United States Patent 6,812,339 (POLYMORPHISMS IN KNOWN GENES ASSOCIATED WITH HUMAN DISEASE, METHODS OF DETECTION AND USES THEREOF) - sequence listing, part 24

SEQ ID NO: 12765 - DNA, 156894 bp, Human
  misc_feature (1)...(156894): n = A,T,C or G
gaggcccggccagcctgcggtgggtgggtgacatgtggcccggatctgcccggggcgcctgcctgtaagtgggcccagcagacaccccatggagccgaggcaagccgtcccagctgaaccggcttaagctgcaggcccacagagtcatgagcagtgaagagaggttttcgccctctgaggtttggggtggcctgttacacagaaatacacacaacgtcctcaggcacgtatctctttaagaatgtgtcccgagaaggcgtcccaggagtcttgatttttatttagccgtccacggttgcccctttgggtgcttcgccttcagatggggtgaagggctcacttgttagctggctggccccaaagacaggcttgttttccaccaggcagtgactgaagccggcagcctgctgcataccgcgggccttcccctgacctgtccgggactgcgggctggcggctgacacctgcggagtgcttaccgcataccaggctcccaaacttccatctgtgttcgtcttttaagttttgttgttttccagagtcggagtctcagtgttgcccgggccagagcgcagcggccatttataggcgcggacctcggcctcgcacaccacagctccagctctgagacacaagcgacccgcacccccccaccgcccagccccagcctccagactggctgagatcacagtgtgcgccaccccatccctggcttgcgatggtctcttactccccactttacaagggaggaaagaggccgagggcagagtgggccgcctgaggtttggaggccagggctagtacaacctcaatttgaccctggaacctgccgcttcccccacccaggtgcgggacccacccgcttgtccacacctggctctgcccaccgcccccggctgctcctctgggctcaggtcgccgcggtcaggagctgccaagtttgcctatcaaactttatcttcgtgcagagaactgcagcctggagctggttattccggtcagtgaaaacgttgcatttctacatatgcttatcatcatctgtgtaaacatttcttggtataactgtggaacagtcagtaaatatagataaatcgaagagtaggtctattgcatatgctataaaaaaatgcttttactatcaacctaaaacaaacaaacaaacaaaaaaaatcaaacaaaaccaccatcacctaaacgttggtaactggagcagctgctagtgtcagtgcggactaaacaggagacggcgggaaccgtgtccagccagggtcctgggccgcgacctggttctcccggagtctacagtgaggatgacgggcggggagagggggccggcgggacccgcgtgtcccaggcaactccgggagagggagaagcaggggtggctcggcgggggctcggcgggggctcggcgggggctcggcgggggctcggcgggggctcggcgggggctcggcgggggcagcgcccgctgcagggaggagcgcgggggcccgggagcctgggcagcaccgcgagacgccacctccgcaaaacgcaaacgccaatcgccgggcgcctgcggtcccagctaccagggaggctgaggcggcaggatcgcgtgagctcggaggtccaccgcgctccagtctgggcgacagtgagaccccgtccccaaaacgaaggcgggcagagtctcctcagccgcgctcgggcgggcggcgccgcgacgccaggccggtcccgcgctctcgccccacgctccggagccgcccagccgcggtctctcagctccggccgcgctccagccccaacggccccgcgcccgtccgccgcaggtggtcgtgagggaggtgccacagctccggctgcccacgacagacacgggcgccccagcgcgcgcacgtccggcgtcgctgcgccgcccccgccccctcggcgtgcgcgcgcccggcgggccggcgggggcggggagggggcggagccgccggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgaggtgagggcggcgcggggccgcggcggctcgggcgggcgcgggctccggaccccgcggtggcggcgtttatgtaagcgccgggcagggactggtggtggggccggagctgcgggccgtcccgggagcggagggcgcccgcggagaagcgagggtgccgcggcaccgcctcgcacccaccctcctgggtcgcccgtctgctccggcgctcggctcccggaggaagctgcgcccgggcggccccgcgtcccctcccgagggcgccgagtccgcgtgggatgcgccgcgctgcgccgcggggagggcaggtgcgccgggacgaggctgcgccctggggaccgagactgcgttttggggaggggacggtgtgccctggagatcggaggctgcgctggggacgaggctgcgcccggggaccagaggctgccccgggtacaaggttgcgccggggaacgggaggctgcgttggcaacaaggctgcgcctggggacggtaggctatgtccctggggagacgctccgcccggcatgggacgctgcgccgggggacggcaggctgcgcccgggatgaggctgggcccgggcaggggaggctgccttgggaggggacgctgtgccacgggagtggagactgcgttggggacgagtctgcgccctggacggtcctgcgtgtccttccgagggcgcagtgtccgcgcgggatgctctgcgccgcgggcggcccgggccagggaagttcctgcgggtgccgggcgtctgcagcgatcgggagcaatctggggcagttgggggcccgaggtgacttttgacgtgttcacatcagaaggaaaattattgcgtggtggatgggtgcgagggaaggtgtcagattgggctgtggacgctgaaacgtgttggagtcccgatttacacgctggaaaacctaacctaaaacgtgttcctgtccaggtttctatgtcggagatctgcaccgtggtgtttagttcccagttaatatttttggtcagcaggtttgggctgttacttctgatacaggcattttacttccttcttactaaccattattgcattccgttctcgaagtataacgaaaagtggcatgatatcaaacttgtttctttaacgtttaactccataattaagatgatagaaccgtagtttttttaattgagaatacaaatatgtatttaatcctctttgtttcctcttaaattttgccgtatgttttattgcttcgaaaggtgccacccagagctgcattttccaaaacgctaggttgtcttaagagcagttgtttctaggagatagaaaagctaattgtcttttgatgaccatcttttccttggggttgagactgctgtatcctttttgcctgctgagggtttcccagaggggaaagggagaaggaagaaaggataaaagcttggctgatacagttccttcttggataagagaattaactgtctctcattgcgcggttcctccggaggacagggtccagtatgcatggacagccacaacgggggctcggtaagtatttgatgagacaggctgagctgggtgcctatatcttgcctgtggtggagaggatgaactcacacagactctgaaaggaatgcattgtctgtgagtgatgccctgttagatgtctgagggttcctaagactgggtatatcccactacatctacatcacatttgaagctgtagttggaaaggaaaaaaggaggccctcctgcagggacaggggcttaaaaataatcgatccagctctgagaaattgatgacacatgtgtctctggtgtgacgtgctcatgcagttgttactgggaggccaagggggaaggattagctatgaagtgataacatcatccacaaaaaacatcttggctcagaggctaatttcacttcctcgtgaatttatgtattgtaaaacatttgaattcttttagatttttggaataagaatttttttaacttctatttgtccagtgaatgcataaaacaaacttaatccatttgacaaatacttgtctgtggcctgttatgtgctaggccttccctgttttaggccctaggagatacagtacttaacaagataggtagagatcaaaaatgcttctggcataaagcagtacatttgtattgatagatttaaaaagataagcaagcacacagtacctacagaaaggtaaagcctcattccactccatccctgggcacttggttcaaaggctgcacccaattgtgtattgtcctagcaggagtcaaagtgtgtattgtatatgttttaatatatgacaaaccttgctatagtgcatattcttacacgtgggtacaagcaaagcctactaattagttattatcaaaatttcttagctgtaagttttacttaagaactgggttttattcccttgaatgctgtgattagctctgtgatcaaacaatataattcaaataggaggtagttaactttggaaagaaatagatgaagttacacatttaccagcctataaaaaagtttagcaaagttatcaagcttagtttgaaaccaaaaagctcagagaggtccaattttattagaaaactcaatggtggccgggcgcggtggctcacgcctgtaatcccagcactttgggaggccgaggcgggtagatcacgaggtcaggagatcgagaccatccttgctaacacggtgaaaacccgtctctactaaaaaaatataaaaaatcagccgggcatggtggtgggcgcctgtagtcccagctacttgggaggctgaggcaggaaaatggcgtgaacccaggaggcggagcttgcaatgagctgagaccgtgccattgcactccagcctgggcaacagagcgagacgccgtctaaaaaaaaaaaaagaaaagaaaaagaaaactcagtggttttctgtgtcaactttctaaaataggaatttctaaatctgtaatttggtgtgatggaaatggtgttaaaaaaaaacccatattattttgtatgttcataatatgtgaggtaggaaaagcaaatgggaaaattaaaaattgtccagtgaaatcattaagattccttccttattccttgagtgacttttctttccaagttgacagctttttatctggggtgtggacagggacagcgcagtagcccacagaggtcttcgtggcagggcttaccgcaccttccatttgcagagttttgcttcatccatagcttgacagctgttgggctagggccattaatatcaaattatcacaattttttttttttggtagtttgattagtactgcttgctgcacttttccacctgtatgcctataagatgtcctaggcgtacacaaagaaaagtgactttggttttaggtttaacgtctttgtgatggaacaggaagggggatgaaagtaactctgagataccttgtatttttattggaagtacagtgaaatggaagctctacttgcttctagtttggtgattttggaacctggttccatttcatttgcttgttcatccaacaggcattcacccatgcatcctggcccaggtactgttctaggtattggagattcaggatgagcctgatgaggagagttcctgccctcaagcggttcattttcttgggaaggaggagagcagtaaacaagcatttggtgtcctaactgcttcaaagggcaaatgaggcagggtaggtgagagaaggtcaaataggtggtgaggatggagtgagctgggctgaggtcacggcagcagcagcctctcaggcacagggaactctcgggtgaaagtccctgagcctccttgtagtatggtggtcacctcagggaggccattgctgccagagaggctgggcgagtggtaggaagtgagatgggagtggaggagagctgcatcttggagcacacaggctgtggtaaggaatttagattttaagtttgatgggaagccttaagggagcctttcttccttccttgcgaatgacatgatctgatttatctttaaaaagtaccactctggctgttgggcttacaatatgccaggctgttttaagagctttacatatattaattcatttattcttatgacagtccaaaaagtaggcattattatcattattcccatgttacaggggggaatacctaggcacagagtggttaagtgatttacccaaggtcacacaggaagtggcaatggcaggatgtacccttacctccttactgcagcttgctttttgcacctccactactgcagactggaggaggaatatcagcaaggagatcagttagacttttgtgaaagctgggtgactgtaccggcacctcagaccagggcggaagtggtgagatcagattcagcctactgaatttcagcatttgtaagatgccatcatttttaagttgcatcatcatttcttatgctgctaacaaagggaaaatgtagccaactagattgtgacacaatgctttcttgttacccagcattcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaagggccagatctggaggacgagggttgggtcattgtgcagctacttcctagatgatcttgagcaagcagtctaatctctgtgcttcagttttctcatctataaattaggaagaataaaagcaacttgtcagggttgttgagttgctaatgtaaagtacctaaaatagtacctgactaacagtatttaatggggcttactttgcttattatttttatgattagttatctgagtagagaaaggtgaatatggatggaaattcaaggtcaggttcaagaagaggttggggccaaatatgtaaatttgggagtcatttgcatattgctgatctatgaggcatacagtatggatacagaggagcaggagatgaggaatggcctgggagcttttggcaagcggtccacattgggagggagggtctagcaacgccattgaaaaggactctgtttgaagaaggaagaaactagtgagagtctagtggcctggaaaccaagacaccgaggggttcttttcttcttattcttcgtgggctggagagtttcctattggctttgataagaggtggttgtgagtgaccttgataggtttggagtggtggggagaggaaacaaatagagtagaggtgggaacatcagtgtagacgactctctagaggagttctgttaaaagggaagagtcatgggatggtggctggaggggacatgggtacaggaagtttttagttgtatttttaaatgagagcgatgatagcatgttatgagctaataggaatgatccagtagagggaaacatttataatatgccaggaaagaggataatgttggagccaagtccttgagaaggtgagagggaggcaggaagagcagggatgctcagctctagaagggaggcgggacttcaggagggaggcaggacttctgcacgtgggagcctggactcagaaatattcctcaagacatgctgcccttttgaaaggaggataggaaataaatcatggttttgtcctcagtcctaaaaagttcggaatctcaccctaggactcaggatccagcttcttaccagcttgtgctgaacatgccatggggcgtacttacggaaagatacatgtggaaatggaattttttatttatttaaaaaattcacttttctctaaaagtattgttacctggaggttggcacctttattcaccaaattcagtactcagaggactagaagactcggtgcctgatttgtgcttgatttgcctagctgggaatttcagttttgcatttaagacgactccctcaccaaccctacccccagaggaaagcaggtattgttgctttgggcctgttgcatgtatatgtttatgttccactgggtcagcagcattcagtgaaacacagttgcctgttaacttggtaaaatatcttaattgcatgagttttgatttgtttttgtgattatttgattttttcaggtttggagtttcagaacacccatcttctcagtagttcagccaatgcgatgaaatgtgaagaagccttccccagcttccttgcattctctccatcatctgtgcagtggagagtagttcccactgctgtggaaacattttccctttgctcttttctctcagggcaggctttcctgagtgcctgctctgtgtgagtcatcgtgggaggatgcggtggagaaggacagggaggaggtctgtgcttctttgaactgacattctggtggagaaactaaacagatcacagaggcagacaccgtgcctcacaactacacacggacccggcttatgatggttccagtaacaatttttgacttgactgtggtacccatacagtcattctgtttttcacttttggcatagcattcaataaattgcatgcgatattaagtactttgttataaaataggctttgtattagatgattttgttcaattgtaggctaatgtgagtgttctgagcaccttttaggtaggctaggctaagctttgatgtttggtagggtaggtgtattgaatgctttttcaggttaggatgtcttcaacttgcgatgggttcataggatcggaactccaccgtcagtcaaggagcacctgtgctgtctttatcggcatgaccgaggagacagggctgaggtagatggcatcaagagggtggctcctggtggaggtatgatgttctgggaaggcctctctgagtgcgatgtggtacgctgaggcccagagggaaagcatgagctcatgtcaggaggggggacaacagccttctggctagaaggatagcctgccagagagcctgcttattagagtggccaggataggaccagaaccattgtccagtcaggggctaggaggtgaggctgcagagacacaggggccaggtcctgcagactctcaagagtgcaacaggaagaatggaggcctgggttggcactgttgccatgatttagcggggcagaggtggcagaactggagaaaagagagcaggtgtgaattcttggttgtgggcaatagatcaggtcttggagacaagggaagtggagggaccaagaagggctcttggagctctttggatggtgatgatgtgatgatgccacgttccagaggatctcaggttaggagtcttcaactagagacctcattttgtattgggttctgtttgagtctgcaaagcagttgtcatctaatatgtgactagcagaatatttgtttgtatagatacctctcaacttacgatgaggttcataacttaaatatattgtcagttgaaaatgcatttaatacacctaaccttcaaaattcaaagtacactttctattaaatatgtatcactttcacaccatcataaagtaaaaaaatcataagtcagactgttgtaagccagcgtctgtctgtaccttcccacggcctacaaaatttgtaatgcattgtttgtaaaacacagacacgtgcatttaaacttttattaggtagaactggctcttcttcagggtccttgtaattaagtcagttattcctctcatgacattcttgtaggaggtctcattacccctatttatcagatcagaaaactgatgctaaggggctcagtgacttcctaggaaagctggataatgtttaacatttattaagctcttaccatgtgtcagacatggtaaagtgagtttaatctagtttaatcctcatgatgatcttaggatgttgctattaagggtcactgtcatcatccctttttactgataacactggcctggcttacctgagtagcctcctaacagatctcttcttccacttctggtctccttcagtctgttcttgaccagcagtcggatctgagcctgtacatggaagacatcacgtcattctcctgctcagagtccccctgcggccttctttcctgctgtcccttcctgccactcagagccctggctccagctgtcttggggcctatagctagccctcacttcagtgttcatgcaccattgtgtgctgcgtgccctgctcactgttctgtttatttctgccatctgtacccaccactaccttcctccccacacagcctgcctggccagaatgaaagcctcaggaaggcagggctattgctctgaatctgtcctgagggctcggagcaatgcctggtagatagacacttgtaagcctttgctgaaggagagaataactttaacttactttttctgttggtagtaagtagtagaacctgcattaagtttatctgcttctgaaaacgtatgcttttgctgcctccctacactgcccccccatcctattgtacttggtgaatcagtcatatatttatgccccatatgtctgtgttatctccagatttccacacttttctatgtagaatagaaacatttataaaacattcaaaattgttataaaaccataaagtttgacatagtaaattatctgttgaaaacagggaggccacatcctggaaaagtagctctgtcctgccagcatcattttaaccccttttggacaagatacagttgaaatgcattctctgaaataatacttataactacatcttgacagaaacaagaatatttcgaataattctgggaggattcaggaaaaggcagccaaataaaatgaaaaaatacatttgattcaactgtggaggcttaaaggaattacacatcttttttgtttttttgcgacagcgtcttgctttgttgctcaggctagagtacagtggtacaatcatagctcactgtagccacaacctcctgggttcaagcgatcctcccgcctcagtctcagcctcccaggtagctggggctacaggtggatgccaccacacccggctaatttttgtattttttgtagagacggggttttaccgtgttgcccaggctggtctcgagctcctggactcaagggatccaattgcctcggcctcccaaaatgctgggattacaggcggagccattgcacctggccaaaaaagcatctcttataagctgtttttggtgaaggagcaaacaggaaagtgtcccagaatttgggagatcaggattgtaatcccagccctgcttctgaacaggatggtgcattctcttcatgcctctgctgcaggctccttggatgtagaatgagggcagttgaattgcttgttgccgaggttctctccatttctggaagactattgtaagtcagagtcaaataatcattcattcagttgtccaataaatactcatcatagaacctatgtgtagtcctgtctaatggtaggtggtgctacgtcacttcctgccatggctgccgaggctcacgcgaggctggcacttggcagagagtcctgtcccttcttttgactcagtaactgtggaaagaggtgaggtataggaagggagggcctaggccttaggggttaagcgggcttaggaggcaggattgagagaggtggaatgatggattcagagtccaagagaaaacgtgaaactccaggggattagaattgatccctttctctgtttcctcagtcttagggggactagactgtgttagttgtcttgaattaaattgagcaggggttgtttttcacttctgtaagtccagagtttatcataagccaccagaggtaattcagtagtagttaatatttcattaaccctcacttctaaaattacaaagttagaagtggaggtctttaacatatatatcagtcaggctggagagtaagttggaaagttgcattttattcctgtgtgtttacttatggcagtgcacataagcccagttttgtttctttttctttgattagtaacagttgggcacaaggtgtccaacccacccagtgttaagtcacttagagtgagttgatttccttgaaaaaaggaatcttttcaagaatgtaaagtggcttctcgtagtcttcgtgaggctctggagtcagacacaatactgggttaccctgggaccatgtgcagtgagcccgggcttctggagtcagacacagtacctggttaccctgggatcatgtgcagtgagcctgggctgccggatgccgctggtgggccctctgccagctgctgcatccccaagccctctcttgtgtcattgttttcccttttcaggaatagtttccactagggacctgctccctcaaatttctatcatttgaggtgaggtttcgtgttggttcatctgactggccgagtgcaccctggctgtgagaacaggaaatagaattctggcttttgtcttagggatatccccaggtagagagaggagattcaaaagatgctggggagctacagacgtgacctctgacctctacatgaagaatggtggaaaacacttactacttagtgttaatctacacatttcacttggtttagacctaagcataaatagtgtgaagtcgatttaaacagaggttacagtttccagaaacttcagcgccgtggctgcagttaaacagcaatgattggactctttacgtctactccattctcgatatgaatgaaagtagtcacatcaaatgcatatttattagtcttggtcattttgaatttgagtcctttacatactatgtatgtatgtacccaggagcagagcagggttaaaagtgacatcttctaacttctactctggaattttttccctctgcactttttgttgtcacgtagtagatgttttcacccacatgcaggtgaatgagtgacatatttatcttgttacatagtgaagctttcaattctttaattttatccctctaatgaaactgtgaggaattgattctgttgacacagaaaaggctggtgtcacatgaacctaaaggacgtcattgagcatgtgcctctcacgcagaactgacatagagcctcccgtgcagctcaccttgaattctccatgcacgaatcagccataggcacgtgttatgtgtggcacaggcaagaagtgcctgatagattttagttctgtttattgctggaagcccttgctgtaggaaaaggaaggttttttcctttcctggacaatgattttgagctacggtgtagaatggaaaaggcaggctttgatttgccagacactgcttgctatgtgtgaagccgggatagggcggtgctgttggacagaagacctgccctgtgtgccttttcacactgcattgagaatttgtctagatgatttcctgggcttattgattgttgaaggaaacaatgcaaattgcaagttatgatcaaataatgctttgagtcttcacctttttagaatgctctgggaaaatacggggagaaaataaaccataggaaaggcattttgaggcggttttgttttgttttaaacagctgccatgaaatgcaccctctctaagaggacaattcagtgattttctgaatgtctgagttgtgcagacatcaccactgtctagttcttgaacactcctgtcacctcaaatgttccctgtgcttgtctgcagttgattcgcgcacccagcccagcctcaggcaaccgctcaggcagcctgcctgctgtttccacatgtgccttgcagatatttcatgggaagcagctcatgtcctgtgtcatcgtttgcatcaggctttcacttaacatgtttttcgggttcatccgtgtgttgtagaacatatcagtagtttgttccttttagtcgtattggcgtagcgtgttcgtttattccactccagcgatggactttgggttgtttctgcattctggctattatgaatcacgtgactttgaacattagcaagcatgtctgcgtgtggatgtgtattttcatttgtcataggtagattcctaggagttcgtaggagcttcgaaatggagtttaagacagaagcctttgtttgatactgataatgctagcaagggccatttatttggcttgctcttgaagtctgtctctgtgatgtgcattgtgcttcttgaattgtatgagcctactataggatgaaatatggttataatgtcgagcagaagctattagcatttcttaagctgaccacctgtgttgtgcacactattaggtcctcagcagatgagttcttaccgggtgtttgatgttttccccccacttatcagaagaggaagtcggtgaagtacggttgggcatattaaaaccacattcagcctacaacaccacagaaacacttaccctttgacccagcaattctgcttctaggaatccttccagaagatagacctccaacaatgtgaaaatacattcggaataacctaaatatccatatgcaggagagggttgagtaaactctagtacagccacacaaccacatccactgttgaggatgacctctgtgaattggtttgaggtggtttccagggcacgtggatgtgaatgaggcaagtaccaaagaacatctaaatgctgcccttgatgtgagaagaaggggatgcaggaagacacacgctccctgcacacttgtgcagaggagatacaggagggcagagccagaaacaaaagagatggtgactgcagagggccaggggacggaggaggagtgggtgccaggtcataggtggggtgcagagggcgagggggcagggaagtggagtgggtgccaggtcataggtggggtgcagtgctgctctcagtacaccttttagtgtggcccagctcttgaaaccacagcaatacttcatatactccaaagtaaaatagatggttaatatcagccaggatgtgggggacccaaaatgaaatataagcggaaaacacacatctcactgtagtacaaagcggcagggccacagcaaagggggtggaaaggaaagtgttaaccttatttgggaaaatgataatgttgactggattctgtgaggctgaagagaactgtacaaaatagtagtaaatttttttctcagtgttaatggtgagcaatgtgaaacgactttatgtgtatgtggggattgaacaaataagcagaatcgtagtggataatgagagccaggtttctcactgtcccaggaagaagttacaaatagcaaaaggaagatggcagagggaggccgtgctgttggattgggataggtgtcagtgtgactctgtggtctttaatagatgcatgtacagcacaggagtaaacataggtgtacgcgttacatgcatgggttagtgatacacctacatatgcatctcctagccttgtccgttgggaagacctagaagcaatgacctccagcaacagggagcacacctaaatatcagttgctgataaaaataagcagggctccttgcagaagatgagtctggaacctctgatgatgctggaaataaggaagtggccaaaatggatggggtgtgtcagagggcacataagcaacctggaggagccccatggccaaagcgggtcaatttgagcaaggaaatgagtaatgatagtataggtgtataatctataaaacaaagtcagtatcactactgatacttcttatattgatataagaagaaattgaaaaaataaggagaagggacatctcttcctgacagaaacattccaattaattggtgtaggagcagtgagaaaatagaaaatcgccttcaggcggcactatggaaatagttacttcaggtgagttccgcgggaggatgctgattagtgggccagagtttggagagaaacaggatatttgcctagtctcgaagtatctcttcctcaagttatttatttattaaaaagggaaaaatagtaactttagaatggaggaagccagcagacaccacgtcacctgggcgatcaagatcagcatcatctgatgagacaagttgcatcatatgccgccccacaccacatggcatgtgctctgtcagggactcctgccacaaatgcacaatcacagtctagtcatggagaaatgtcagacgctccagtagagggacgtcctgcaaaatacctcacctcatcagtgttcctcagaagtgtccaggtcatgaacactggaaacaccgaggattggtctaagcttagagacctgatgactaactgtggcctgtgattctgggcagaatcctggaacagaagccggtattggtggagaaaccaccgaaattcagatgaggtctgtggtgtagccaattgtattgtgccagtgtttattttctgatttcgatatatccttctcccagctcacaacatacaggtctgtgattgatacatacttctcctcatgctcacaacttacaaatctatgattttagaggaagctgggagaaggacataggggaattatctgtactatttttcagccttcccataagcctaaaatttcaacataaaaagttgaaaaagaaacccatggcagaatatgatgggagaatggcagaaatggcaggaccagcccctgtctctgtttcttcccatgtgaagctgtttacctggtttatcttggtctttggatttggtcgattttttttttctaaaaagaaattttaaatatagtcaaatttatcagtttttttcctttatggcttttgggttttgaatcctaagaatactttccctactacaatactcatatttttctttaatttcttctaatagttttatattttgtttttcacatttagcatattgatctatatgaaatttgtttttgtacagtttgaagttgggatattttttcaattggctaatcatttgcctttgtcattgagtagtctgccctttgcccagttatcagaaatatcacctttatcactactaaatgttttctttcaatgatatttcaaattgcttattattcttgtgtgataaagtgattggtttttgtatgttgtgtccacagcttgtcatttgtgtctcatgttttctagatggaggatccttttgggaacatgcgtcttcctttctaagctttgtacttcccctgtattaattggctaggacttctggtactgtgctgagtgtagtgtttggatcatagtgatggctagcaggctgcatctcgttgttgtctttgacgtgaatgcttccagtatttcatccttaagtgtgacattactctagttgttttgtacataccctttatcttgtctagcatgttaccttctcttcctggtttgtccaaaataatctttatcatgagtggcagtagaattttaccatatgtgcgtctgttgaaatgatcacgtggttttccctccagtctgttaatatagcaaatttcattaatagatttcctgatattaaacattcctgcattctggggaaaatcctgtttttaacacagtgcaaaattaaaattgctatttattttaataccttctattttttcaaaatgagtctctccccagccctacccctagtcttttcatttttttcatgtagtttacatgctgtagtagctacatagtggtataagtgcttaacacctggcttttggtgggaaggaggagtgggagtgtatggaaacccctgatttgtagcatttgccaatttccaagttataaatgtccctaccgtgccctatttcaagctaccgatgagctgtcaactggtttacaaaattcctgaaaatgtgacagtcttctctcatgaacaggtataagtataccagtggggcctgagtgtgcagcctggtgactctcatatctgtgtgcactcacacaaccatcactgggatcaacccggaggcttcctggtacctgtgcagctcagcactcctaccctccccaggaggaccccggttctgacctctctccacctttgttctcacttggggattgaataccttgtttattttcacgtcatccttgttttctcttctgtgcacatgcagctctacgttttccccccaagaactgccttggccacctcatttgtagatagcgaaatgcagggtttgtaatgatttttattgaaaaattgagcatctgattattattgtggcactggctttattaaacaatgtaggttctgtgataacttttcttaaatgttgggcattgctgccatgttatattcatgaagttcatcagcttcatataaactgacgtttttcattcatgtgtttatgcagtcattgaataaatattttttgagcactttggataccaaaggtttagcagtgaatgaaataactcagtccctttcttcacagagcatatgttctgctatgtctttaagtcacgtgttttttctatttgaccgtccttgccaattttcccctaactcagacatccacttgtctttgcccctggtattatcttaaatcaactctaaatcaatccgatttcttccactgcttcaatgctagttgacgtttggcttaactgcttatataattatttctgcttttattgaattcttatgatgaaaaaacagaagacttgaatctgatgatttttactttagaaaggttaatgatgaaagtgttgtaatactacagtttggtgaaatggcactttttgtgttgtgtgaactgtcatcacttaatgaggagcaggagatcagcttacagttttctgctatagttctggacatcatgagaccttattccccaccagcatgatctctgtctatggctcagagggagagcaatagggatatggggtgctattcacagccttgcctgggtgactgtgtcttctggcagcttagtggctcccaggggcaggatcctggtcaccagcatcctacagcattgccacatgtttgctcatgctctggtgtcctgtggagtagagctccttgttctcctgtggaccacagtccagggagagtgggggtttccctgtaggaggaggagctggaagactccagatcgagtttaaccgtgggctaggctgcgaaatttggatgcaggccagtggacctcagaaatccatctgttcatctttctgctaaactgatttggatttctgcttttttaatcctttgcaaaattaatttgtctttaatatgaaaatcagtgttttatttttagtaagagaaaataattctattttatttatttggaacaatttaaaagaccctagagatcaacatccttcctctttcatttcctagaggagggtgtagaggagcagagtgtgtgacaggcacagtgggactgacctttgcttctgggcctggattaccatgtctggagagtgatgctttggaggaagtatgggtcacttcgctcctgggccgtcggttcagaaggtgcagccttgcccggagctgaggtccagtgctagcagcacattccctttccttgccctgagcctgcatggcagccttcttcatcaactggaatctctgttgaggatggagaaaaatctgtggtccttttgtttactgggtgactttctgacctctctctcttctcattctctctactgcattacaactgtttgatgagagagattttaaaaatgaacataaacaatttttatggaaatatctgttatctattttttttatatagttataccattggaatttactcttaccttcaggtaacagttgtgaggaccaaatcttaatcctggtaggtgacctttaaatcttagaatcaggaattcggctttagtcaaaagttaactttttccttattattgtgctcctgttggatttttaaaaatggatacattctatttattggtatttacaagtcacttgactagactgatactaatagtatgacacaggaaaaacaaaaacatctttctgtaaattttgaagtaatgaacaatattagggattattccaaaacagagcagacaaggcagaggaaaaccagtcaagctctttatagcttaaatctaaccctttacctgaataataatttaaaaaactattttataaatcaagcctcccattcctgtaaaataggagtaattcattatcacacatttttgtacctttaatttttttttttcttgatggagcccaagtcttaaagatgtcaaaactagtatcatgttccattttctaaagtcgaggctatctcagtcccatttctatagccaacagggtaatctgttactaggccctgaaacccttctgatgagtctcagcttataccccaccccacccccaaatattcacacaataggcacagtgaaaaccaggaaattagtctctgaaataagcagcctccccaggaaggaagcagcatggccactgcccattctgtgcctggacctcgccccaccggcacttggcttcaggaactggactgatccaggcactttgctggggtgcactttggcttttctcaccagttcccagggcagcctcgggtaggagtctcgggtaggagagtgttggaggccctagatctggggctacagggacttttctcacaactccaggcgagggcacaccgggcttggctcttctaggtctggcgactgctcccattggcaggtgtccacaggcctctgcctgacgtccttgacaagaggaagagaggacccggctttctgtgggtgccgagccctctgggccacacagctgctgttctctgacttgtgggtttttctgccgcctcttgcgtttcatgctgtgactctggaactaggtcttaccctgtttggagtgaaggttcggggtgttgggaagttctgtcctcttctctcaggaagaggccctttgactgtgtgcccggaggaggcatgggtgcatcttttctccagggggctcctcaccaggggtatggggagactgtgctgcagcctcaggaatgtcagggtgaagaggccctggaggctgatgcttccggccaagggcttcttctggattttcaaataaagtcccagaacagaattactttatgttttaatttcaggcaaatgtctctcatctgcccttttaagtacattaggattgggtttttcgaccctgcacagcacatgggggctcctcagagaagtgtctgataaaataaaattaaataactcgctttttagcacttcgtttttactggtgatttgttagtcattgattgaggtgattgtgattgatccaattatttgtctgcccatcctgattgtaactttttttatttacaggattttaaaagatagtttcttgatcttaatgttatatttaacgttctctttcataagatggttttttgatgactttgtgtttaaaaagtgagggtcttttgagaaatagaatatatcaaattatttgttcagaaacattcaaaagcattttttccaactctgcaagcagttgtctgttaaagcaattagcgtgtacccaattagagctctgttcaagatccctcactgataacctctgtgaggctgttggtccgtgtctttatcaagcagtagtgtggcttcccaggtactgtcagctcattttggacccaatactagtttattgcctgaaattacctttaaactggaaaatcttcaagtaaaatttttgagagtttttgattaatcccctaggatacttttgaatgataggttttggggagatacatttggttgttttggcaccactaccatcagcctcactcacgtgctgccaggcgccccgccagatcagggaacatcctctgtacatggaagcagccccgagcactatgtctgcttgtgtttctgctctcaaggtttctacggccctgcacgtgggccctgctgaggccccagactgcttcctcacacagctgacctggtgggcttcctgtccacacagctgcccttcctgtcctcccatccaacctctcgcatcatgttgaggggagagaggggggcaaatgagacatggtccttgctttcatggaaatttctagtgatgcagatgtctgtatatcaagtactcacacaagcagatgtaaagtcataactgtgatgaaggaagaccaattgaggacctccatcagccgaggggcctggacgctcactgagaggcgaggtttgcactcagtctccttgcccaaagctggcagcctcattctgctgcccatgtgctgggcaccttctccactatcacgacttccttgacatttcagtctgttctgttcaagttttggccttccatccctctgaaatgggtcttgctagtcactaatgatctgtctcttgttaaggtcagtggcctgtatttcgtcctggtctcaatcagtgtctcaacaggactgtacagaactagccaacctcttggattctgtgggcagtgccaccctggcatccttctggctcagtcttctgtgcaggtcccccagtcaccaggagccctgcaggtgcagcctacctgcccccagcccaggctgcgctccctgcttgctctgcgtgtgatgctccggcctttgccgtgagctctgacacagtgcagcacagacctgcttgagctctggatcccctccccaggctcctgtccatcctgccccctttcagcttcctgcagtgaccattgcctggaactcaacccagtgttttttctctgccccctttttctgttagctcttcccccagtggtgtggggctgggacaggggcctcacattgtcgtccacgtttcccgaggcttctgtctctccatcccgctgtttcagggttctgcatcctgctgtttcagggttctgcatcccgctgtttcagggttctgcatcccgctgtttcagggtgcacgtttccttctcgggcttggctccttgggtcatgtctccagcctgacgttccagctgagaggtggtgaggcaggaaggggtgtctctgcatcaggaaagcgataaggagttcaggaaacccagtgtctctcattggctggaagagtattacacggctacctctggttgcccagatgcctggggcagggtctgtgctcgagaaaataaggctctgtgagtaagggtctcccacagccagatcaacaaggagctgtaggctgtaagtcctggttcctgactgagggaggcctaaaaagtggggctgttggggctttatatttagcacccactttttaccctctcaaattccagaccagttgagagagccgcacacactgtagataggcaagtggagatcagatacaggctctgttttagataaaagcaactggagaaagtggctgactggccaagcgggtttgctaatcctttatcccaaattagacaaacttcccacctagtaacgagcatggctgggggcaagccccttccacgtggcaggagaagaaaccctagcactttggtgtgggtgcgcctagcccaagaggagaggaggaccggctgggctaagcagcccatttcctccttctagatgcctccttctgcaggaaagagtgcgtgagttggattctgtccacagggaacagaagcgcaagggacaagtgccccctctgctctgaggaagggttttgcatatctcctgttggaagtctggaagctgggcagtctcgctccctgcaccagctgtgccggccctgcctgtcttcctgcaggtctgggctggctgctgtgggcctgtgtcctcaacactgccctgccctgaggctgttggagggacagccccagtgctcccccttcatcatccactctcctttccctttagtgtttctatctctggatttgtttctggtgagccttccctccagaaggaactgctcttgtccccatgtacttcctcgaggcctccctggtcgttcctaggggcgatcatactatagaaagaacccatcattgtcacccagaagtgctcctgagagatgagggaacctctggggaagccagcttgggcttcgggaggaattttctcctctctttatttttattttatttttttgagacagagtctgtctctgtcgcccaggcggtgcagtggcactgccagctctgcctcccgggttcacaccattctcctgcctcagcctcctgagtagctggaaccacaggcgcctgccaccacgcccggctaattttttgtatttttagtagagacggggtttcaccgtgttagtcaggatggtctcgatctcctgaccttgtgatccacccaccttggcctcccaaagtgctaggattacaggtgtgagccactgcgcccagcctttctcctctttttaaatgttctcaagtagcttcctcttcaagtccggtttctttttcttgttttctgctgggaactagatgtagttcccctccttcctcagcagcaccctttaggtacgagacgggtggggttggccctttccattctttaaggagagtattttccactgtgagatggtcacataccttctctttggtaacaggacaaaagagcaaatgctggaaaaactaagcttatgagctttggggaagcctgatgtgcaaatgagggaggctaacatgattttcgggctactggattggtgctcactcccaatttgaaaactagtcaggagataccgaggccctgtgtgatgtggtacaaagtataaggcgttggccatggtagagaatcatgatttttttttttttttctggaggtgggaagccattgtggttgggggcatgaactcagagttgtgccgtggaagggtccctgtggcaggagaacaggtggagagcagacgccgaggggccgctgtccaggcaggagtgatggagcatggctggtggggacttcagacacatgtgcaaggttctgaggatgcctgggtgctggccatgtggcaaggtggaaggcagtgcctatgactggacagctgggagggagcccactgtggtgatggggagggtagactagcaggtctgtttgggtatgctgacttgggggcactcaaggggagctgtcagggaggccattgggtggaagcaattccagagacaaaccgctgctccctaaaggaaaaggagagtgcctttgcctttcaacctgagctccatgtggtcctctggcccagcctgctaggcagcctcgccctgctccccactgatgtcacacaggtgtcacaaaatgaacatctgaaaccagagcttcattttcctaaatttcctagcctttctccttacagtgaacgtcaccaacacccacccagctgctggaaacctggcagtcatcctagccacctcgctttccctcaccgtcacacccagtcccctcaaacatttgtgcctgctgtccctgcgttcgcttcccacccgggtgcttgcctttccacgtctccctgctgtccagcagctggcaagtcattcctgccctgtgcttgcaggctccacggacccaccagggcatctggaatacaactgtgacttcctcctcaccccacggctgtgcttgacccggctcccatctgtctccagatcccttggagcactctcccaggtctgctgcaggcccatggcctcctcccttggaccactctccccgtctctgtctaggggctgctcacagcttcctagaagtttcttgcctgggctttgcttattcccagctggtggctttccatctgtgctcttcctctgctgacggccccttctgccccagctcattatatgaccgttgtctcccatcccgtcccgacctgcctgtttatggaggcatcctctaggttctcagtggagggtgcctggcccctggaacaaaactgttgagtttgaatcatccccaccctgcctcttcctagctgcagtgctgggcctcagtttccctatgtgcaaaatggggacactcaaacctgcctcattcccgtgaggattacatgattaggtaaagtgttcgtggcagtgtgggggatggcgagtgctaggcaggagctggaggctgttctctttgggctatttgcacacatatgctcttagcctcctttcgagcactttcctcagccttcaatcttgtgtatatttgtgtgtgtttctcttttaggagagagacttctctggcattgactggacaactgtcagagcttatccttgacctgagctcactgcctctgcctcagaattgggggtcaggttattcttagtattctaggtttataaggccagacagagtccttcttccctgtagagcagaaatgacccctaatataggagcatattgttttccctcagcagagcaaatgcttcagtagtagtgttaccagcagacagatggcgctttagaggtgacatgtgatagatgcttgggactgaaatttagccgtggatcatagcctgaatgggattttcacgcatgtcttccctctcaggatttctcttaagggttgttgattccacatttctccttgaggagggggtggtggtagggctggtgaccggggaactgtaatttcctgtgggagagcagcaatttcattattcctttaatgaagctatagttgatcatccttcagtgcctagtatacagcctgttaaattagggtcttcggattgctctgcaagcctttttaaaaaaataatttacaggctgggcgcggtgggtggctcacgcctgtaatcccagcgctttgggaggccgaggcgggtggatcacttgaggtcaggagtttgagaccagcctggccaacatggtgaaaccctatctctactaaaagtacaaaaaaaaattagctgggtgtggtggcgcacacctgtgatcccagcgagcaggaggctgatacatgagaatcacttgaaccttgggaggggaccactccagcctgggtgacagagcgagactctgtctcaaaaaaataaaaaataaaaatttacaatttatgttaaaatatgtcattttaagttatgtaaatccaagcataattactgaacacaaggctcaatccaaaacatgcacagtaagcccgtgtgaagtgttcacatgctgttctgaggctggctggatctggagtttctgggagtgctctcttgggctggcacgtcttgggctgtgggggccctgaagccctcctagatgctggacattggtgtgtgtgcaacttggtggtggtgttggggttactttccagaagctactcaaggcttagtctcagtttctatctaaagatatttatatgggaagtattccaaatgtggatttataaagataacacatggatagaaatagtgtaaaacttgtgtgaactgaaccagccaagcttctagtcttccctttccaaaactttcctttttctccccccgtgttaaagatttaaaaatatatgtttaaaaaggtcacttttaacttgtaaaaattattcaacatatacagaaatttaaaaagcagcattgcaggttatgtgagattatgtatgtctgctctttggaactaggttgaaatgatagctacaaggttctttggaagaatggggatgtgtgggtgagagtggagtagacaggctgggcttactaactaggcttgcactggcccccgtcagtcactgttcccaagtcaaatactgcattgcactgaacaccagagcagcagtgcatttcctagagaactctgcaaggctacaggtggcagacttagggagcgcttgccatccctgcccttcccagctctacccagaacaaggaggcctcgcacactacctggtcatattttgacttcatgcatttaatgaaccaaactaaaggtaaatattttcttttgattcccaaggcagacttgtgggtacccaagttcctcagcccatctttaactcagtaggatgtggcatctccattgaggctcttcatggaatccctggaggtgaaacctcggtgtccggttgctccaaaccagtgctggtgggattcagttttctggacccatttctgggtgaagtcaaggaatggaggcgggcggctgtcaagcgtctctgttgctcaatggggcaggccagtcccagcggcgacttagaggtggctggctgggcgtccctacaggagaatgggccacagggccagcggggccagcaggatgagcaggcctggtttggggtatgggccgcaggcgtggagctcgatgctgggcaggggcctgctcactgacgagttgccacccgggattggggtaggggtgggcgcggtggtctcgggctctgagcggctctgcaccggcaggagcaggactggcagcagcagcagcagcgccagtgcggatcgggccgccatggccaagcgctccggctcgtcccgtagcagtgccgcggcggcggccgctgccgggagtgtctgttccgcggttacgcggggtcctctccggtcctgtccagtgaggtcctgacagctgtaccctggcccaacccctgcccacggctgttaacgatcagcctcggggagcaggtgtgccgccacgcgcgccgtagcgctccggagctggctctgcgctcacgtgctcgctgtgccctgcgcgcgggcgggccgtgtccccgcagccccgcgcctggcgctgccaagctgcccagcgggctttagcaggtgctgaaatgcccgctgccagtcgccgagtgctgggtgcagaggatctctccagacacctaggctcccttctttcgcggcacgtgggaaaaactcctgaagtgcgtgcacagagtttttgttttagaggctttgacgttatgattaagtatacctgtgatgtaacgaaaaccttttttaatgcttctcaaaagatttgctagcgtttaacatttacctcctgtactggagtttaaaggaagcgttgcttcttaagtaatcagtgatccttttgcttttggaaattgtaatgaacttcaccatcgtagagctttaatatttctttcctgaagcagaaagcatgtgaaattttctggatagtgtatacttaatacgcaagcttttggagtttttgaatgctgggtatgttagcacaccagtcttgctgactattacgtgggagatgagtgctgcttaaaattgtgtaaggggtcagtagttacagtggtggacatacttttgccagacatggtttattttaaagtgaacatattttgtgcttatttatttatttgggacagggtctcactctgttactcaggctggagtgcagtggtaatcatggttcactgcagcctcaacttccaggctcaagtgatcctcccacctcagcctcctgagtagctgggactgtggggctacaggcgcactaccacacccagctaactttttttattttttgtagagacggagtcttgctgtgttgcccaggctagacttgaactcctggcgtcaagcgatcctccctcttcggcctcccaagttgctgggattacagatgtgagccaccatgcctggccaatgtgcttattttaattctaaatcagaatttctataattatcttccttaccttggtgtctgtctgttatcagcacaagggtttaaaataatttttgatttcttggaagtaattacgcaggcagttcaatgggagaaggcactttcctcagcacatttggggtgctgttgtcagaaagaaggggatggattcaagtcagcaaaaccagctgtaaccacaactatattttttaaacatgtagctgcatgttccataaaacagcatataaaaaatagagtgagcattctttattggagaaatagctgattctaggactgggcaggaaataacacaagtgccaggaatgccaaggaaatggcaaggaaatgccgagaaacaaacataaccacacccacatcaatgggtggtgtcaaagggacccaggagccaactgaaagagctcccagtggccaaagctggaacagtttctacaacaaaacaaagtagtattggattatagcccagagataaataaatatccatgagtccagactgacataaataaatgactgataaatgaggagaaaagacaaagctccttttccagcacaattccagatcatctctgcatctgctgtatctgctgtgtcttccaggaggtggagcacaacccttaccccaaggcaagggctgtgcagagcaacttccttccagagaggacagcatggaagtggggcggggggctcaacccagcaggggccaggtcagcctcacagtggtcagtcacggtgacagggtgtgcctgatacagtggagtgacagtgggccttcacctctgggggcttcatccccaaactcagtcccttcctgtaccatgagaaaaacatcagacagatcccagctgagggacagcttcctcaacagtcaaaaaccaagaagagtctgagaaactcacagccaagaggggcctagggagccatgacatctcaatgtcacgtgggatcctggacgactgaatctgacgaaagtgtggatttcagttaataacaatgtgttaattaatactggtccgttaaaccagcagtcctcaacctttttggcaccagggactggtgacaatttttccatgggccgaggtgggggctgggagaatggtttggggatgattccagcgcattacatttattgtgcattttctttccatgattacattgtaatatataatgaaataatcatacaactcagcatcatgtagaatcagtgggagccctgagcttgttttcctgcaactagatggtcccatcgggggtaaggggagacagtggcagatcatcagacattggattcttataaggaatgtgcaacctagacccctcacatgcgcagttcacaatagggttccagtcctgtgagaatctaatgctgccactgatctgacagaatcagtgcaagaactgattctctgaagcccagttcctaacaggtcatggactgttacttgtccatggcccaggggttgggactcctgtattaaaccgtgctcatgtaagatcttaataatagaaaatgggtgtggggtctgtggggcctttctgtcacatctgctcaatttttcttcaaatctaaaattgttctaaaaataacgtttactttaaaaataagtgttttttcaaaaacacttttttgtgtccttatcttctgctccaaataaataattatcctgacttttgtgtaagtggttccactagttttctttgatttcttaactctgtctgttacccttacacagtatatcctttggttttgaaaaccgagtagtcagggcacacttatcgaaccaggccccaggggtcagtgacggttgatctccaaggggttcacttttggggaggggggtccctcctggagcagtgcgttcagctagctcgtatactttttcacaagtgtgttctgttcccttcagcggggtaggcctgctaccctctccttccacttgggcttcccctttcttgtctgtctccttgtgcctggcagccttgggtatctgtgatatggctgtggttagttttggtgcagtgggatatatttatgtgctgcagtcacttctgtgaagagttaggtgctgtccgggtgctgtcagcttggattccggagttgtcctgtgcagtggaggctgtaaaggagcattgtcagggaagagaggctgttgctactgtacccatttgactggggactcctgggatagagtgagttccaagaaagagcagggaagaattgggtcagtggagacacagtgggggtcagggcatggacaggccgtgctgcagcttggagatacaaagaatgagggacgaacccagaactggaggtgtttctcaagaacagaatcttcaaaggttgagatgaaactcccatcatacttactagcaataacctctagcaaagttgaggtggtctgttttggctaaataaaatggacatagcattgctgggcccctgtgaagggctggaagcagggaaatgtcagcagtggcaagcgtgccctctggggagtagggaatttccctggcgctggcaggcagcccatgctgccgtagatgtttcctgctgtcctgggtggcctcacacagagcagctccacacctgctctttgaagttttcttggggtgcctgctggctacaaggggtctagatgtttatgacactgatataaagtctctgtgcttcccttggggaaatgctcccaagtatgaagcacccaggttctgagaacagagttggataaaaaggttgagttggagaaacttacctaacagggttaaagtggagacaaggatggcatgtgaagctttggctttacttcccaggtgatttttctgttacgcttagcatgcatcattgctgcttcgttgttttgttttgttttgttttgttttgtttttttagatggagtctggcactgtcacccaggctggagagcagtggcatgatcttggctcaccaaaacctccacctcctggggtcaagcaattctcctgcctcagcctcccaagtagctgggattacaggtgcccgccaccacacctggctaatttttgtatttttagtagagatgaggtttcaccatgttggctaggctggtcttgaactccagaccctcagatgatctgcctgccttggcctcttaaagtgctgggattataggcatgagccactgcacccggcctgcttctttgtattttaatatttgtgtattttatgattttctagagaagcattggtttcattttggcctaagtatgatacaagaggtggaaggctggtttctctgtttccttcagctgctcctgactggtcctcatctgttccttctcagatcacaattaactgaatatattttaaaagagaaaactcgtaagtgccctaaggaaataaggaattattttgaacactaaagctaaaagcattctaacattgtgttgcttttatgttctttactaaatttgcttcatgcacacacacacatatatgagtgtatttctcagtatgcagatgatttcaaggactggcttccttcgtgaaaacgtattgttggttgcaagaagataggggactggaaacatgattcgtctgtctgtagaggtgaagttccaagaagctcaccactgtccagtctttatgcttatgaacttgttgagtgagttctttttttatagtgtacccatgtctaggaattttggctgaaatcagcttctttgcttttttaggctttttgctagtgatagtgttgtctttgttctgtaaaacaactgtaaaggaataccaacaatctagtgcagaaattcttttgtaagaacaagctaccctgatgtcatgtcgtgttttaggactgtttgcttctcaacctgatgaagttgttcttagctgtttgctttgttttctcatccacagcagtattcctttctttgcctttatgcttgattgcaggcttgttaaatcccgtgggaggcttttttttttttataggtcctttctctacttggctatgttgcctgctgagtttaaagcctttttatgatatttaacaaagccctctgtgttcagcgtgggttgtggttgtgtttaatgtttcaacctagactcgtgtattaagtacagatatcatctgtcacttaacttagccttgctctcagtgtgtttatcatcatgtctctaaggccatcctaaatacgtgacctggagagagagggggtggctaggccaaatgctgggatgcctgcactccgtttcttagccgtgagtctgtgcttggaaacccacgagaactctggggagccacaggccttggggcttttagctgtcccccttttctcttactctccggatgagtgacttgggaacttccgagcaacttaaaatatttagctcactttactttaataaaccatttttagtgctatctatgatagggtccttccagtgggaggtacacaaatttaacttaactatagttaaacaagagccagaaaggtaaagaaggtattgttgagaacaaatacggctggatgcacttttggggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaaatacaaaattaatatgcaaacgtcaatgttattcatatatacaaaaataatcagaagatattatggaagagacaaccccattaacaatagcaacaacgagaaaatatttaggaataaatgtaatgagaactgttcaaaagctaagtgaagaaaacaataagttgagaaagacacagaagtcgccttgagcaggtgaagacaccttgttctcggttaagatggcttggctcattaagatgtcagttgtcaggtaattttcaaatttaatgtgatgctaatatttgaaagcaaaaagactcagcttttttttcttgggctggacatgtcgattctaaaattgaaatagcatgaatacctagaaaacttagaaaagaaagagccaagaaaaggagaatagctctactagatattaaaacatactacaaaggctatatggaaaatagtgtggcaaggttgcatgaagaaccagacagaccaatggaggaaataagcccatatatagatggaaatctagtatatgataaagatagtatctcagattgttgggtcaaagatagattgttagagtcaacgttcttgggacaattggactccattttgtaaaatacatcattaggatttatagcttacaccacatgcaaaaataggctgcaagtgggtcagagaactcagtgtgaaaaaggcaactgttccagtgttagacacaaacatggttgaatattacctatgtgttgggaaaggcttttttaaaggcgtaactcaaaattcagcttcaacaaagaaaagatggatgaatttgactgcattccaaaatactgcgaccagcctgggcaacatggcaaaacctatttttacaaaaaatacaaaaataatttgggtgtggtggcacacacctgtagtcccagctacttgggaggctgaggtgggaggatcacttgagcccaggaggttaaggttgcaatgagccatgatggtgccactccagcctcggtgacagagcgagaccctgtctcaaaaaaaaagtaacaactttgcctgaccaaaaacaaaacagaaaaacacaataaggtcaaaagacaaaaataccaattgtgtgaaaacctttgtagcatatcataaatgttttaaaagttgagggagaagaaacccgaaattctaggaaaatgggaaaaaggtatgaacagacacatatgcacatatacacgtacataaacatggcccatacactttaccaagataccatttcttacagatgtgcaaataatcaaaagtctcacttgatagctatttctaataatgttgctatttctcatgtacgtgcttaattggaaatggtgtattaaataaaggtgaagaggcagttgccttttcagcttaaaagagcattaaagtttatgattgttaacttctaaatttattctcagtgtgctttgaaatagactttataacaaaagcagcactaactctccctagatttcctaggaagcaggtaccaaattcttatgcacctgcatgcacaggctgccaggatgcccccgctctactgtggattattctaggctgtttctccttccttccaaccaccacacccacatccctaaacctaggggtttaaatttaggtaacacacctagggcttgttaaatttaggtagtttccacacttcgaccttttttcttaggatggctctgtattcattatggatttcataagtcacatggctggaaggtacctgatacagattaaacacagaatttagttaggatagcattctgtctttgaaggctgtgtgattgcagcccaggccaagccaggcagaagttgggtcacttgagcagggccctgcaaacacacctgaaggaggtggcattgctaggactctacttttggggctgaatcagcagaggcaaaaggactgagtaagtccttgctgaggatggcacagctctcagctacagagctaggaccagaccaggctctggggttcatgcgggaatcaccagtctgcgctgctgcctcctcctgtatgcgtgtgtgtgtgcgcgcgtgtgcgtatatgtgtgtgcgcgcgtgtgcgtatatgtgtgtgcacgtgtttgcgcgcgtgtgtgcgcgcttgtgtgtatatgtgtgtgcgcgcgtgtgcgtatgtgtgtgcactgtgcgcgcgtgtgcgcgcttgtgcgtatatgtgtgtgcacgtgtgtgcgcgcgtgtgcgtatatgtgtgtgcacgtgtgtgtccccatgagtcctgtggcaccaccgagttgtcatgaatgctttcgtttaacgagtcaggagcagtttcccattttgtaggctgtttttctgtgacctggattttaatggcttggtcaacaggtggaaaagtatccacctttccttatcagtctggaggctggttggttttttctgcgtcgcctgcgtcaccacttcctgatgtcagcgcacggggctctgcgcccccccaggactggaggctccgtgtagatggagacttttgtttttgtcccatcctcctggcatgtagaaggccctcaaatacttgttgaagaataaatggacgggctttggtattttataacctagcaatgcaccttttggttgtttccaggtttactattaaaaccaacgtcttgatgcccctctttctggatgcttttggtgatagagaagccaaatcacgctggttttaagcaaaaatcatgtatttgctcctgaaattttcctttgaaaactttctgtatgcggttgtacgtcagtatgtggttttcagccacactgggaggcgcctttctctctctttttgtcgctatagacattagtggaaagccacaagtagcgtgggggctgcctctagtcacgcttcagctgcaagtgcggtgtgagcatctatttttacctcacagtcctcgctctgaaaaattctgaccacttttatttttaacattctgctctattagctgggtgcagggaggaaggaagctcaaattagtcagtttactttgtatttatttttacttgaccttttcacttccacattttgagaagaaaatgtgagactctttcctctgcataattttcttccttgaggagaaaccattttcagtcatgcttggaaagaggtggagataacctcagggtagcatgtttagcgttttccattcacgaaacaaaccttaaaatgttcatctgtttattctatgaaataattagtttcttatttcccacgaatttgaaaaccagtacatttctgtgccaagtaatggctgtgttttcttgaccatccggcaagtctctacctgggtgtggtgacttggggaccgcgttgtcaaagagccagtgaggcgggggtgtggagaatttgtttgccctttgtttttcacttacctttttctgcaggaattgaactaaacaattgctactgacaatgatgtattttaattcctaggaggttaaactcctcacctagaacagtttgattaataaacctaatctatttaagcatgtgtcaatccttttggaaattgtaatattcaaggacttgctagcatttatggctctttaaatatttctagttatagttgctgtcaggattcatttattttgattgggtaattagttttttaccattattttaaaaactaataaacattttaatcagatctcatggacagaaagccaagattcttgtgctgcttcctaaatgcagtgggcgcatctctgtcagtttttacctgctggaaggtactcctgagtgctgtgctgagctctgcccatctgtccatcctcttgggacactcatccctttcccattctctgctctgtgaggggatggtgctagtgagagctcaggtcgagagggctggggtgctccttcgtctctcagctcatcagcagtgacttggaagacaatcagggtctacctgtgttgttgagaagcgttacgcaagcaggaaagcgcacaagaggaaggcgcagctgagtgaagcattgcagagcccgccaggctgtgccttccacccaggccagcacacggagcgctgcagtccctgaaggcttcctcaggctcctcctgttggcgtgggtgcctgccactgacctctgtgggtgacaggtttgtcactggagcttgtatcctgcaacctgtttgtttgggcgtgcctgtttgtttgtttttaacgttttaataaactttattttttagagcagttttatatttacagcaaaattgagggacaggtacaaagatttcccgtatgccccctgcccccacacaggcacagcctcccccattatcaacatccgtatccggagccgtgtatttgttacagttgatgaccccatgttgacacctcattacccagagttcatggtttccatgagggtgcactcttagtgttggacgttctatgggtttgtacacatttatgacgatatggatccatccttacagtatgcagaattgtttcattgcccttaaagtcctatgcttagcctattttttaactatataaatgcagtcaaaggatgtgtttttgtgtgttttcttttgttcagtattacatgtgtgatgagacttgcctgtgttgttgcctgttcgtttttactgctgtacatagtactctgctgtttgaccatatcatatattcattctgctgacgatggatagttagacggtttccagtttggggccattataagcaaaactgctctgaccatactgatacatgtgttttggtaaagaagcacaggtgttgctggggtggatgggctggctgtgagcacacgcacttcagcgtgagtgggtgatgctggcatggtgcctggttgggcactcaactgcctgctttcaccacactccccatgtggcatcaactgctttggaagtttctgtcttcttaatttttaccattctgggcaggtgtgtgtggtatttttctgtagttttgattctcatggacctgcttactagtgagattgagcttttgttacatttcatggaattctggactctctgagatgcctcccaaagtgcccagctacagcctctgtcatcagggaaggagcaggtatgggaatggtgtctctgcacacctcatgtcttgcctacatccttcttcaagaaaatactggttttccccctgaaaatgatagaaattgactcatcatttttgagtctagctcaggtgtcttttctggaattgccttttttattcggtgtaaagaggcacagggacttcatatctgctatagatgagtgaaggttgcctagacatgcacacaaggcccttggtggacttcccctatccctggggctcctcataacccttccctcttctcttccctggactttctgggctggggccagggcttggggtcgggggtgagccttcctctcggtgtgtatctctgtgtagagttgcatggtgagattcggcttctgttctaaatgcagttgggtggaaataaagcagggatggtcctgagtcacccacattcctcttggtcagtctgccctggtgtgaggagctggcagcctctgcagacctttggtcccacttcccatttgggggatgtaggcttgtgttataaaataggtgaacatgtgatttactgatttactgcttgaacagggacacttttgagagtgaaagggcctgcaattattaatgaccccaagatgacatgtgataacgaggaagttctggggagatcaggtcatgatccccagagttatgatctcaaagatggagagtgtcatagggaggatgcccctctgtgagttgtgaggggccacgtgtgtcctgtgtacacaggccctaaggggtgctggggccatgtgggtagtcataggaagatggctggagttgggaggcagaatgtttaagtatttcactcattgactaaacttagttgagttttatttgtctgtgaaaagggaaatctacttgccttgcttgcacgcctttcctagggatattttggggactaaaatgtgatagtgaattttaaaatattggttgaaatggccaggctcggtggctcacgcctgtaattccagcactttgggaggccgaggtgggtggatcacaaggtcaggagttcgagaccagcctggccaacatggtgaaaccccatctctactaataatacaaaaattagccaggcgtggtgttgcacacctgtagtcccagctactcgggaggctgaggcaggagaattgcttgaacacaggaggtggaggttgcagtgagctgagatcgtgccactgtactccagcctgggcgacagagcaagactctgtctcaaaaacaaaacaaaacaaaactatatatatatatgtgtgtgtgtgtatatatatatatgtgtgtgtgtgtatatatgtgtgtgtgtgtgtgtgtgtgtgtatatatatatatatgttgacatgtgagtttttcagtttactctgaactctctccttgtctgttttttaaagcatcctgaaagggagtgtctgtacagcgtcacctgttaacagccactaggaagctgccctgagagttggacctggccgagctctctgatacttgagcagccctgcccagaggagcctgtgcagcacatgagggttcttcagtattggtcggtgtttcgggagcccttacaatgaatgaacacagctgcagcccagtgacccctcttggacaagtgcggagatcagttttagctcagctgctttctgaatgtttcagatatttcaaactggaagtcacaagtagcttttacttttgcaagcagtctgctgttatgaatagcacgtataagaaaatttataattcagttagttaaaaatatgtttgagcacctgttaaagcaccagaattcttttataaattgaggaaagccatgccatctaacacatatgcggcattaagtgttcttttaataaatattatgcttagtagacatactctacataccaatcagaggttgccatcctaaaccaaaactacatatccagcacattctgatattaggcggtggcttacaccagggaaggcttggaggttgttttggctcctaccctttaaaaggcttaccagcttttagatggagtcatagataagacatggatagtaacagaaaggaagcatggcttatcagctgtgtcaagtccggacacatgtatccccattcacattgctgaactcaggaagatatccaagcaccattgtgacatacttgtccacagagaccgcagataaccccagcaccctctcagagtggtgccttggtgtttttgttcataaagccttgatgctcaggcccatccgtcatcccgggcaggtgcgtagcctgtgtggtggatgccagggtcaggggagggctttgcttttgcagagtctcgaggcttaggctgaatgtgtttttaaaggtccgactatactgaaacaaacattaaaaaatattcaacatcacttaatttttattgcttaagagcttatctggctctcccattggctcagtaatttggttgctattaataacgttgttgaggttgtcatcgtcaccttaacattgtcatcatcacctccagtaatagctaacatttattgagttcttcctccatgcaggaactgtgctgagttctttttctgcattattttattcagcctttgctgcagccatctgcagcaggcactgttactaaccttctcctgccagagggaacgcttgagatgctgcagggtgacagtagcctcagagccagggggctgcattgctggatcttcaagcaggcaaactgccaactctgtgttcataatcctggtcatgggctcgcactgacctgtagagagctggatatggggaatggattggagagcttttatttgaaacaacagcaaagtggcatgatcttttgggaatacactttttcaagtcatgtatccactcacagacaggctttgtgagcctcttgctttgttaagggcccagggaagattttaaggcgaccaaacttccagtgacaaacaatatttgaaattagtctattcctttaccccagaaatgcagaaatacatggttttggatgtttgacctcattggttggtgggcatgaggaggtggtctgctttggtgccaatgaccgtctgtgagtcacagagtgagtgaatgctgagccgctgtgatgggaaagctctctgctgagttggttcagtctgggtcacagagtgagtgaatgctgggccgctgtgatgggaaagctgtctgctgaattggttcagcagtgcacctgcttcctcacggggcattagccggtcagggcgatgtctctggatcactcaacttgtccctgacagagcaaggaataagaaacccagttagattgtctgtatcatcagatgccatttacatcccagtcaaattagcagccagatcactgatttcttataggtatacatcttttgacttcagcataatctcttcccctttttctgcatccttgggttttaaaggatgtttactatgtaaatgtttaacatgtttactatttaaacttaatagttgaggtagcttttaaaatttgtgtccattaaacccaaggactcttgcagaagtcgtatggtttttcttctttcatctataatgcatgtaaggaattattcacttgctctaaagttcaaatgtgtgagtttctggtgctgttacataacacgtggtattgtgggtcaaggggagttagtgtctcacctaaaatctggggccatgatgtcaccacattaaatagtagggatgtttgctcatcttttaagggtatttcttccccctgcaaagcaaaatgctgaagagatacatatttgttaattaactgatttcaccctcgtcatccatcctctttccataaggaactgtatgttgcattcttgctgagtgcagactaagtcctttgtgcaaggttgggtcatcctggggtgaaaaggtaagtgctttcggggatgctgattaaggtggtatctgctgtgcctctctcagtgtccccagggcgaaattcctcaggttacagtggcaggaacagctgcttgagctcatttttgtcttctgaacaggatcagtcttggaattggccttttctccatcttcagccccagggtggggctggcctgggtagggcctgcgcctgtgcttgctgcgcagcagcacccctgcgtgccttcccttgcctcggctgctaagtctttggagaaaactctacattgccaagcttcttctgaaagatttaattttttatttagaaacagtatgcttattacagactgtgcagactttgcagaaatgcaaaactaggaagagacatattagtccctttgcatagaagcaacttttgttattattttgtatgtttcctttgtatctgtattagtgtgttctcatactgctaataaagacataccaaagactgggtgatttatgaaggaaaaaggtttaacagactcacagttcagcatgactgagaaggcctcaggaaacttacaatcatggtggaaggggaagcaaacacatcattcttcacatggcaacagcaaggagaagtgtccagcaaaatggggaaaagccccttacaaagccgtcagatcccgtgagaactcactcactatcacgaaaacagcatgagggtaactgcccccatgatacaattacctcccactgggtccctcccacagcacgtggggattatgggaactacaattgaagatgagatttgagtggggacatggccaaacaatatctgtgtcttttttcatgtatatgttttttttttcttttctcagcataattgatatactgtggttactctacctatttgtgtaggcctctcaggtcattgaaacaagatgttgtacaaattagcagatgacactggcgcatggaggaatggtttgtattttaattttcactgtataacattttagtaaagcttttactggaaatgttttctacccatatcctcaggaaaccatgtgaagtagacagccttgcatttcctggattgctccctcgaaggatgaagggagcagttctatcagatgctcttcccagcctccttctccagggagacctagccgctgctgttttgagtttcctgggaggacatcccccaaggactctctggcttgtccttgtgaagttggtttgctttttgtgccagctttttaggcttacaaaatgttgtgtgtgtgtacataggaaaaatatggaagggtacgtacccactagtttgtgtcagcactggattctggcatatataatagatgaggagtttctgttatgtatatgggatttctgagatacacaggggttttctgtgcacatctctctataacgcagctgtcccgtcacatcctgcatgtcagtacaggtagtgccgttctcttcgtaggactgtgacactttatctttgttctttcacagttaaaaaaaaaaaagcttctttaaaattctgactttatataactaacgcaatgctcatgctacttcacttgttacaagaacatattattctgtcctatagatgtactgcagttatttaatggatcagctattgataagggggcccttttaatgtaactattttaaaaaatggaagtaataccagcacatggtaaaaaacacattgcagctcatgaatgggtataaattaagttggagatttcctctttctccctccccaccccatgccccgtttccagaggtaaacaatgtacagtttgtgttttcttctcttaagttcttcttgtagtcaccattatagctttaacttttctgtttgtgagttcatgtggaagtcaacagtgccttcacactctgagttttgatgagatttatattgacaaggcttaaaacatttgtagtgtttcccatctatcattaggctccctgtgcttttcctgcaagtgtagtctaaacattttaatataagaaaagtaacatttatagtattatgatagtatattttgccatagaaccaagtggtatgaaatgtaattctgcctcaccaaacctttgccaataaaaggagaatattcagatggaactcccagtttctctttaggtgtccgctgtttctagctgcctcagttgccatggtttctcctatcccatggtgttggtttcttggattctatttttgttttgctggagcacctccttaatccacttccttatagaatggatggctgacagacttcttaattcacttccttatagaatggatggctgacagacttcttaattcacttccttatagaatggatggctgacagacttcttgggtttttgcacgtaatgttcaaacatgcaattactttgttctcatacttattgataatttggtagggtctagaattctaggatcgtataattttccttttgaaatcagaaaatattctctattattttccagagtctagtgttgttaatgagaagttggatatccgtttgatccttgttctactgcaggtaaacatcttctactctctccttctctccctccctgggcttcatgtcctgacggtttgatttttcgttaccctaaacccggatctgcttctcttccagcccgcgtgcccatattgggatcaccccttagaaaacctcaggctttctttggagagcgattctcaggtttcagcccaggaataaaagcgttccctatggctcctgcttcttgggaagacccctcacctctgttgtcttgctctgcagtttcctctgctctctcgcatcaacctgctttcgtctgccttatgccctaaaagccctggcaggctttcttgtgttctgctaaatccctctgtaaatttttagcaccgtgcactattatggttcattcaccaccaaaaagtaccttttctgacattttaacagagctctgggaagaatggagagaagatatggtgtactttatcaccatttttaattaaaagcccttttaattaattaatttagaggcagggtctcgctctgtcacccagggtgaagtgcagtagtgtgatcgtggctcactgcagcctccaccttctgggctcaagcaatactcctgttatcagcctcttgagtagcttggaccacagtcacgtgccacactgactgattaatttttaaattttttgtagaggtggggtcttgccgtgttgcccagactggtctcgaactcctaggctcaagccatcctcccaccttggcctcccaaagtgctgagcacaccactgtgcctagcctaaaagcctttttagatcactctcagtggcaaaattagtgccttggtcacctttaccagtagctgttcttgctctgcagtggaaatatcactcaacattatcaaagaatcgggatgaaattaaatgaaccagtttaggtacttttgatacagaagttcttatgagacgtgttgttctttactatgtaagagtgtggccataaacttaaaaatagctgggtaactttgttacacttgccttgatggtgtgttgcaagttagttaaatttcatatactcttaatcagcacatcaccaacaaataaaatgttactgctgcatcagaatttagaggaggttctatacatctgtttcgaaataaagacggagatgacttagggtacttataagttgttgaaaaatcatggctcctgaaactatgaattgtcatcgtggtatatacccagacagcccacattaaactgctgtgaacatgagaaaacggacatcgaaatgataaaagcaagagtgttggtaattgaaatccattataaataaagctgtcattggtaacgcacgaaatgctgtttctgaggatgaggactttgtggcccccacgtgggcgcattaccaagctttgcagctctgcacaggagcctcccttcttgatactgaactagacctctataaagcctagtaacacctcaggtttaggttataaatcttaaattttagtgccccgtaataattcacttcgtaggttaccatggactagcccttagttgcactgagaaaagaaaggctatgaaattttgttggtgaagtgccaaagaaaggattgggttttgggtcatctcacagcccatggtgagggctgtctttggcctctaccgcacggacaagtttgcatgtcagatgttggcacacttgtggggtattgggttcttttgaatatctgattaaatccatttacattttcgttagaaaaattcatctgtgcatatgaacgcatcatttcatatatgatttcacacttctcattgtcttcctgaagcccattcgtgaactgtcgattgaatgcctgctctggagaggagtgtgaagctgcacttcttccgtctcctcctggcactcgctcaggatcctcacaggtgtggaaaacactctaaggaagcctgcgaaggccagatgtctcccttttgccttctttggttctgttcatgatggccttatcacggacacactaggaccctctgaggacaccacccctgccaccgcattgctctgggggcaacttccgagcttattgtcttcctccagcaagggcaggaatgtggagaagctgtgtgtgctgggcctttactttcattattggcgacaatgtttgttttcattttatcagctttctttatcctccatttttttatcttccacaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttggtatgtgtgtattcaactcaggtgtgacctactgtcttttatatgtccctggatttaaatatgctaattttgttatgatttttgtgtctacatttgtaaaagccgctgatagttcatgtctggcacattcttgacagattttactaccgagattatactgggctcgtaaaacgagtgggggatgttccctgtttttttgttcgctggaacggtatgtgtaagctttgtgcttttcctttattcagccagtgctttcacatgctgcttccttttatagccactcttttttgctacatattctttctctacaagagcacagttcttctggaatgtgtcccttaggattaactatctcaggtgtgatttgtgtgaaaacatctttattcttattgtggaaagactgttgttaggtggggagtttactttcccgtctgcacattgaagatctcatcctgctccactactggtctcttccctgggccctgggcatccgctctcagcctgactgtccccctgtgctcccgcatcatttctctgtgctgtgtctgggttcatgcttatttgtatttattctgctgcgggttagttggccgaatctgtttctgtgagagctcccatgcttttggtactttctgtctctcgtgtgtctctgcactgctttctgggttattgcttcggttctactgcccagtttggccattttctctttaactgtgtctaatatgctgctaaaacctgtccactgagcttttagcgttagtcattatagctattatttctggagggtctctctgcttccctgtcctgccaagtccaattggtcattcttagtttacctgtttactaactgtttgtatctcctttagccgttgttttctgtacgtatatggtgtgtttgacttttccagcatgttcaaggctgttttcccagctgtatcccctcctctcgggccatcaactttttgttccccattgttgctactaattcttaggactaataaagcacttcaaatggcagctactgtcaaaaattaggaagaaggcttctttgccgtagcagcctccagttgattactttctcttgacctgtactttacttgccacgagcatatcatgcctctgtacttgctgcagtaattactgtctcgaaacagtgaaatctcatcagttgcccatatgtgtttaactgcacacgcgtgcatagtcttggctttatgcgaggtagaaaatgagagtacttagtttttggcagagcagagcctcaatttccacagtctaattaaattataatgataaatatcactttaaaaggaaacagttgcttcgtttaatcaatatgattattactggcacagcaaatccatcaagtgctgtgaatgataaatgtgttttaatacaacttgcagtgtacttgctgttggtacaaggcatgttaaatcctcagtggtccctcttttcatagcattgctgtggcactggcatttccctttgttaggagatagtggggtataaacccattgtggaaaccccttcagcttgacaaatttggagtcatgctattttcagaagaggatttcctgcgactaggagcagtcacccagagaaagctctggaaaggtggtggtgctggggttgaagatgagctgctggcccctggcatgtcagtgggcggaggtgggagacgtgcagagctgcctatcccacagtacttccctttccccatccaccctttcaggtggctcactccccaccagtttcgcaggatggctcaaggcaaatggagaaaacggcacaggttgaaactcttggccgtagcttgcgagcttgcctcttagcacctccaaccacgatctccttgaatgtagtctcctcagtctctcttttttgtgtgaggaatataaagtttctagttgccttttcgcataatctcatagctcttctgcacctgtggttccttagctcttatctgagaccgtggcaggcagacagctggttgcagtggttggttagttgtttcatatggttgatcatacagcagctacttggtcccattgttattgatagtattgtataaaatcagttgtcattgctggcatttttttttgttctgttgcctgattatttgttttctaatacatttttattgtgagatacctttcttgaacatggacacatatataagagaataattttaattgcatgtccatgtaactctcacccaggttaaatagacactgtgtacctcacagtttccttcatgctcctccctgatgataactccccctcatccatatgacacatctaatatatactacgtgtgtgtgtgtgtgtgtgtgtataattaattataattattattattttgagacaatgttttgctctgtggcccaggccagaatgcagtggtgtgatcacagttctctgcagtctcaacttcctaggcataggtgatcctcccactgcagcttccagagcagttgggattacagacatgagccaccactccgggctaattttgtttactttttatagagatggtgtctccctgtgttgcccaggctgttcttgaactcttgggctcaagcgatccttccgcctctgtctcccaaagtgctgggcttacaggtgtgagccatcgtgctggcctttttgtttgtttttgagacagtgtctcactctgtcactcaggctggagtgcagtggcaggattatggctcactgcagccttgaactcccaggttcaaacagtcctcccgccttagcctgctgagcagctgacaccacaggtgcacaccagcatgcctcgctgagtttttaattttttgtagagatggggtttccatgtgttgcctaggctgatcttgaactcctggcctcacgtgatcctcctgccttggtctcccagagtgctgggcttataagtgtgagccactgtgtttggtaatatcctatattttgaaataatactgtccttttctttttaattttaccatgtaagaatgcatccccaatcaatgtagttcagttttgcctgtgatggaactttatccaaggggagtcatcagtatattcttttgtgtttctcttgatttattaatgaagtggattacataaatcgattttcatacattaaatcatgtttgcattcccatcataaattcatcttaatcatgtttgatcgctttaaaaaatattattggattgagtgtgatcacattttgtatacgatgtttacactgtatttgtaagattgacttactgcttccttttcatcttcacagaagtgtcttgttgaatgttggattcactttctagagaagccatctagtcatggagtgttctttccaggatgatttttgtttactgactataatccatccctccctccctgcattccttccttccttcccttttcttctcttttctttttcttgagacaaggtctcactctgtctcccaggctctagagtgtgatggtgcaatttcggctcactgcagcctctgcctcctgggctcagacgatcctcctgcctcagccttctgagtagctgtgactacaggtgcacgccaccacacctggctaattttctttattttttttgtagagacaaggtctcactatgttgccaggactgatcttgaattcctgggctcaagcagtctgcctgcctcggcctcccaaagtgctgggattccatgcatgagctactgcatctggcttctaattctttaatgtttgtagttttgtcagattttctgtttcctcctgagttagtgttaataagttgtatttcttttctttttaaatggtgatgtgtgtgtgtgtgtgtgtgtgtgtgtgtgtgtgtgtgtgtgtgtgtgacagggtctcactctggttgcctaggccggagtgcagtggtgcaatctcagctcactgcagcctcgaccattcaggctcaggtgatttctcacacctcagcctccgaagtagctgggatgacaggcgtgtgttactacgcctggctaatttttgtatttttagtacagatggttttgctatgttgctcaggcttgtcttgaactcctgggctcaagtgatccacctgcctcagcctcccagagtgctgggatgacagacgtgagctaccgcacccagcctaataagttgtatttctcttggagtttcttcatttaacctaagcttacaagctttttggaataaagtttataaagcctcttactatatttttagtgttgtcagagtttaagtgataattccattttggtttctcttgccgcctgatgacccattcccaacttagtgacataaacaacaatcactttattaatgctcagccaggtagcctgagtgtctggagctctgcttctggctgtcagctgtggctttcttggttcttctcagtgtcctgtatgagaaggcttcttcagtgaggtggctggctcccgcctggggctgactagacatccttctctgcatgtagcccctgtgatctcttcagagcatctgagttggctccccagagacagtgttcccagaaataggaggtggaatctggcttcctcttcaggtgctggtctggacctggcagtaccacgcctgctgcgttcaatgggccagagcagtcacccgcctgctgggactcattgggggaagtaagatcttcccacacaaggacaggagagtcacattgtggccatcaggccttcctgccctccaattcaattccaaggctggttaatttgggctttttctcttgtgttccctttctgtgtttccatgagtcttgccagagatcactggttcactgcattgtcttttcaaagaaccaatgtttatctttgtgtacctgccgttatatgtaattaatacaggttgaatttcttactagttccctttttctgttttctttgagcttactttgttcttctctccctgacttgttcaggtaggcactctttaatttttttactcctattctagcttgagcaccgagctataaaggtccctctgatgtactgctttatctgtgtgccacacaattctgtacataatcttttctagttttaagttctaagtgttttctgttttctcctgtgattattttcttttgtctatggattatttagaagtgtattgctgaactctcagacatatgggactttctagttatacttggcttgttaatttctaggctcatggtattacgatcagaggatgagctctgtctgatttcagccacctgaaatatgttgagattttctttacggctgggatatggtctatttttagaagtggctcatgtgtccttgaggagctgatgtgtgatgcactgttaggagcagcgtcttgcatgtgaccgccatgcagcttgttaattgtgttgtgcagatcttccatctctccactgttttgttttttcagccgctgtctgctgtctctgtcacctgctcctctccactccctccatgacaaaaagactccggtgtttttgaccatcttttattgcgcccctactgtgatcttagtcacggggccaagcactctacatctgttcctccatttaatcctcacggcaccatctgcggcgggtgttccttgtgtcctcgtcctgtcctcataggagcaagcctggaaggggctgagtcactgttcaagtcacacgactgcaaggctgaggtctagggtggtggcctggacccctctttcctggaagccatgcttttcctgaaaccccttgcaatactcctggcaagtatggcagttttacctcagttggtatgagtgtactcaaatgggaggcaaccattctcacacttgatgtttagactttgcagcttccaaaacccactctgcatatcacctgctccctcctcaaagtggctgggcttcccatgcagtttcccatcctgcagacggcccagggaggtcagatttcttggccaggcttgcagagttggtgggacatgatgtgggcactagaacccagttctgtaaatcttggtttcatgtcctttctgctgtgtttttctttctctgtttaggcggtggactttttggtgtgtaaagcttctagaatggattttacttctttgtggctctttggattgagggaggggctaggtgccatctccagagaagcttgttcagctcatgctcactcggggcccttgctctctgcccactggggaggggctgtggtggagctggattcggactgagtggaggcaacgctgaaggtcagaggccaacgtccttgcacttcttgacactctccacccaggcgtggtgattgggaccgctggggagggtgatttgggagcttgaatctggtgtggggatgatgggggtcattgatagtggggacagttctggacatgtggccctcattctctgtgctggacaagatgactctgtgacctgtaattccaggctgatagagcattttcagtgacagcccatttgacttgatggtgctagtgcaggacacaggtgagcttgtctctgtgtcttaggtctgtcccagcagacgagctgacgtgtgttgtagatgaatgtcagctggtcacaggtgggaggtttggaaggtagcctccaatctcctctgaggactgcagcagcgaccggggcagcaggaacgcattgtgatggcctggccaagtctgcatagcgagagtcgagccactttcacgcgcaccttatcccacacttcacctccttcctccaggttcccactcagaaacccgctcacccctggacacacctcccagagacttctctttggaactctgcaatggagaaacccattgcagacttccccttcttttggatatcagtttgcttttcaggaagaaaattttaatactccatattgaggttttataattatattagcatgttgaaacattttctctaatggcttgctggttgaaaacgctttcacacagagcagaaactagatggagatactgtttcacaacctctgcttcagaagcagaggtggcctgtagcttccaaacccgggcagagcacgtgcagggatggtgcgtctctgtatctggactcacattcacatgtgtgcatgtgtaggggtgtgtgcatattgaattgtaaaaaagatgagtacgtgtgagattctgcctgagactccagtcctcagtgtgtggcctggtgccgctgatgccgagatgttgggctggcagcgatctgcctccgtctgtcacaggtgcctctacctgctgcaggcagacggacggagacgtgatggattgcgcatatcccctttacagattcggaagagtacatttaaaataacttaaatttgtatttagaagacttttcatggagagtatttattgttatagagttcacttctgaaatggtgacaaagcttttgatactgaatcaaacaagtgtgaagttaccgaatctctctgttacacagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggtgagtaaaaacctgtaaagatctgatcaaatctgactggtagaaatgcctttttcttgatataaaccgcttaattaagccttttggcttgcctttgaaagatgctttattgaatacttcccggcacagatgatctgttactgttggttgatttctaatcttactgcagccttagctcacccatgagtccctcctgcttgttctggggtggtgcctgctgccctccagtggcatgtgtggcacctgctgccctccagtggcatgtgtggcacttgctgccctctttggggtcagttcaccatttattgagtcagtgcttcatgccgggcactagacttggtgaaagccttttaccatcaattattattttcttaggagtaattaaaagaaaattttcctgtaatcccagcacattgggaggctgaggcaggcagattacttgaggccaggagtttgagaccagcctggccaacgtgacgaaaccccatctctaccaaaaatacaaaaattagccaggtgtgatggtgcacgcttgtagtcccagcctcgggagactgaggcaggagaatcgcttgaacccgggaggcagaggctgcagtgagctgagatcatgccgttgcattccagcctgggtgacagagcaagactctttctcaaaaaaaaaaagaagaacatttctttagtacttatttttggcgactatctcatgattcagcgtctgcttttgagagaagttgtgacaaatactaaaatcccagtaaaattagtatggtgtcagattaatttacttatgagcagctgagtgactaactcaggaagtccagttgtacatttccagggaagctttttcatgggttcagatgagatgaggggaaagagaaggtgtcagagggctgctgctggctggaggaacgcaggtgtgctcctgtgtccatttgctctgtggatactgacgagcgcccactgggcctcagatgccctctgggcatggcagggaccaggcgctcgcttggcagctctcatgtgagccgctcactggacacagccgtgctcccgcctgggagttcgggatggcatgcagagctgtggggagggagcggtcaccagggcgtgagtgtggacagatgggagtggctggtgcagagccataggtagggggcggtcaccagggcgtgagcgtggatggatgagagtggctgggagcctaggggggacgccgtctttggggagtagagacacacccatgtctgactactgggttttgagtttgtgccagcaaaggtcctgcttgccatttctgtctgtaaatgtcaggaatttcaggtaactggttccctagcgagacctttaaaggaggctttatcttcaaccgatgctttttttgggggggtacacaggcagtccaagtatgggaaggtcaaaatcaggtcacctttatcatggcttgtgctgtgggatgggattttattttcagccacagcgcttcttctagcttaattagtgataggaaatcagcttctctgtaaccagaggttattgaaagaatgaggatcccagagttggaatgagtctgaaagagacgttgtggtttaatattgctaagttaagtgtcgatttgtgactacctatttttaacatgccacagaagtaaaacattgcattaattatgccatatatgtgaaatagcaagtatttttatataatataactgtgcattggagaaatgaattatttataatcctttgcaccaataaattgttcttaaaagcatagaaaaaataatcaggccagaaggagatatctaaagcatgtgctgagaaagcaaaactgaagagctggaaattataaaatattacgacatgatgagtcatatctcctcctcctgattctgtgttactaaatgctagctgcgaatagaaatcgtgtatttcctttctttcataaaataagagctaatttcggcagcaaacagtttggcgtgttattcttttcccttttcagggtggtttaaataaaaataaataaacatgaaagattttggctggaacatctttggaagcacggccgtcctcagcctcactgcactgtctggtttccctctgagcctccctcccgggtcctgccttagtgctgtctgtgccgtgtagccacaggtcgcactgcagggctgtggggagttatttttagtttcaggcagactcactgtttttgcctttctttttgcttgaaaagactgaagttatttcttgtgtttttatacatgagattatcttctgaggctggaacatcttggggggatacaatagatagaattcctatagtaattcccctgcgcaagaggaattgctgaggagggcttcgggaaaccttgactcttgttgaagcctggaaagctttctcagtctttctcattgccaccccacaccacatcttctttttgtaacaaatatttattaactcatctttttattttaaaatgaagttcacagaagatattaccttatataattatagccatataatgttaaaaagcagtgtcatgctgaaatgtaatataaagagaaactgaagatacataataaaatagttttctatgccactgtatggacatttaggcactgctgctttcactcggatcactgagtggtgtgggcctgtcagtgcaggcagatgtggggtaggtactgagctggtgacctgaaaaccataagcaatagagctgagtggcattactttctgaaatggtcaaacctgaaggaagcagtgttcagtcttccctgtctctaggtagtctctgtatttctggaacattgagtgtatgttaaaagtatagaaaaatgcattgtgtcaatccaaaactcagctgggctgggcttagagaattatgagcagcctttccacctgcatggaagtccttttgtgcaggacagttctttgtttccggggtggccctgctccctccaggaggtttaggagtgcccatgtcaccatgatgcctacgccacttctcatgttgctacctgttgctaccaccgggcatcgctgccgcctcctgctctgtgcacagtgtggtgtggccgcctgaccgactggtcaggaactaaagttctctcgaagccttgactgaaaggagaagtgaggaggggcatggagcccagtgccaagaggcagctgcgtctttaggggctggcacttttcagaggggctcttggggccagaaggaaagagccgtcattcaaggcttacacagcgtggaggtgccctccctggggtgtcctgtgtgctgacctctgtcctggtgcctggcggtgtcctggcgcagagctccgcaagcctctgcggggctcttctctgtgtggaggttctcgagatgggcagtccgggtggatggtcaggccaatgagggccttcgaatgaagcacattattgtaaggatgctaattctggatcctcagatattgtgacaaaaacttgacatttttcttccttcaaagtaatttattgactaaaataaccaactgagcaaaggtgatgttttagtatctaaatattccaaaagattactgaaattttaaagtaaaaatttggccaagaacgagaagtctctgaatgtgcttttctggcatgacccctgtcaccaggaagctgtcagtgtggtgttgggcctgattgattcgcatcagctcaggtggcgtcctattggaaggtcggcagtgggagagcagctggccaggtcagaggattcatttctgtctgaagctttgtgaggaactaagatggcttttccagtagcctctgtcattccagagagttttaagattgcttttatttgttcttctaccctggaactaggaagccagacccaagaaatgtatccacaccaggttttgcccatagtttttaaaaatgttgaatttctttaacttgaggccctcacaattttctgggcccccataagttatagaacagggaccaggcctgctaccttgtgggggctgggtgggcactggctccccagggcacagatccttcctgtgggtgggcttaggggatgtgagggattcactttcagatgtgacactccagatgtggggttggtggcacattttttttgtccggttacatccaagtaaaaaggaggacaaattcttactgaacctatgcagtaaactccattgtcaggaagagtaaagtgtcttagcatgagtgttcctgaattctgaaagttcaggagagtaagatgttacctagagagtgttttatttcagctttgaaagcagagtctactggatttagggctagagatagacgaagaagaaagagaaggggcttctttgagcgcacattagaaaatacaccataaaagaaaataccgacaatcttccaaagccacagtcagcgtttccctgccagctcctccagtcttccttccttcctgtctgctgggtggcggctcatctgtcaagttttcacagtcatgtgcttctgggcgcaaagccctggtgagcccggctcgtttccctggtggaatcggacagttgtcgaaggggtgtcagcctctgttcagaagcctgagcccctgattctgttccttgaagtgtcaggagttaaggtgcctgtattgagcaggggctgccgttgcttctgactgagggtcctcttcaggcccactggctcttggcagagctcagttccttgtgaccataggcctgtggcgcttggctcctggagactgcccatagcccctgccctgtggccctcttcccagcatggcagtttgcctctcaaggcgtataggcagggtctcccctcttcctttcctctctgacttctctcatccttcaggggtttacctgatcaggccaggcccacccaggaaaatctcccttttgatgaactcagtcagctgatgagatgccttaattgcatctgtaaaatcccttcacctttgccttatgtaacactatatcccatcatgttcacagttcctcccgcctgcaaggcaggggagtgtacaaggtgtgtaccccaggggcaggatgctaacactgcactgactgagaaaagaatttgtcttacctgtacctgacaggtgtgtacctgaaagaggtgtgtgcccgacggtgtgtgcgaccgatgggtgtatgctcgacagtggtgtgtgcgcccaccgggtgtgtgcccgacggtgtgtgcgcccgatgggtgtgtgtgcccgacagtggtgtgtgcgcccgatgggtgtgtgtgcccgacagtggtgtgtgcgcccgccgggtgtgcgcccgacgggggtgtgtgcccgacagtggtgtgtgcgcccgacgggggtgtgtgcccgacagtggtgtgtgcgcccgacgggggtgtgtgcccgacagtggtgtgtgcgcccgacgggggtgtgtgcccgactggtgtgtgcgcccgacgggtgtgtgtgcccgacagtggtgtgtgcgcccgatgggtgtgtgtgcccgacagtggtgtgtgcgcccgacgggtgtgtgcgcctgacaggagtgtgtctgacatgggtgtgtgagcgcccggcaggggtacgtacactcggggtgtgtgtgcctgacgtgtgtgtgtgtctgacatgggtgtgtgcacctggcagaggtgtgtgcgcccagcagaggcatatgcctgacagaggcgtggcttagtgttcagggtccatagtacatgaagaatcctacagatccctatggacaaggcagtacagtagaatttggggcaaaagacttgcacagatttttttttttttttttttacacaagatgaaattgaaatggccaatgagcacaccctcattcatccagcgagcattgaggaccccctagaggccaggcccatgagtgatgaagatcccgaggatgaagacgccttgccagccaggtcagtgggtgatggcatttgtggtcaggggcacccagcaccacacccctggctgccgttgacagctgggtgagtcccctgctgcctgggcagagccacctctgcagatgcccaggtgggtctcctggggcagggactggcaggctgtagcctgtgagcagattctgggacctgaaagctaaggatggtttttacatttttaaggagttataaaacaaacagaaaaggaagaatctgcaacagagaccataagtggtctgcaaagccaaaggtttatagaaatgggcagacctgctctaaggggcctgcttgctgatggggccttgtctggattgccagttctactaattctggaattggaagttctcatggaggactgtgtgctgggtaggatttccagatcccaagatgctttggctgcattcaaacccacagggcagagagagccctccgccctgttccttggcagaggcctccacactccgtgtgctgaccggcctgccagaatgacaacaactgtcagctgtctgcatcctcctggcaccccttagtgtggctgcatactgaggggagttaaaaccataaacaggtggagaatatctccttccagggaatctcagaggactcagtgatttaagaggaaaagaccaaactgctgctttcagcaggaccactgtgtgctgcctgcctgtcagtgcatacagatacggggtcctgagttggtgacctcaaaaccgtgagcggtagatagacagagtagcccctaatgaagcagaaagactagaagagacaggacctaatttaggtcgaaaagcaaagtgaggcctcagaagatgaaggcagagtgcgagaaaggctttctggaactgacaagtctgccatccacatttcgaaatgtattagaaaaattggaaaaaaaacatacgaagtgtagaatgtcagcagaaaggtgtggccacagtcaagagggccctctgtgggtcctgtggtcctggactgcaggtgggcccagtggagactgtgctgcccctcaccctccccggtgggtcctctgtgatgggggtgggtgaagctgagtgctgtcctgaaaatctgaccatgcacagcccctttccaaagacccttctaattttagaggccgccagcagccacgggactaggcagcatcagagcagggacacaatgtgagtcatatgcgcctgtgttcatcctgtggtgtccctgggcccatgggggtgggagggatcagagggatcggagggaggggagtaaaaccaggggaaggagtggaggaccacgaactccctccccttcttggtggccagctgctgtgaggactcgctctcttaggacaggtccactgtctctgagctctggttctggcctcctgtcaggtgccctcgtgcgggaatgagtgagggacagcagggcaggctttccaggcttccagcaagctctacatgatgggtggggagaccctgctcttaaaaacatgtggacccttagcattcttcttcctcagacctggggcctcagcctaagctgagatgacagggaagaactacagatacaccagatttagggaaaataacgtcaagtggtgcagacaagtggaactgctgcttgtgaagtgggctgtggagtcgtgatgtttgctacgcccggcaccatgtttcagaacctgtagcagcgctcaagagagaatcattcctttaacaacaaacatgtactgagcccctgtggggaggcactgaccgaggcctggggacaaatgtggggacagaccagtcctgtggggacagctggcgggggtagaaaacagtagagctgccccaccagccagcggctgctgggagagcaggggtgttcccgcacccagaggaggcaccctgccgctctcccccaggttgcttggtgtgtgcgctgcagggagaatcccgcccccagctggtgtccacaggggccagggacactggtaggtaggtgtggaacaagggagtttgtgacttgggattgttttctacttaaaaaataatctgagtaaagcttggtttaaacagcatcaagttaaaaaaattcctaagaagtggttggattcccagtttatatgtggctttaaggttctgaagaagtacacaattaaccacagaagtatgacttgaatagataagaatttaacaaaatacacactgttgggtgtaaaatcataaatatctgaagttcttagaaattggtaattttcttttagctttgctgtgctctgagcatgactaaactaaaagtaatgaatccagaccttgaagactggtgtgtgtgtaaaaggcaagaagtgagaagattcacgtgtagatccaggacaatctgaatttacttctgttcagtagttcccaaaggctttttctacatggagggactcggagtgacacagcagctccctcttgtgggcagattcccctgtgtaaggtgctggaggctgaggttccagcctgcagccgcttgtgatcctgatatgtggagagttctggaagactgatgactgctgacccccttcttaacctacgccatcgccatgctggtggtggggatggggctcttggccattcctgccccttggctgcccttccttggtctgagggtacgtgggtggcccttcgggtgtgccaggagctttgtgctttagtgaccaacagtcccctgatgtgtgaaggcccatcaatccgatttaaaataaaacatttgaagtctcttcagaggacggtgtgaggatgtctgcgttcagtgatggagcttggcctctgccttgcccctgattgaggctctgagggttcagatacagtctctgcccactgcatgtgaacagcctggtgggtgtggaggggaggaagcctgtgatgatggtggcactgtgaggaaagtggggatggaaggaggtgtgcccaggaggcagggcaggagagttcatggatgtagggttgcagcaagtctggaaagctgggtttgttttccagggagatggcatgggaggtgggcaccccaggcaggaggggctctggatatgactccagaagcctggtgggctggaggggagggagaggctgggcctgctgggggcaggaaaagggcagacctgtgcttaatttcaatttctatgggagtgatgccctcaaacttagaagggcttttgatgagaagcgatagagtatagctcttgccctcctcagtggcatcactgattttttaaaatgcattttagatatttgtatttctatattaattagtattaggattggctataagtgacagagatgcaacataataggagcttaaccaagagaaagggctgcatcctgcacttgctattgtttgatttatgaactttagacattaactgtgcactgttagttcacatggaggaggatttagctccgtgacgtttctccaaccttcttttcctgtatcatttaggattgattctgggtgaaggtcacagcatgactcacagtatcttacacaccttggatgtatatacgcacttcttatgtcgtaagtaatccagagggaggagtttgctagagctagtccagagttcagccatcttagggctctgggtgagtatcgctgcagtacagcagcagcagctttagacaccacttctgtgtttaaggcaggaacaactgagaaggagcaggccgtggagctcttgtctattccttttgtcagagacattgtggaagccctcagcatattttcacctgtctttcaccagaactgtgtctttctccttggcaagaagtgtgttttgtggccagctttagtcacaaaagagacagaaaatgagcctttcatttttgtggcacccttggtagaggggtaggggaaagggcttcaggacgagcactggatcagcttaccaagcctgaaaccacgccccctgctggtcatcctagagactgagtggcccatgtgctcgtggcctgtgggccctgggcggcctctcagtttcctgcatggaaggcagcagaagcacttatccggccctcagctcctcggtggtgtcagtttgtctgacctctgtcagtttgttgtcttcttttttttttttttttaagacagagtctcgctctgttgcctaggctggagtgcagtggcacaatcttggctcactgcaagctccgcctctcgggttcaagcgattcacctgccacagcctcctgagtagctgagactacaggcgcatgccaccatgcctggctaatttttgtagtttttgtagagacggggttttgctgtgttgcccaggctggtcttgaactcctgggctcaggtgatccacccatctcagcctcccactgtgctgggattacaggcgtgagtcactgctcccagccttgtttgtcttctgtgttaccaaagtagaaaacttcttctgttctgtaaccttggttcaatcaaagttccaaattcataaatggcacttatattattatgacgattgctgaaagtcatgccacagtttaatttgctttatacttggatttggtatacttgattttttggttctgttttctctttttcctgatttccttgatttttttggttccgttttctctttctcctggtttccttgattttttggctccgttttctctttttcccatattcttgcctggcatggagtggtagagcagagtggggaatggagttgagtttggatccagcggtcgagcaagtgtctcaactcccatgctcagcttcctcctctgtcacgtggggcagggaaggtgcctgtcgggcgcagcgagcgtggtgagtggtagtgtggggccgcgtgcgcccgtgggccctgagcatcagcacttctgcctctccgtgttctcttgttgagagggaccactgcctttcttatgctatcgccagccttttccagcttattcattctgtttcttggaacccatttaattcattcttcttgaaatatgtgtattttctattttatttcaaattgagacttacctttcttatagaatttgttttcttctgggatctcttgatttttttaaaattggatttactgaggtaaaatgtacagacaataaaactcttttttttttttttttttttttttttttgacacagagtttcgctcttgtcacccaggctggagtgcaatggcatgatctctactcactgcaacctctgccttccaggctcaagcgattctcctgcctcagcctccctagtagctgggattacaggcgcccgccaccatgcccggctaattttgtatttttagtagagatggggtgttgccatgttggccaggctagtctcaaactcctgacctcgggtgatccacccacctcaacccagccaaaaatcattcttctaaagtgtgcactctaatatattctgacaaatgtatgccagtgccacaccaccaagcagctgaggtagagaatattcttaccccaaaaagtttcctcttaccccgtgcagatgtcctacccatcagggcccagggcgaccttgtctgatgttgatgtcccatcagatggtttgtattcagcagagcacctagaccaggctgtgaggtacaggtccgcccctggcagcccatgccttgtagcttctgggtggctcctggcttggttgctgtggtgtggagcgttgagtgacctctgcagaacagcagatggtgctgtagggccgcttctaagactcagtggaggaggctcagtggcgttctgagcggtggccaccaggacaaacctcttgtctttacaccatctgtgtgtgtgtgcgtgagtgtatgtgtgtgtgcattccagtgtgcgtccagaagccagtttccttcagaaagctttctgttccctggcttcatttttaccatttagaggacctgtgaagcaatgagatggaatacttatagctggtttaattcagtgagtgatctgaattgtaaataaaattttatcaagtaatttataaatttgatataataaattaagtctgcggaaggggctgattgtgttatggaatgagaagttttgtacatcttttgcaattctaaaaattgtggccaggtgtggtgctcaagcctataatcctagaactttgggaggctgagacaggaggattgcttaagcccaggagtttgagaccagtctgggtaacatggtgaacccctgtctgtacaaaaaataaaagtaaaaataaattagccaggcatggtggcacatgcctgtagtcccagctactcgagaggctgaggtgggagaattgcttgatcccaggagacgggtggcaatgagccaagattgtgccaatgcactccagcctgggcgacagagcgagaccctgtctcaaaaaaaaaagttgtgactttgctgtgtagtctttgtgtaacataattttatgattctattgttttaagcttaatattccaaataggtaataattatgttaaaatgcaaaaaattagcctatactctcatgatctaaatatgtagtagtggttttacagaatatatttcaaaggattgccattctgttttatttttagtagccagttatagaaagcattatttttaaataatgcctaagaatctttaaagaaatacctgtcaatgtatgttccagtttagtatcaaatttatattcagagctcataagaatttaaaaagtttcccagagtctgtaaatggggatggagctgtccttcaagggtgatagtccccctaggtttgagttgtcctctgctgctagcatagtaccacctgagctacctgtgggccaccttcaccacccgtgggtccctccagccaccccagggacaccttagcctccctgggtcgccttagccacccctgggccatgttagccaccacaggatcaccttagcatccctgggtcaccttagccaccccagggtcaccttagcatccctgggtcgccttagccacgcctgggccatgttaactaccacaggatcaccttagcatccctgggtcgccttagccaccccagggtctccttagccatcccagggccaccttagccacctgtgggttacctcagccaccagtgagtcaccttagctaccccaggatcaccttagccatttgtgggtcaccttacccaccctttcaccttagtcactcatggtcagcttagctgtttgtgggtcacttagccacccctgggccactgtagccacctctgggtgtccttagccacccccgggccaccttggccactctgggtcaccttgtctacccctgggttacctgagccacccttggtcactgtctgtgggtgcttgcttgctttaagccacattatgctactgcagctaattaaggtcgctcaattcaagtgtctcctttttttgggctcctgccttctttttgtttttcaaatcgaacacccgctatactcatttgagaagtgtagactttgatttttaaccctaagttgcatggtaaagtcacctttaaagccaatggaaaaagcttaattgaattcatttgtttgaagaagtagaggaatgttgcaagtagactgaaagttatacttagtctgttctgtttgaaaccattctcattcagaaaacagaaatgtgtttatgtaaagaaatatgttacttgacttaatattgtaaggaatcttaattgagaaaataagtagttgtgttttttctttaactgggcagcattgtagcggggtggagtgtgggtccccaggttggagagctctggatttggagtggatcctagcacatggccaccatgtgaccttgggcagtgactcagcccagctggctgccaggctgctccccatgaggtggtgggagccgtgtgggatctgcctactgggtgtgcagctgctgcggcctaagcggcgtccttgcttggtccccccatgaactcaggggtgtggcctggctccgtcatgtgttttgcagggggatctgaggggcccagaaggtaagaaattgcctacggcccttggctaatagaagagggagcagggctttgaccagggggaccagctagtgactctgtgctggttactactttaccaacaccatggccatgctgcacagctgtgcagcctccacccacaaaggccaaagctccaatggcatctgcgatgcttgtaaaacaagtagcagccgtgtccagcctgctgctctgaaacctcagtctcctttactgagatttgatgatgtttaaatgagcaaatgcatgtgtagtgattggcaggtggccatcgctcagccgacttttcctgtgccctctgcttcggcaggtgcccttcctggctccctgcttcttcctctcctaacctcctggcactgtgctcctcactcaggaattgcacccagcatcacctctgcaggtgagtcccacaccttccccctgctctccaaactcagaccccaagtccagcagcatcttctctcaggcatctatagacctccacaacttaagacatccaaattctcattcccttgccttgccataatcttcccatctcagcagctccttccttccaggctctcaggctgaaggtggcctatcctttcttttctatcccacatggcagccaggaggcctgtgggcggtgccttcaggacatgcctcttgtgcccctgtcccctactctggcctgagtgttccttttaaaactaggtcagaactagattaaagcccgtgtccaagatgctgccacagtctcttgccaccatatgactgccatgtcctcactgtggcccaggaggtcccatgtgcagagccgctggacctccgtctcctctcactctctgttaactgtgctgctgtcagactggctgcctggctgttcctgggcggtttcaggtgctgcggctacctagaaccttccatcttcctttcttcactcttcccagaagagaacactcttcccagctgtcttacggccagcttcctcaccacctcgctgcagtcttttccgcaatggcatcgccactactgccctcccacatccagccatcatcctagaataacagccactgttgtcccctgacacttgacggcagttcatcttttatgacccccattgtccccattgtcagttgtctttttttttccttattagaacataagctccaggaaagcagatgttaacgtctttgttcactgatgtatctcaggcatttaggacagtactggtacatagtagatgctcagtaaatagttagatgaatgaatatttgctacttttcttattgacagacatttctgaggtactttaatattacgttaagtaatgttacaatttcccatgtgttgattttatgtaaataatgagtaaattactctcatagagattttagaattctaataaactcatatttccccttcttaaaagagtagaaaaatgcttttaagagttttcctaaattaatattctgggaacattaaattttagaactttactctgagggcatagataaaaataaaattaattagataccaggaatgtcagatgctaaatggtgtatggctatttgtgacattctcctagaattaaacagttattaacttgcaaagacatggcagctgaagtcagaaattgatgaacttttaaagttgggaaaaaaagagctttaaggtatcttattaaaattgtaaactgtcagtttaatcatcatagaaaccatacctgatacagtaaatcgttgctattctgctttgaatttctggattctcatgaatcagacattctatttttatgtttctcttcaataatcctaaaggtggaagaaagaaatgggaagaaaaaggaagagaaccatagctacgttgtgagggcattgcttcaactctggtaacttcatgtgaaatgactacaaaatgaattaatatgcagtaagagagccagtgccccaccagggcacctttccacttgctggcacacagatttaccacaattaggatactgcttgtcctgtcatgccgggagagtctaaattactctgactttcaagaaaccaaaaatatgcatttttgatgttaggaagatttactgtgcattgggctgtgtcatttgatgaggaaaaaaccaaatgatctctttatgaaaatgaaggtaaaatatatgtaaatgccattttaatctaactttttatatgaatgtagaacaaatatcaaacaggattatacagtgtgatagtcaggaaagtagcatgcttttgtgttttatagactagtctaaaaggagccccagtagacttggtattgttaaaccaaggagatcttgagaactgttctgtctcccttgtgcccatagaattgtagcctgtggaggtgaccaaggaaccagatcccaagaggcctctgccactgaaaggagatttttattacttgcgtttcctagacgggggggcactcgcgccaagcaggcccacggggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggcccacaaatgccaaagcattaggaataagaaaatggacgtaatagaattgatcctgtgaggactggatgcctaactgccacatacagaatgtgagaaagcacagaacaactgccttcattgacaagatggtgcccagagctcaagacaggcacacagcaggaggatgccggcaggatccctcaacaagcttaccgtggtatctttcacaatgttaactgtcatcccagatgaacttttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggactacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatggcttgctatacaagttttggtcttttaaggtaagagttacaatggagatggggaaattatacttttctcatttcaaggaaagcaacagtcatgagttatgcatcagttgggaaacgggatgataggaagttgcaaggcaacctggtttcagccggaccgggactctcccggggctgcgtcctgctagagctggcaggacacagaataccactagcagcctccctgggagtggcttggcgtcttggccacctctttccacggatgtggtggatgtgggggtaaactagagagactaaagcccactattgggctcagcttcctgtagaaatcaaatcagatgaaaaccctgacccagagggagaaggcagagagttggacttttgaaaacgtgagtgtgtccagcaaccaggcagcaacagtccttgtttttatcgaacttctataagcactttatttctccagaataatttcatcataaagaatccagagctcagacagctctttaccatctgtcttttccttttttcttaccctgtgtttggcttgatctggactgcacttaaccatgacaatgttaagtgctttcttctgggtaaaaattctggcttcttctccagaaattctggctccacttctcaaattgtttctgtccctgttaggagacccctggggcctcggctggagagacagtgcagctagtcccagcagccactgtgcttgggcctggccagcccctcctcaggggtcacggcactgctcacctggtgactaggtcttctcagccagatcagttcatgtgctctggtgtttttgagcttctggctagtcctcagtttctcagacctggttaatcacagtgtggagtcatttttcataactgtgcacctcacttgtttgatgcatggcaagggaataattaaattaataaacctacagatattcccccttacagttttcaaatacagtaagtgaatttctactataaaataggtccaaagaggttttattgtttcttatttgaaataattaaagaacatttatgtttcccttttgtggtttcttggttctaatcctgtgggttgcttttgacgtcctctgttggggatacactgtgcatccgtatttaacaggagatcccgaactcccagcagggagctaagcacagatgtgtgcacagatgcgtgcttaggtaaggattttgtgcaaggtgacttgtaatatgaaactgtaaaacgtgctaccttagactggagagagaagggggtggtctgatgttttccacacgcctcttttaccaaaatgggtcatcttatctgtctcaggccaggcccccgggggtgcacaggaacagcacagctgcagtgaaggaggggctcctgcagccgggctggccccagagctgtgggtcgtgccctgcgtgttgctcagcgcgttctgcagttgccctggccttagtcccccatctcgctgtgatagccatgcaggtcagcaactgtgagccttcctggctcccacgctgcccccggcacctctctctgtttctgctcccagcatcctctcagcttctcttctgagccccacgcagcggttcctgctttaccagcaccacttctcctctgtcaccgagagagagcaagaggctgccgcgcctgtgccaactgcctggtgaggctccgtcgagtgatgtgcagggccttgcggtacagccctctcgaactcaccccaccagaggcctgtcggcatcactgtcagaaacaggcgttctcccctcccagcccccgtcacaagctaagcatctgtgagaacggaggctctgcttccccgaggatcctgccccagacgtgggggcagcctttgcagacagcttctgtcccactcacctcctccttggttttcactcctttatgccctcacggacctgcccaccagttcccaagccctcagggccatggcagcctccgtgagggtgtgagctgggtaaaaggaattaaggtggagtcacagctaccagtggctgattgcccgtgggtgtcaggctggccctaggtgccccattgctagttcactgtcctgggacggccccagtattgtcagcattgaaggaaagaatccggacaggcagcagaggctcccacctgatgacactgaggctcctgccttagcaccagggcctgggctcccctttgctgtaatgtcgtaaagtatgtcaggaaggtttgcccatgacctggtggagagagaagagatgtgacaaggcgactctggcttgtgtatcccgcccacaggggaagcttggaggagtcggtttgtgaaaaatcagggctctgagggcactggagctggtgctgagttctgcagcagtcaagaagtagagcagagctgaaatcctggctgctcatgggcatcacagatgcattcgccagcagctgggctcggctttgctctaacatccgcccctcctctgggagcgttgtttctctactcctggctgcccagcccagctccctggcctggcgagatctctgcatcatttcttctccccagcttctctctccacccatgccgccatgggagagtttaggctgtctcgtccctgactggcctgaggtagggctgtgactgtctccttttccctctctcctgtcttcctcacctatgcccacataatcagtccaccttccttactgctggatgcaaacctgctgagtctctatggctttcaggatggagttcaaagacatcacctcagcgtgaaaggccctttcaggtctggcccggcacaaccctgacacccgcatgttcctgggtgcaacaacatggggccccagggcagcttcccatgatgcatcagcctctgctggctcctgatgtggcctctgttcctgtcttaggcccctattcctctcggcaggctccacacttgccttactctatctcagaagctcatcctgacaccagctctgtcctctgtactgggaacatggagcagaaatccatcacggctgctgatccatgcatgctgatgagttgctggctgcctccttgtgcacagcatctgggggcactcaggtggccctgctgtctctgggcctgtccctgacactggcaggggttggggcaccagagttcaaatgggggccgcatatcttgtctaaatcttccagagttttaagtcaagccagtgcactattgatacaatatgttgtgtcttcttctttgacaactacatcttcaaaatggaaaaaatatgtggggacctatggtttttatatgaattaatgttggcaaaatatcaaagaccactgaatttaactgttaatttaactgttatctaggtgttctgttcagaggccactcatgtttgaatgagtaacaggatcaagacatgatttatcaataagtgcatatatctcccataacattgattattttgtttttatttctgcaaatgactaatcatgttttatattaagcattttcggataatgcttgttctgttggtgctcacggcctaatgcggggctagcgcacagcggcctacatcctgttttttgtgcagtgtttacagtttttaaagagttgttaaaaaataaaatagtgcaacagagacatggccacgaagtctaaagtacttactctttgcccctttacagaaaatgtttgctaccacttgatctaaaggattaaaaaataaaacatgtcattgggccagatgcggtggctcacgcctgtagtcccagcattttgggaggccaaggagggcggttcacctgaggtcgggagttcgagaccagcctgaccaacatggtgaaaccccgtctctactaaaaatacaaaagaaattagccagacgtggtggcgcacgctacttgggaggccaaggcaggagaatcgcttgaatccaggaggtggaggttgcagtgagctgagatcctgccgctgcattccagcctgggcaacagagcaaaactctgtctcagacaaacaaacaaacaaaaatgtcattgaatttgaagtatacaaaatttgaatatctttctatcaaaaatttgaattttaaggaaataacaaagcaaaaattataattttttgtgttttcaaaaaattattttttctaaattattaagttataagatataaagtagttaatgtgaaatgtttaaatcaaaattgtttaaagctgagttttaaatttaatactttgaaaatttagttaaatcatattaataattttataagaaataaaactattgataattctgatgtctgacatctgtctgattgctgacatggatcctgagtcttacagtgttttgagggcctccagctacattggggttccagtgccagagtggctggcagccccaccctaacgagaagtgaaggggctgggcatgctgtttccagtgctttcatgagatgctgctttgcctggcggtcgggcctgatgtctcgttgttccacctgtgaccaaggggtccctctggaaatgtgtgtgtactgacacatgccctggtggctcttgtctgatccatgtccaggttattcctgcctgaccgtcactcgtgccaggagcccaacacaaattcaggcacaaattcagtacaccacacaatgggggaaacatgttcaaagatttttacttacaggtcctgagcagggagggtgccatgagtcaggagggccgtcctctgtccctgggtcatgcaagcaggaacaaagggtcaggcagagagagagagcactgcagccaaccagcagaacaaataagggagtagggtggggtcacttgaagtgtgtgggcaggtgcctgagtgaaagatgcctctaggttctcatctctggtactggcttgagccactgggtgtggtgtagaactacaaagtgtcaggggtggctgaactctgccgctactaggagaaagtgcagctcatattccagatagatgctgaggcaatagaaaatgaaaagaattcactatgcttacgcagagtgtgtctggacacacacaaatttaagagtaataagaattgcttaatatggcataatttccttaggtgccatgtgcagttgtcacaagcattgcactaattggaataatgaattagaaagtggatgttggtcattattaggaaaaggtactttgttacacgagacagtaattgcattgtggcaagagaaagaatctgactaattaatttgtcttttttttcttttgcctatgagtgcttcttctgcttgactcctccccataatcggactccttccaagacagcctaatcttcagggcatttggatgcagctgccttttgttccagagacacaggccatctcaggggaggtatctccctggggcctgaacagcgtttttctagacaagaggaggctgagggctgtgggttctgctttgccagccctgaatgctggatcccgagtggcagaggcaccaagtgctgtatgatgtgtgtatgtgatgtgtgtgcatgtacatgtgtgtgatgtgtgtccctgctcgccccaggctggccatggtactgtgctagtcacagactggctgtgctgatcaagccaggcacagtggaaaatgggaagatgttggcgtttgcccctcccttggctgtgtgtcattcacctggggcatgagctgtgcccctgctctgcagtaatgaacaaggcagctcagcattggtccgagacacgtgagttaagagaggaggaagagcactctctgggggcggggggatccatttgtcagtggcctgcagtttcctgtcccagggatttcactggtgacatcctgaccactcacctgcactttatatggagctgttttcatcagctggcgtctgctgagcctctgcattgtgttgtgtggtagcctgttactttttgcagttttattttctaaactgtactcttttattgatagattttttgtattaggatttccatttaaacaggactttggtacgtctgctgtgggagatttgtttccctagaagattcacggctgtcgttctctcccctctgctcgtggtgttttactgtgactgcgctgaacggttagctgtcacatgtcattctctgggtggtgtgctctgaagtcattgtggtgtgtgggccccttcagcctagttctgcctaactgcggcatgatgaatgggcccgaggcagaggaggaggctccctcgtcggtaggggctgctgttgtcgcagctgccggcacacggaagtgagtcggtgtgctgctgccccgagtgactgagggacagaatgaggctggggccggccggactggcattggcgtgtctgcatggcgtcgtccaccactgggcctttgcacatggggacctttttcagcatcatggggcgtcggtataaaaggaggcgcaagaagcgctctgagaggaaaggtaattcatttagtttttattcttcagtgtgaagcatttgtctttaatgcaatacagaagtgttttctgggatagacggctttgtgaattaatcttgctgatgccagttacttcctattttccctttttgagtgccttttttgttgttggcattttatagaattttagataggggcacttaaaaaggaagattcaaaaacatgtctgtaaacatgaatagaaatcatttagcttcagagtctggagtatgtctttggaaagatatttataaaactttaaagtttgtagctttgagctacagaaaaggtttttctcccagagacagatgcttatatgagatttcctttgccgcactcttcattaatgacttttctacattaaaactgttcttcatgctgcagaaagcaaggctgagcaaccattgtgaaaatatttcccctttaaaagaatggagagcaaattccttacattctgcactccaggttaataccagtttttaattcaacttaatgttttaagtcattaaaatctagattttttttctcaaaaccagattcaaaagttgtccatgactatacacatcacaagctactggtttttggacctaaattgctgctttaaaagctgttgatgttttttttttctctttgtataatatgaaataattaatagaaaatgccttagtgaaaagatgtgtctagcccggagaacagctgaacacaggcgtgatcagtgcctctgcctctgtgtcttctgggcgcccccttagtgtcccccacccgacaggactggagtacagcgcttcaccaccacagggcccttgggacatgctgtggcaggagatggctgtttcttcaggaagtaaaattaacctcggttttttggtgtggcttcctaagaagaagaacagatgaatctcaaagtcagcaatcttgtaatagtaccttgtaatataacaaaggtgacagcacctaatggaagtctgtgtctgggagtggggaacccctgaccctgggccctctgtgcaccgtgctgccaggtgcttgtgtccagggctggggatgccacaccctcgatgctttcctggactgacgggcggtctcaggacagccaatctgtgcggccccctctgccctcacctcaagaggtcacagcattggcctgtttttgtttcctcagttaagctttggaaattgagatgtcactaagacaggcaatagggagtaaaacaaaggcacaggcaaaaactaaaggacatttttaccaaataccctcaatttagaattaccaccacttttcccatggacactcatcactaattatttaagttgggaaaaatattgagaagtacaagaataattctgtcatcattcttttggaatttactgtgattcaagcttaaaatgtctttttcatgcattccataatctcattctgcagtgggaaaaccactctcaaatatgttgcattttcagaccaaggttataagaaattgagagggttataagatgtaacaatgaggcccacatattaaatggcttgtgttccttggtcattcctatgtgagtaagttcattgtgagtgttactaaacagtatcatgttatgtgttagttctcgctgttggtattttgtaataagcattatctttgaaactaataaaaatacctttgaaattatcgatattattaagattggccatcacatttataccaaactggcaaagttttataagatgtaaaatagtcttttatactgtatatttctaaggtactgtaaatcatgtgtattgcatggttttttccctaagactgatacaatgtacgccttttaaaatgtaattctttgatgaaaacaatgtagtagcaagttacgggttttagttggcttcagtggcaatataatttcagtgatttttttcatcactcctgaattatacttgcagttactcccttccacagggcaaataattgactgttgactgtgtgtgagcctcagatgggttagcttaatcatcaggaaaatagggctaaagaataatgtaccatttaaatactggccagagtccccatcaagcagacactgccaccctggcagatgctgccagcacgagacctgggagaggtctgggagccacagggcaggattctgagtagcagttagtgcccatatatggagcgcttcctgcacccagccagtgctcagtggctgctgctgtagcctcattcactcacagcactgctgctaagttcatgaccagtgggaggggagagagatgggaacaaagaggcagtccttcagtccccaccctcctgctgtctgaatagcatcctgtatttccagatgtatttctcactgagtgttttgtttgtcccctatgtgataacatccttatctgtgcttagtcgtgtatgcacatgtgaagaccactgtcctctggcagcagttctgaactgtgttttagtctgaggctgggctcccccatgtttccaggatagaggtgaacagggtgtggggacctctgtggagctggaggtccaaacgtagagaggcctgctccccctgagtacttctggaggagaagccctggaactcctgaccttcacccttcacagagtgagcagagccagttggccaaggggaggaagcaggcggctgtcgtaccagcctccttctctggtgccagccatgactctcaccttacaaagagagcaaccctttgtgagatgcagagcatggtagcacctggaggtataggacgggatggcatttatccacccatccatataccagtccatctactcattgtagtccatccatctgtccgtcaacctatcatccatctgttcactcatttacccatctacccacccatccatcatccatccactcacccatccatccacccatctacccatgcatccatcatccatctctccatgcatccatcatccatctctccatctagtcatccatctatctgcgcatctacccatcacccatctattcatccatccacccacccacccacccatcatcacctatcatccatcatccattcatccatccatccacccacccacccacccatcatcacccattacccattatccatcatccatccatccatccacccacccacccatcatccattcatccaaccattcatccacccacccaccctcatcacccattacccatcatccatcatccacccacccacccatcatcccccatcatccatcatccagccatccacccacccacccaccatcacccattacccatcatccatcatccactcacccacccaccatcacccatcatccacccacccaaccacccaccatcacccatcatccattcatccatccatctacccacccacccatcatccattcatccatccatccatccacccatcatcacctatcatccatcatccattcatccatccatccatccacctacccatcatcacccatcatctgtcatccatccatccatccacccacccacccatcatcacccatcacccatcatctatccagccatccatccacccacccatcatcacccatcacccatcatccatccatccatccacccacccatcatcacccatcacccatcatccatctatccatccacccacccatcatcacccatcacccatcatccatccatccatccatccacccacccatcatcacccatcatccatcatccattcgtccatccatccacccacccatcatcacccatcatccatcatccattcatccatccacccacgcacccacccacccacccatcatcacccatcacccatcatccattcatccatccatccacccatgcacccactcatcatcatccatcatctgtcttccatccatccacccacccactcacccatcacccatcagccatcatctgtcatccattcatccatccacccccccacgcacccacttctctacattgttccgttcatccaacaagtactcattacacccttctctgcatgctggcaccaggggtttgaacatgcttagggaagatgggggtaatgggatggcagtggcagggggcagccacagctttcaggcttgaggtttgttctggaatgggccacctgaaatcccactaggtgcatgaagaggatggatttatgtgatttgtcactgctgcactgtatgtgtagtagtggggagggatattctccagtatctggtgagaaaggaagacaccattctctagcagtgtctgccaggagaggggcccaagtaaggaaagttgaacccccagtggacagcagcgttatggatagaaggcccagatctcctagaacccgttgtaatggctatgtgtgtacctttcactgcatctgtgctgatgggcctcgcagcacaagaaagactctgctgcctgggcaggagctcctctcagctacagggtgcatttcaagcacaggtgcatacactctaggttaacagttgaaattctaaagtaagcatgtagaagtagatttgtgaaattgcacttgaaataccatggaaattggatccaaagcagattgaacagtgccaattcttagtgcagttataagtgttaatattgaaaataaagtttacatcgttgtcttttttttccctttgattccagaaaattaactacaattttcaaataagcaggaacttacttaggttgtgttaagtagagcaaagtggacagtctttcaaatgcattgctgctgcgtttgcactgtgaaggacggagcaacttcacgaaggcagggccctgtgaaggtttgtgctctcgtgtgccggctctgacctgtgattttgttgctggatgtctccttcagcagttcatgtggctttctaaagcttgccattgcttaggcatgcctgactgaggcgggaaacaagcgtgtggatcagtgtggctctgtatgtgtgaacatgtatggacatatgtgcatagggtgggggtaacgagggagagggacaagaagggccagggcttgtgaccacatcagaagcaagggtgatgctctgtggcacagctggccctcgaagtcactcagggacctaggtttcttccatccttaagctctgttctctaacagaagtcaccctggcagttgcttctagtccagcaatagaaaggtgagaaagaatacagagaagcacgcaggaagctgtgtgagttggcccagatgcagtggcacacaccacaaattgcacagcacccccacaggaggcgagcctgtgtccttgcccatcacctctttccagctggtgtccagacctcggggtgatcactgattgttgtttcgttggtctggctgtggctcttcttgggccagcagcctgggagccacacagggacagggtaactgcgataaaatacaattatgcaggagaggaggcggaagggcccagcctggccctgtctggccagcttcctgcaccctgcacagcagggagcatcctcattctccagaccctgattcttctcgggttggggcgggaggggggaactcccttgtccattgttctctcagccactggcctcatcctttgggggttctttctgatcatcgcctccagagtcccatctgaagagggtatcagtgtagaacacagtgaggcagaatgtggaagcaaacgggaccatctggaagttttgctctaggccttataaaacacataatttgttaggtgtaaaatatatagtatgttgtagtagtgataataggatggaataaatgccttagatttgcaaaattgggtcagagagtttagggatctttggtcctgtaccagtgacatcattttgtggctcttggggatttggggagggacctccccgaggccactgtgcagcagcctcatgcccagggctcacaggtcccatatgtgtttcctccaccaaagcaccctgagctgtcctaccttcctcacatccccacaccccgcgggtgtccctctgcttagcagctatttattctgcctgtatttgggccaactgcacaggctgtctgagacctgacagtatgctagaatgtacagggcatacaatattttgtgtaatatcatggaaaagtgtgccgttctttcggttgacggtggttgcagataagactgcagagacagcttgtggtgggttggagtgtgactcagtctcccgtgggtctgctccccttccagactgcatgtggaattctgtatagagtaaggcatattcgtgtatgtgggagggaggcttagaataaaatttattttttttcttatggaagcagtacatgttcattgtaagaattaggaaacatagatacaaaataaactttatgaaaaagcaaaggtgatcatctgcattagtctgttttcacactgctaataaagactgaataatttataaagtaaggtttaattgactcaccgttccacatgactgcagaggcctctcaatcatgacggaagatgaaggaggaacaaagggacgtcttatatggcagccagcaaagagagaaatgagaaccaagcgaaaggggaaactccttttaaaaagtcagatctcatgagacttcttcactaccacgagaacagtatgggggaaactgcacctgtgattcaattatctcccactgggtccctcccacactcgtgggaattatgggagctacaattcaagacgagatttgggtggggacacagccaaactatatcatcatccttgaagctaaatctttgaatgggagcaaaaccataataattttcttccaattcgtagtactagaattagatttagaagtgtttaaggctttatatttttgtcttactatgaccaggggctcagtaatgccttacttctgccttggaggatgatgtgagcatacaagaggggtggccgcatccctccagcttcattcctggtgtccaatgggaggcgaataggcccctttgcacctcttaaccaccatagtcctctcccattgccagcctcttctgacttttgggattgttttaccctctggacagcagtgtgaacaaggtatgtcaggccaagggggctgctccccatgggaggcctggccgtgttggcttccaagaggccagatgggtgctgctcaccatagaaagtgacccttttccctgttcctgagccaacctgtcacttccatgcgctgtgtgtcactttgaaaactatctttgctttctgcaaaatgaaaggaaactttcaaaagtcaacgtattaaagcctgtttgcatttattcttttatgaattttgctcacattttttaattgggtgtttgtctaaagacaattatcgatcatagtaggctgctggaaggttgaccacagaaacctggttctctttcagggaggtcaccatgtctgcctccaggcccatcgggtaggggctgccttctgtcaaggcacatgctccaggtcccttagatggaaggaaaacacatggtctttatccagtggactcagggtgcaggtaactgaaggaattaacctccatcattttcacagatcctcgtagagctggaccgaaggaggtgggagatccctgccgggagccgctgcagtgggagggcttacagacgttcgcatagtctctttctgtttggttgttttaactcccattaaaaggagtggctttcagccttcttgcttactgtcttgtgatgtatgtgtgttcacatgttccatgcacatttgtaacgcttaccatgctctctgattcagctttgttcccttagagttgccccagcactgctttgccatgatgattgtggtttttaaaatacttccagttgcttacttctgtttagttatctcagtgctaaatattgttaattaattaaatataagcagcatgttctagattttatgtgtctggaattcttactaaaaatcttcctggatatgacttccagtcataacgttatggattttattgtaaacaaggtagaattttatttgccttttaatcatttcattatggtgagtgtcctccttacagagcgtgtactgaatttgggttttactccttttttgttcatttccacaagttgaactctgtgttattatcctattttctgttagggtcattgtgttgttaagtaatcgacttacatagaaggtgtgcacctagaaggttaacagaaaacaagttgaaacatgactgaaaatatatttctgtaagaattactgtaattcttctgagagtataaatagccagggttttaaagatctgctttataggatttatactgcaaataacttggcaggattaattggcctgcatttgcttgctgtagtcagtaccatctagtgttttagtcaatatcagtttttgtagtgtggatgaggctggtgatggcagctgcagcctgtctggagttgctgctgccgtggtgtcagctgcagcgggggaggctagggctctgtgctccgcaagttggtgggaaccgggaacaggtggaagccccacccccttccaagttggaggggcaggagccccgccatcctgggcacagctgcagccgtccattagaagctgtggacccaggcatccctgcactcaccggggcccaggaagcccccctgccccgacaggctgagaagtgcctgctcccactgcttggtctctccccactcccagcacctgctccagtttcagatcaaagttgtggccgagctgggacactgtcacaacctggctgggtgtgtgtttgctcagggcagtgctgacatgccagcaccctgctgcctcggcacccccagactttgggtgctgacaagcatgagagggaggccaacgcggggctgagggaagcacagcgcaggccttgcagccgcccctcggcaggaacactctggatgccatgcacactgtggatggcaggataatggtggccggaggcagacaagctcctgggaagaaaggggagggtccctggtgaaactccaccttcagcttacagagggcttaaggcctggggcccaggctgtcagttccacagaccggagtgagaacttacggtgcttttccagggctcacccgtgactgcccatgcaccaatcagcacacactttcctctgaagcccataaaaacccccggactcagccagacttgggcagaagacaggacgacctgcttatggagaatagctgcccactgtgggtctctctgagctgttctgtcactcaatgaagcacctcttcacattgctcaccttccacttgtccacgcacctcattcttcctggacatgggagaagaactcaggacctgctgaatggcaggtctgaaagagctgtaacacaaacagggctgaaacacacccattgtttgccacattgcaggcaatgaggagaggaggagagaaggagagaagagctgcagcccttcaaggagcccagacctaggagctccctgagccagggcagtgatgccccctttggggccctgcggttcctggtgtttccaagcttctgggcactaccgtattccctggtttcagccatggaagctgtgtgtggtatgcctggttcagctgcagccttgcagggagccagtgtccatgccagtgcctaggtctgcccgtctcacctgcctggctgtacacaatggctggaccccacgcccactcactcacacaccccttgccactccacacctggctcccccttggcaggcatgggatccaggctggaagtgtgagccgagcgcagcctgccaggctgtgtgggcagaatgagcccagcaggcccaagcaaaactcgggtaaaggcgccaccagtgatggaggtttctggccagaaaaatgataccctgaggatcctatgacactgggttctgatttaccaaaaagagccacacctgactagggacatggggaagcaggggcatgcaggtctgtccatgaaagccccactccttgctttagggacagtagctgatgcccatgagcgctccttcatgcaggtgctgtgctagcactgaatcaccagggcttgctccgcctatagaaccacaaccaagaagatgggagagactctcagctcacagcaccagacacttcagacccaggttggagagctcaaaggcctgaaacaggctccaagaagatgtgagtctgaattcacagcaccagacacttcagacccagatgtgaatcttaactcacagcaccagacacttcagacccaggtcggagagctcgagggcctgaaacaggctcagtcccagactctcacccagtgctcccttgcccgctcggccaactgtcgttttgcagacggcaggctggtcagaggcttcccatccagagtgacccatgaggtgtttctgttccttagaagaggacgctaatagctgcctgggaaaacagttgttaatgaggattgtactaagtagatccctttcacatcaatagtaaccagtttaaagccttttcatttacaaatatttctgatttaaggacttagaggtcagttcgtatacagtcaagtttagatgtgttttggagaaagtggatacagcccacaaggtcccaaaaggcaacagggcacaggtaacattccctggctgtgattagttggttgaggacatcacaattggaagcatccacgttcttcctcacaggaagcacttggctgagagctgtggacactgaggatgaggcttgagtctgtcctagcagagctcagggcctggtgggaaaagcagggtggtcaggccagcgggggagtgagcagggaggggcaaccagctttgcacaaggagccaggaatctcccccccacctccaccctgcaccaggggcgctgactctgggccctcaaggccccccactggggacgctgactctgggccctcaaggccagtggcatccacagctccatccacagcagcgagccttgtgcagtttcaccacaatagtagcacatgtgtgacctcctgggggctgctggggcctatgggagtcgggtgtggacggtgtgctccctgggcctgctcggggatgctgagtaccaggcagcagtgagtggggtgactgaagggaaactcgagggacatctggccctctgctctgccacgcttgtccccatgcttgctgtgtttggtttggggccattggccctgctcctgtagactcagagtagctgtctgtcccacgttgccatagctgagttcactcggcacagtcaccttgggctgtgtgctttttttgctgatcccttaactggtgagaactagtgtacatttgaacacttgccatccagttgacacctttcaataaaaattgcagattaataataaatgatagaagttcatgctttttccttctggtgaagaccaacacatggccctgttttaaagagcagaaagctgcagagccactgccacgtcgcaggcaccatccaggatgtgtaggcgtctcagggatgttacggcactcagaggattggtttatttttaggaaacaactgtagcagccaagtgaagactctggacaggggaggacagctgttgaatgtgtccacagggcctgaagtaggccacgaaagccccaagtttgcccctgcgttggcacaagtactggggctgccaaggaaaaggcgggggtggaggaactcagtgtacagcatgcctgtgggggcaggcatggcgcccggggtggaggggtggaggagaccgagcctgccccagccatgtgggcctcgcagcccactgggagaggcaggccacaaacagggagacaaattgtggattgcactgtgcgtggagggagagggagcggggcggtggggtgggttggtgccgtgtgagctgggacttgagcagtaaggtggggtctgatgaagccttgcgcgaggacatggcagggagggaacagggaagcaccccaggaagttggagaggctctggtgggcatagcgaagggctgacgatgagcacatgggcatgtgttagagcacgttttttatttataaggacataaccctggctgctgcgaggagaggggctctcagggtcaagagaaggcagagaggctcctgcacaagctgagtggtaacagcagcgcagaagcagacaggctgatgtgtttagcccaactttgggagaagagctggtgacatggggtgtggggtgagaggggagagagaaccaggtagtctccaggtgtctggcctgatggctgcagcgaggtgacaggatttacacatgtgcattggtacacctgctgcccgggatggccaggtgaacaaggagttggcctttgtcaaagctgaaaacaccttacttgaggccccctggagcgcccaggcctcaccaggcccacccccgcccagccaccctagagttgccttgctgggccagtctactactgtctgtgcgactggcatgtggttctcccgtgatgcatcccttttagtgaggaaggaactagagccacagtttgatgaagttgctgactggaccactgaggtgttagtgccctgtgcaaggtgccctaactgacacctctgcatgtttctttctgtcatttgtccttgctagaatttcctcttctgtttcagtagattcctattctcatcaatatttcccacttaatatgatgaatattgtacattattattcttattttaattatctcctttttgcattgcactagaaaaaatgtgtttgctgaaaattaggcacaaatcttgcttgctctgtgtacaagatctataaagattcacttagcagcttgcagggacggtttcctagaaggtaaaatatttcactgaaaatattatcaattgaatattttggaacactttagtgatattgtttggtttagataatactgaaagcaaaatataaattatgaggtgaagtgtatctctaaacatgcatgattcgcttgttgagtttcagattgttttcgttcaaatgatgtaagaggtttatacttcagttgcttttgttaaataagcaaatcatctttcaatttttttgctacaaagttaatctagctttggaatgctgcttgatgtatagtaaagaatgaacacgaataatctccactttaataccgtttctttttttttttttagtttgcagttcaaagctattaaatatggaacccatagcagtcataaagaatatgtaaaagttttctcaaagctatccatttttgaggggaaaatggatttaatccagtaatatatgttagtaattttaatcaagttcaccagttgtcttaaacagtttttaatctataaacttttagtggactcctaaagatgacattttttaccagcacaatagaaactattcaagttctgatgcatctttaatgtaaataagtcatgtttttaatattttattccaggatatgttttttcattaagggaaggggagaaaaagggtaggtatgctcattgtccaaagttgataagaacattatatttatatatattgtttatacttgtggttgcaatgtatctataaaaaggtataaagaataatataacaatcatttacctacccccagtacaaaacgtataacattgtcaatttgaccatgttagctgaaatcaaaagcgagctcatgaagaaatgatcaggacacggtgagggaacggccttgtttgatccagcttgatcttcttccatgtcggcacccagtgtctggtcctgtttattaaaaataaaaagcatgttcatatgtccctgatttaaaatgccacctttaccaaatattctgtgtctggatgtgttgtgtctgattctgggtttttcttccatcacattgaccctctttgtccgtgagccacgctgtgttgcgttaggcactgaggctctttatttctaataggaaggactaagccacctgctcctttggttcagagttttcctgagtatttgagtctgtttatccttttcacgtaaatgttagaatcagcttgtctagttccattaaaacaagttggatttgtacctggaaccaagtgaaactgaagtctcaggtcttctgcagtcaagttcaatgttcttccacactcaccacctcccagctctgtcttcttactgcattaggaggcattctgagaaatgaagaggttgttttgaatattgctatcaaataagtcttttttttttaattgaccattcttggaattttgttccataggggatatttgatagggttttaattcttatttgtttgtagttcaggtcataagaggttcttttaaaaagggaagaaaaaatagctctgtgaaatgtgctaaagtgcttgcatgtgctgttttgctttgttttataacctttggtacaagagttggcattcgtcaaaactgaaaacgttggcttctgctctgcaagagatttgtagctcccattcttaatgtgggcggtacctgcaggtactcacctgccaccacactcggcatgactattttctactgcgagacattttccatgtccttttaaaagaattttaatatgtaagggcaggaaaacaaagtgaactgtatgaattaggtgaactacatgagctgggctcactcctgtgcctctgcacttttattgttgttgtaaagtttgtttttcctggtcccagaaatctgagagaagtcagccttctcaggcaaaccaattattgattaattatgtataagaattaaattagccatttgtgtgtcttctgcctattattaataaactttttattttgaaggctgggtgcggtgactcatgcctgtaatcccagcactttggaggtcaaggcaggcagatcacctgaggtcaggagttcaagaccagcctggccaacatggtgaaaccccatctctactaaaaatacaaaaattagccaggcatggtggcacgtccctgtaatcccagctactcgggaggctgaggcaggcagcttgaacctgggaggtagaggttgcagtcagccgagatagcgccactgcactccagcctgggtgagcgagattctcaaaaataaaaaataaaaaatactttttattttgagataatatagattcacatgtagttgtaagaagtaatacttatatgaacgtaagccttcatttctctgggataaatgcccaggagtacaattgctgagtcatgtggtagttgcatattttatttttaagaaactgccaaactactttctagagtagctatcccattttacatttctgccagcagtctatgagagatcccttttctccacagcctcatttcacctggggctgtcactatctttaaagcaacactatgttgaatagcccttctcggaggtgtgcagcggagttatctcacggtagttctcagctgcatttccctagtgactcgtgatcctgagcatcttttcatgagtttattttccatctgtagatcctcttcgtgtcctttgcccattttctaattggactatttgtatattttactgttgagctttgagaatttcttatatattctatttgttggatatatatttttcaaatattttctcccagtctgtagcttgttttttcatctttttaacagggacgtttgcagagaaaaagtttttaacttccagtttatcagttgtttcttttgtggattgtgcttttggtgtgaagtctaaaaactctttgcctagccctagatcctgaggattttctcctgtaactttctaaaagttttatagttttatgttttgcatgtaagcccataatctattttgagttaagttttgaataaggtaggagacctgaattgaggttcatttttttggatctctagttgccccaataaggctgtgcctcttcacgaaattgcttttgcacctttgtccaaaatcagttggacatatttgtgtggtgtattcggggttctctgtgctatcctcttgtgatctgctcgtctgccccttgccaacactgtaccgtaccgatgactgtagctttgtagtaaatgctgagatcagctagactgattgctcccactttattttttttttatggtggttacattaaagtctttctaagagaattctaacacctgtgtcatctccgtgttggcatctgttcattgtcttttttcatttagtttgatatcttctgtttctcgatgtgacaagtgattttttattggaacctgattatatgatattatgagactctaaatcttactgaagccttctgttttagctgactttctcatacaccacggtgtcagaggaagcggggatgctgtctcattactgctggatgggggataagtccaagttccccactggggctcccggatagctccctgttgtgagagggcctcatcactgctccatctggagccttcactggcagcaccggctagcgtcgtttctaccaggtggaaagagagcccagcttccccacatagtctctcatgactctgcactgtggcgtgggaagggaaggggttgttagagcctggtggaaatgaagattgtggcttgtcactcagccttgtctgacaccacccaacaaggggactctggggttgtccttacagtctggcacgggtggggcgtggttgaggttttttgtttggtgtttggctggaataaagcaattcttgtctaagaagttttctgtcttgctgggctacctctttcctggtcctttggccagagagagcagcttttgttgcagctttttgtgtgttttgtttctgccaatgcctgctgatgtttctggcttcctcagctctatgttgagaaaatgaagcaaaaggaaaatgcagggtcgcttctcaggtcctgaggccccctggcttgtcagctttctctacatctctcagtctttttatgtgtgttttatgtataatatccaggatttttagttgtatttaatgggaggaaaaaggagaagaactctgtcttcccactgaggaagttcctttgcctatttaaaaccagtttcagccaataagaacagagctatttggacaggcttattcgttgttcctccagtttatagtttgggcttctgagaagcgccttgccatcactttgcctgcataacctcagtgccctcacacaagccacctgttttcccgtcttcgtgatatgctcagccagaccccttgtctgaagctcagtttgacgagcatgtcctcattttttggcctgatccctccagccaggaggctcctgggagcacccacagcctactgagggcatctgccctgactgcaggggtcttgccctctgtgcctacatctcacctcccattctagaccttaacccaattactttttatcagtccttccataatggaaatattaaaacatatacaaatatacaattgtatcaagaactctgcatgcccgtcagccacatcagtaattaccaaccagggcccatttgttggttttgtctacactcatctatgtttttctcaccacactgaattattttgaagtaaatcctagatattgtcctttcatttgtaaatacttcagtatatgtcactaaaagagaactgccatttctacacctaaaataatttatcataattccttaatataatcagctgttcaggcagtatttacatttaagtttctcagaatctgatttaggttcttgtatctagcacaagtgctttgcacgtaatagattctcagaaaatatatcttgaaatagttaatgactataaaataataatgcttttaaaactatctggaaaactttgttgaataaaggattctaaagagaaactcatttaactttcagcaacacatttgcctgaaatatagtgagattgaaagttattaacatgatttcatgaaaaactatatatataaaatatctatttttagatatatgatatttgatatagatatataagatatatgcatgttttagtacattttagtcaccattttctaagagcaatgaatttgccttttagtgatttataagttttatttgtacacaaagtaacgtgtgattataaaatttgcaaatcttctttttcctcaattgcaatttgatgatattatttattatagaacatgtattaatacagtctgacaaagtataactaaaatatttaagaagaggaaactcttaaatttgttagtaactagaaattgtaatacctgttctttgaggatttcctgtggtttctcctgccaacaaaataatacttatatgtaactaagaaattagattgaattttagcagtcatgtgcactttagttttgtctgcataaggagctattcaaggtgagagagaagtagctaagtgagaagctgtaggttctggttctgctgtgtggctttagtttacagctggaagccaaaagtctacccagagtaaagatagatggcaagtatgtgagcgcccttctgaggtctgtcgccatctgtcatggcgtgttgtgtccttagtccatcctgcagcaggcgtctttccagagtgcaaatgccagtgcctttgtccctagttcagcgctcttcatggccctccattgcctggaatcaaacccaccctcctcagagtggtgtgaggtccctgggcactggccctgaacctcccttgctgggacctggtcccaccctcatcatccctccatgtgggagaatccacgcgagacgtcctttgctgtgctggaatccacgcgagaagtcttttgctggactggaatgtgccaaggaggagtattttgtaccagatggcagatctgacttctctaacaagacctagttcttattttatgatttttttcctttaatttgtaataatgttgtaattatttccttagagtagacttacttcatattactcctgtcataggcacactaaatgctattttcttactgtctttcagacagaaacagtctccgccagtcaagaaaccctcaaaagtattttgccatggatatagaagatgaagaaaacatgagtaagatctaggcctatcacgtagtatcagatagctaattttatgttaacattttggtgtttttgcaaatgtatttcatgagaccagtgtggggattgtgttttttcccgtaacatcttctactgacagtggcatgtttttaatttttggtgtgttctctgcaacaggtgtcagaatttgctgcagacgtttttccttcctcgttatcgtcgtggggcatcactgtgccccgtggaatgggcttctgggtatatctcatgaagccccactgtttcatgtggagtcctgtcacggcatgcctctcagaataatgctctgagtattcacacatacaaatcgaagataacgtctgagattgatttaaatacccaggcctttgcaataataggacagaaatatttcccttcaaaatgcaggttctcgctgcattttgaaggaaggggattcacacgtgtctgttgatctaaagttcgcaaaggtgctaatgagagctgggactggtgtgggcctcctccttccgtgctgttctctctggtgccggggtggtggaaggccgctggggtacgttggtgtttcggtgaaggtacttatctcttctagttcatcttcagtcccagaaaacaggtttagatgcttccacggaagttgggagagtttagtagagaaattacaacaaaggcatcattgctctaactaatataaatatctgtatttaccttcttacttgtctgaaggaataacatgcagctgtcaatgatgagtgacatgtcactgggagtgattattgagcattagaacttagcactttccctttgactttacgcacaaccgatgatctggggtcttggagtcactcttgcgtaccatgtagaacccaaaccatgacccagtgaagcatttctgcatggtattgatttctgcatggtattgatttctgcgtggtattgctgccccatgggtgtgctgtggaggcggctgggcctctgctctatggactgtgtgctaagtgttggctttggttgaagtcagccatctggggtgtgagggtgagaccacctcctgcagtgctacccaggaaccacgggaccagcgtgctcacctcacttccgctgttgtgtgcgcagcccgtgcctgcctgctggtgattgtttttttcaggtttttatcctcatcaatcctgctcttgagatcttttaaaaacccagcttcatgtttttactgggcagttctactcactgtttccaagtttgtgacaagttttaagagagaggttacgtccatactcctcatttgagaaaatgtgacctgtgcttggcccgtgcagtagcccaccaacggagcatgtgcaggggtcctcagggcctctgtgtcaggactgtggcctacagcctacagctgcagtcacctcgcatagacagaggctttgtgatcgtgtaggttctggaactatccccaaactgatcctgtgatcacttgacatgataaagaatcctcccacatttttctgtgaagagaagccgatgttgtagtgctaaaacgtggacattctggtcctgtatttgtatcattttgaaagcaatgcaaagccctgtcatgatcagtatttacatttatgaagtgtagtagcatgatacagaaagagaaggcatctgttgaagaaaagctgtgaaagtggcatctttctctagttttagtattttcctttatgatagtagcattttcagtgacagtgagagtagtatttcagtgtgcccctgaggtgaataagaatttagaatgtatggaatctgtatcacagaaagtgtattcttctcaagattatttgtcaatccaatagtaattatttttatttctgaaaggaaagcatttggttatttcagaggttataaatatttggttaaatgcatgtccaaatacatttataatgatttgatttttgatattgataattgtttagcaacaaagtcaaaatgtaagcagtaatctagtatgtcatgttcttgctcagtttattaatctctgaattccatcttggctctattttttttaaccttttgttccctttgagcaccgaaaggagtaacctatcgagcttttgctggaggatgttataaatgaaaatttagtgtccattccatcagctttgtcaactgggagaagtggtgtgtgtgtgaggattattttggagaaataatgtctgtagagaaagttttaaatctcttagcctctaccacagtgtggcatcagttttcccatggattgtgtctaaaccaggtttatgctctgctgtcttggccgaatgatgacagccctggaattagagatctttaacctcaaagattggcagccaagggcgaggacttggtccctttaaacattcccatggatgaagctgatgaatattttcacaacttttcagtttgcttaacgtaatgagaatctaccattttacacatgtagtagaaatagaccctaaagccaccatatggggcactcgtaaattggtttacaattttagtaatattttggttactttaaaaaatacagatttttgaaatctagtggtagatgtctttaactttcattcacattacaaccttgcagggcactgtagccctcacccttgggctccatgtgacagctgcctagccatgatggaaaggaattatttcttcttctcctttttaaaaagcttgatgaacactttatactcctctttttaaaataaaaaattagggctgggcacggtggctcacacctgtaatcccagcactttgggaggccaaggcaggcggatcacctgaggtcaggagttccagaccagcctgaccaatgtgatgaaaccccgtctctactaaaaatacaaaaattagccgggcatggtagcccacgcctgtagtcccagctactcgggaggctgaggcaggagaatcacttgaacccgggaggtggaggttgcagtgagccgagatcgcgccactgcaccccagtctcaaaaatacatacatacatacatacatacatacatacatacatacatgtataaatccataaataaataaaatttaaaaattatgtttattttgccatgtaattttacaattctaaaattgtctgtattaattcaaaatctgaaatacctttaaaagttaggataaacaaattattctggaaattcatcaaataattgttttaaaaaagacaaaatcaccagaaagtgtatttatgaagttaggaagttgtaacctgcctacagcttcagttttgtgtcttgttcttacacacttttcctatcatggaacgatattaaggattcagacttagtcagcccccatatataatattctcatttttaaatagatactagaaataaaaccataccctcctaaacacaacaactaaaaagccataatactttacacaattacataagcagcttttaaagattggttcataaactaaatcaaataattgcatttattgattgaatattttaaacctgaaaaactaattatcttgtgaatgcatgtttttaaatagttttctcttctgagagacgctgcaatttaaaacccttagatagcatgagggtaaacaacagtgaaaggaagatgctaaaataaatatatatttatccatatattgatattaaattgtcatttcattagacttattaatgtaaggtctttctggattaatttatcatcccacattttgataaggttgaaaaagtctaggtacttcagaatattctcagaagaaaaaaaattatttaaagattttactttttaaagcaaaagcagttggtgacactaaatagaaatggtattagtcactaagcaaagtgtcagattacttgtttagttgaggctgatagttctttaactaaatgtataactcttcatgtatacatcaaggaataaaatttataagcacacatcacttaaccagttacaaagagagctaaaggaatctataaattttgcatttacaagatcctgcaacgaaggcattgtaagttactctttctgggcaccacaggttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggtgaggaactatgctgctgctttaaaacacggggtcattgctcttggtaatgcttctagacagcattttagtttcaggattactgttgactttccaccttgacatcactctgtccccaccaggaggagttactggtaagtctggctgcttgatttccatggccatgtggccactgagaagccgtctgcatcctagtgcatgctgggtctgtcgcaatgcaaggcagggacacctgagaccccgtccaccagagcagtgtttacaacactatccataactcccttcccgttaggcaaccccccccatgaccctcatcccacagcaagcctttagcaggagagacggaagaagagcccagtctttgaaaccttgcccccagttcagcaccattttccttcaaaggtctcatccaagaatctcacattcaagataagtgacaccagcccgtcagcagctgaaaacccaagtctgggtcaagatggcagcctctgggctcccacatgactggctggtggctgtttgctgttcctaagccgaggagcccatcaaagcagcgaatgagccagcacagcagtgagcacctatcagagcgcagggagggaggggcctccaacaactgttctagggcctgccagttgcctgggagtctctactttgaatttcctacatgggctgtatgaggacttccccgcatgcccaggctggaggtggacagccacccttccatttgacctccccagcgcagtgaaatcaggatgaaggaaggggaagttccagggtgggcttagattggcttacgtgaaagagaaaaagtaaaggagaaaatcacctttagttctcatctctaaatcctaaaactctctgattatgtattccttcttttcttggaaatccaaagttcttctggtctattgcaaaagttatttttttgaccctctattcatttattactttgtatcagagtcttcttcactttgaagataacatgtatactacccttgaccacaagacttgaaggtggcttgtgttcccctggaagaatccaagtgtcttatagtttcttttttgctgttggctacaattagaacaacctctgtgcagttgtagtctgagatgaccaggagttctgttttaaaggaaggaaatgtattttattttgcctaaaggaatcaaatgcaacatcagtataaaataatatattcaaggtatttcactgatttttttaacgaaccaaatacttgcttcccttattaacctctcgtcaacattgtttataaggattattagtccatttgtactttaacaaatcagtgctactagatcccatgtgattttttattttcaggattactctttgctaaaatattaaagcctgagttcaaaatattgtctgatgtgacttgtcttcccttaatattgacagagtggcatataagaccattgaaatgacatcaaatgccgtggatcccagatgtctgaaccttcagtgtgtaggctaggagcaccttaggcggacgcagatcgaagtgccagtagagatgtcacccctgcctccctggcttggctgtgcgcctgcagtgacttctgtgtggagcatgaccagagcccctggcttgggaaggctggagggacatctgttgggctccagcctggggaggggtgcaggtgggcagggctgcctcagccccctgacgccacgttcctctgggctctgtaggtgctgaacaccaggctctaggcctcatgtccagaaccactagggcatgagggcatggagctgcacttcgagtctctgccggagtggaacctgccaccttgtgtctttggagcccccaggatagccccggaatgtgacgtgttccttgtaggacccgggtggccctcccagaagcagtccttagggctttgttggtgggctctattgtctttcaacaggaaatttccaaatgtgcattctaggatgggtggaaaaccctcactctttttctagagtaacccttgaaggacgtaggtcagtcatccctgcgtgtcactgcaggtaaatggtgctgcctgggactgtgtggcatgggtttaactcttaagagcattttttttgttcttatatctgtcccccaaattaagagggaagtccttcattaaccatacaggttaatgagaccagtaatcccctcaacggggtgctgagccctggccatgtgcctcagatgtctgcgttaacaagcatcagccccagcaccagaccttcagagtgaggctctcggaactcactctgaagttaaagttcttcgcctctctttgaaagtttggagattcgcctaatcttacatgaaatggaaacttttatttcctctggcttatccctaatcttcttatgactttttcttctctgtaaactcgaatgaatcgccctttccctctggcaccctggccaattggaatgcgtcgccccttccctctggcaccctggccacgtcctgtgtttctgtcacagcctcagttcctcgcgtccgctcacccctgcattgcagatgccgctgcctgcgggtgcatggatccctgccaccaaagcctctgtccattctccacatgacttgtcttgaacactgtcctctggggctcactgatacttgctggtgcaatgataagagaaaaacatcctgacaactatcttttctactcatttcagaaatattttattaaggaccaacctggggatgctgggttttcctagtagtcatttgattttccagacaagtgtgaaattggtgggacatgagttgaaactggctcttaacacccacctcccagcagacatcatttcccaaaatgccatgggctcattatatccaagataaatcataagccataagaccatgtccaaaatccaacaaatacatctgttctcagaagcactttaatacagatgtctgtctgacctgagcatatacctgtgcaggtgttccgaacgtctaagcgctttccctccccgtgctgttctctggtacatgattctatcgtaccgtctgggcgagtgagcggagtcagagtgcatttgtgtggagaggctggaatgactgagaagcctctcggtggcgcctttgagggaggtgctgtgcacagcttgtggcttctttcactggatcgcatctccaagctgcccctttctcttgcctttgattttgcacatcatcctgggctgtgctcccagctgtgtgtggccctggagctgactgagccacaccgtgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctatttccaaggaatgttctggaagaaacatacacacatacttgtttgccagatttacctgtgtggttttccagatgagaagcagcctgtgtcactccataagggagagtgcgtgcagcattgagagagtgagccctgctcccagctgcatctggcccctaacctgcatctgtgcttcccacacaggttttagctgacgctgtctcacgcctggtcctgggtaagtttggtgacctgaccgacaacttctcctcccctcacgctcgcagaaaagtgctggctggagtcgtcatgacaacaggtaaccatcttggtgttgtatgtaaccctgcctgttttcatgtctgacaaatgtgaaatgttctcaatcgacaaaaaccactgtgccacaccgacgggagatggttacttcttttcttcttcaaaatgtctgccatatgcaagtttacgaactgcacttacaagcttttttcccaaaatgttcatctttttaacctaagtttgttttatctggagaaagcacactatattaatatttgattcctgtcatcttcatcctgtgaatggcctcaatctgctctggaagatggcaaggggcttactaattcttcctttatttgaaagtagagcctatctattgtatcagttaatgttaacgatgccagataagtttcagtgtgacttcctttgaggagggagagagctctagcaagagtagaaaatccgtggggaaaaaaagcacaatttagaacgatagaagaaaccctattaaattagtctagaagttcccagtagcaaaaggaacccccgagtcctctccccacatcccgcgagtgagaacacgcagcagcatctctgtgggtagctcctgggaagggaagccacatccttggccagtgtctggcaccccagggtggagcaagactcagggagaggacccctgtcatgtggggccgtctctgtacccagcatctgctcagcccagcctggacagccagatgcaggaagcagaccctagaggtcagggaggaagctggggacagtttctctgtctacatccaccagcccaggagaaacccccagttctcggtatgtgactttcttgttctttccccctgaggggtcacctctatcagactctgcagccctcttcactgacccacctcttgctgccctaggaaacctggctgctctgctcatgaccattgtttccttgccgtgccgtgtccagggaggaggaagcacccgaacagcagcttctattctaatgttttgtacctgtatcttctcccccttttacctctctccttactgctatcttttacattaatcaaaggtgaacaccacaacgactgaatagaatagttccctaggtaagactccctgcctcttccagcagcatgggtgagtgagctggtcatgttctttcatcgttttgttgttgttgttgttttgtttttgttgttgttgtttttaacgaccttagaagaggccgatcaccttctgggaacaccttacatcttagtgtgtatttcacctgagaccacttgctcagagccatagtttacatctgaagccaggacgctggagcacttggcactccagacagctggttcagggggctcccgctggttgagtggccttgggcaggttacaaggcctctgtgcctcagttccctcatctatacagtggagacattagtagcatgagcctcagaggacatcgtgggaatgcagtgaggacaatttacctaacagacctggtgcttacctgccacatggtgtgcacaccgttggttcagctgcagtggatgcgagtttcccggcaggtgacttccagggtcctggcatcacacctctggtcagtggtttatctcacaaagttgagacggagtgatctgtctgtgggagttcaccactgcttgtgatttcactccgagtgtggttaatggtgacagtttactaatgaaaacatcacaagttaattctgttttccttcttattcctctgggtgccgttaacccctccttcctaatctcttcagtactttgatatttgatgtcaagattaattaccagaccagttagtccacctttccatagtgttgcccagctgtgttctagttgtgggcattcaagaaaagatgctattgcataccagaggaaatgacttccttgagtttagtgtctggacactaagcaatgacgatggttggctttccagaaatgtcacaaagtgagtcctcaataggaggttgtttgcgtgtatacatttgcccacttaaaaaataggtggtaagaatatgcatgaagatgagcttgaaaagtctgttggcccctgaaaagttaagtcactgagaataagagtcagacttcaggagcacagttaggcaaacattactgtgaattacagaaaatagtgtctctttttttttttttcaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaagtaagtttagtaaacaaataaggacaggaagctctttttaaaaaatattcctctattagaaaacattgcaaaacctttcattgtttctgtaatcatggaaaatctctcaaaatcataactttaattagtaacaataaggctgcatcccattcttccacaatgcttaacacacatatgcacacatacatacaataacataacatggtcataaatttcaagtctgtgtttaagaccatgtgattttgttgtatgctgtataaatagaagttcccaaactgccaggtaaagatggtaatttttattctagtcaccgtttctagaaagagctagtcatgtatccaaactccttttctttacaaagccattttttgtatgtggtctttctgttctgaagtcataaattggaagaaggaaaggttactcacatcctgatgacatatccattattgagtgacaagaactgtattaattaccctaaacatgtaaaataaatattccagttcaaacttatctttcccttgtggaaaatactagcctctgaaaatgatagactaaaatttaactatatacagctttaaatgttacttttgcaacttttttcctttcagtaacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaaggtatgagacgagattcttcaacaagccagtttctcaagaaaatgttaacagataaaaactaacctgtgttaatatcccttttcctttttttctttttatttttagacttggatgtggatctgataagagtctctataaaagcatggatttttttctttccaattaacttaattagaaaactttaatgaatgaaaaatgctgattgtaattaaccaagtaattagaatggagtgagaatattggattaaaattgtatcagtatttaaatttgggtaataaatatctctaaatcagaggtgtatgtgatcctccatatttctgaggaattctaatttgctaaatgtgtaattaaagtatttatttgcctgatatttcagaagcagataaacactagtgaaaagtgaaaccactattgtgatcatatttttttccatccttctttacatttgaggttagcacttttgttttttagtgttttgtatctacatcccttctcccaagcccttaggcattgtttattccaaatagaacgttttattacattactttccttgtttataaaagcaacaggcatactcactgtggaaaattgctaactatttttaaaatataagaacattaaaatcatccgtattcctgtaacccagaaatactcactatggatgttttaccatactttccatgggtttatttctgcatctgtctagatttattttggaaattttaaaaatatagaggaaaataacatggcaaacacccaagtatccatcacccagaattagcaaatgttagcattttgtcctatttgcttcagtgcatttttaatgatagaaataaatcatttcagttaaagtgaaaaccccatttccccaactcccttggagaccacttttgtgaattttgtttgtgttatgtccttcctactcaatttcatataatttttttttttttttttgagacagggtctcgctcttacacccaggctggagtgcagtggtgcaatcatggctcactgcagcctcgacctcctgggctcttaagcgatccttccacctcaaccttccaaggagctgggactacaggcatgtaccactatacctggctaatttttatattttttatagagatggggtttcaccatgttgcccaggctggtcttaaactcctgggctcaagcgatccacctgcctcagcctcccaaagtgctgagattacaggtgtgagccaccatacccagcctctcagcttcacatacttattttgtatgtgtattttgtatgtatggcataaacatatgcatttatatgcacagactgtattttaaatttataagctattgttagatgtgcttttcaataaatcaaatagatggtttactacctgtggggttttaactctttttctctcttagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacggtaaggggcgggggctccctgtggccacctccctgcacacaggattcatccatactgtttgccaacctcccttttccacaaccatttgaattttggccccatttcccactcaggtgttccacagtattctttgaaggactgaggttctaaacaggtgctgctgggacccccgtgaggggcagcagcaggacctagacacaggaggctccacgcttctaacattcctatccaagcgtctcagagtttaccacttatttttaacgtgggcttctgggttaaactgatgtttttaatgggctacaggccatgacatcttaaaactactggcttctcctcattagtagtagatgcaacttcagtggtcactttcatcattcagttaacattttaggtagttgatatgtgcattttaaaagtaatgcaaaccctgtcacaggcattgtgttctaagcacagagagcatccccagccattctgtgcctgggtgtgggttaggcttagaggagggctctgcaagcacacttctgtagtcagcaggcacctgggagatattcatctttcagaggcctgtatccagagcagattatagaaaacccatttcttcagatggtatcagttccagtagttctttgttttcatttttaaactaatgtttatttggaaaaaaaaagtaacataagcagatggcaaaaagcatacaatgataaagtttaaaacctccctcttcagagccctcctgtggcacccacagtgagtgggttttgactgtccatccagaagctgtcaaaattgatgcatacgcatgtgcacgtgcacatcttttcattgtttgtgtgccctttatgttgatttccttcagtgggtcttgtcaggcaacctcaagtacagggagctggattaatcacacattttgggccattgcccacagcccaggtgaccactgtgatgtgtttatttattatttgtccttccagtccacctccacacgtgcatatgtcaactttgtgtgtgtgtgatgtgggggaggggggtgtactcttgaaaaatacacaatagaattatttggagtatttgttgctaatttacagaaatgatactatgctgtaaatcctatctgattcttacattttcattcaacctatatttttggagctatttctgttgctctaaccaacagccagttcactactgacttttgcaaatcttccttcatagtcatgggccatttccttcatgatgggacacccatatttcttctaactcccttatacatgtagtcctgtatatccttcaacttatgcaaactccatcacaatattatagactttgctagagtttcttggggcatatattcaggagttatgcacatatataacttcacagaataatatcagattgcatcccagggcagtcacactagttgacacttacaccaatagtgcattaagttagcttctcccacattctgtaaactgatatcttcatagtttcaatttttatttctctttatcactaggaatgttgggcatctcttcaattacatattaactgttcatcttacaccttctttgagttgtctgttaatatcatttgttcatttgtcttttgaatctcatgcctttttcctcttgattttcagagttccttttacagttgatattgtaatccttagccctttgagaagatgcagtgtcttttgcaagtcctttcccctttgagtagtcttgcactctgttgaagatgatttgaacatatacacaagggtttattactgtgctgtctgttctattccatatgtctattctttatgccagtgtcatgctgttttgattactgtagctttgtaatatgttttgaaatgaggaagtttgaatcctccaactttattcttcttttttcaaaatccttttggctatccagggtctcctgatatttcataaagatttttggatgaagtttttcaaaaaatgccatcgttattttgatagggattatgttgactctatagattgctttggttaatatggacatcttaacaatattaagtcttctaactcatgaacatgcgatatatttccatttatttgtatcttcatttctttcagcagtgttttataatttttattttacaagccattcacccccttggttaggcttattactaagtaatttattcttttttgtgctattgaaaattgttttcttaattcccttttcagatcattcattgttagtgcatggaaatgcaactgatttttgtgtgttgattttgtatcctatgattttgctgaatgtgtttattatttaaacagttttatggaatctttagggttttctacatataaaattatgtcatctgcaaacagatataattttacttcttcctttccattttggatgccctttatttctttttcatgcctacttactgtggctagaacttctaatactgtgttaaatagaagtggcaaaagtggacatccttgcattgtacctgatcttagaggaacagttttcagtctttcaccgttgagtacagtattaactgtggtcttttcataaatgtcctttattacgttgagttagttttttttctattcctagtttgttgaatgtatttattattattaagaaagggtgttaaatcttgtcagatgctttttctgcatcaattgagatgatcatgtggcttttgcccttcattctgttaatgtaatgtattaattgattttcatatgttgaaccatccttgcattccaggagtatcataatgtataatccttttaatatgctattgaatttggtttgttgagaatttttgcatcagtagtcatcagagatactggtttgtagctttttttacccttcttcatgtctttggctttgatatcagggtactgctggcatcatagagtgagcttggaaatgttctctttagtttttttgggagtctcaggaggattggtggtaattattcttaaatgtttggtagaattctctagtgaaaacatttggtcctgggcttttttttttgagatggagtctcgctctgtcacccaggttagagtgcagtggcacaatcttggctcactgcagcctctgcctcctgggttcaagtgattctcctgcttcagcctcccgagtagctgggattacaggtgcctaccaccatgcccagctaatttttgtatttttagtagagatagagtttcaccatgttggtcaggctgatcttgaattcctgacctcaggtgattcacctgcctcggcctcccaaagtgctgggattacaggcatgagccactgcccccagccatgggcttttcttaattgggaaatttttgattactgacccaatattcttatccattaatagtttgaatgaattgtttttcatattcattattcctgctatcatttggttaccatctgcatggaatatatttttccatcctttcactttcggcctatgtatccttagatccaaaattagtctcttatagacagtacatagttgaattgttttttttttttaatccatttacccaatctgtatcttttgattggggagtttattcattgacatttaaagtaatcactgatagggaagacttactgttgccattttgctgttttctatatgcttgtagctttttgcttgtttttcccttattctcttactgccttcctttgtgtttctttcattattttttctaatgataggtgtattagtccatttccattttcattgctgataaagacatacctgagactgggcaatttacaaaagaaagaggtttaatggactaacagttccacctggctggggaggcctcacaatcatggcagaatgtgaaaggcacaattcacatggcagcagacaaaagagagctagcttgtgcagggaaactcccctttataaaatcatcacatctcatgatacttattcactatcacaagagtagcatggtaaagacctgcccctatgattcgattacctcccactgggtccctccgacaatacatgggaattgtgggagctacaattcaagatgggattttggtggggacatagctaaaccatatctataggattctcatttattttattttttccttttgtctccgtggggtacaaaatctcatttctttttgtgtatattctacaggtattttctttgtggttaccattgcaattacataagacatctttaaattatagcattctattttaacttaaacttcaattacatagtaaaactttacttctttacttccaccccttcacactttgttattgaagtcacaaattacatctttatatactgtatatccattaatatacattgtagttgtaatgtttttgtcatttaaattttatgcaccaaaattacaatagtattggttactgtatttgtccatgtgcctccctttacaggagaaccttatttttccatacagcttaatgttgctatttactgtctttctatttcaacttgaaggactcactttagcatttcttgtaaagcaggctagtggtaatgtactccctctacttttgtttatctggaaaagtcttaatttcttcttcatttttgaaggacagttttgccagatcaaatatgcttggttgacagggttgtttttttttttttttctttcagcacttaaaatatatcattccactcctttctggcttgcaaggtttctgctgagaaagccacaggtcttatgaatcctcccttgtatatgacaaatggcttttcacttgatgcttttaagattctctgtcttcactttagacagtttgattaaaatgtgtcttagtgtggttctccttggatttatctgtatttcatttctttgagcttgaacttgtatggtccatttttttccacagatttgggaaactgttagcaattatttcttcaaataagctcttagcccctttctctccctcttctccttctggtattcctagaatacttgtataagtctgcttgatagtgttccgtaagtcccttagtctcgcttcacttttcttcattcttttttctttttgctcctctgactcagtgatttcaaaaaaagacagtgacctgtcttcttttttccacctcatcaagtcttctgttgcatgcctttaatgatattttcagttcagttattgtatttttcagctccagaatgtttggctcatttttatactaatatctctttgttgatatgctcattttgttcttgctaagtttttcttattttgtttagttgtctatgttctcttctagctcattaggcatctttatgacagatattttaaattcttttttagacagctgatagatgtgcatttctttagggtcagtttctggaaatttacttttggtcctttggttgggctatgttttcctgtttcttgtatgccttgtttatttgtgtgctttgctaatatttgggcatttgaaaaaagaaccatctctcccagtctttgtgtactggctgtgtacagagaaagttcttcactaacaagctggctaaaaaatctaggacctcttatgctttttctgatttcctgcttctcctggtgtcttcctggaaaactgtagctctaatgtgctgcttgcctctgtttttagtggctcccaaactctggcaccagtctcatcaccgagtctgatgagactcaggcaagacagaaaccagccctttgggcagactccagacagccagaacatcagactaatgatccactcttttgtttccatcccaagagaagagccccagtatggaggcttcctcccacttagggggcaccttgctatttagggaaaggggaacaaacaggcatgccaaacatcgtgaaatttcctatccctttcattggaatctcttcctagttttacaatggactggatactgtagcttctcagttggtctccagagttctcacagagccattctggtctgtatattgttgttaactcagggtctctatgggggaaagagggcctgtagcttcctagactgccatcttgttgaagtcgtagtccaaacaccattgattttttaatgttaaccttatggccagcaacttaactcacttcttattctatttatactttcctggttgttcttgaatgtaccaagtcacagtctgtagatattgactgttctatatcttcttttgttataccagtgttatttttctttattcctgctgtccaggaccttggatgatatgttacagcactgtccatgttttcttcctgaatctgagagagattgtgactgaagtttctccatgatgtacagtttttcctacagggttttagtaggtagccttcatcatgctaggaaaattctgttctattcctattgtcttagagcctttttattatcatatattggtgttactttatcaaatgttttatgtgtgtctatttttaataatggtaaataattaatagatttcctgatgttgaccacctttttgcaattttgacataaaccttactttattatagtcactcattgttttaacatactgtttgatttggatgactaatattttacttaggatttttgtttataagttaaataggcctatactttttctaaactttttaattgttcttatctgattttggaatccaggttaatatagcctcataaagtgtgtttgtcttcttgttctactttctgaagtctcttctgtgagacagcagtgtatagaacccaagagtgaaaacatccagtccattatatatatatatatatttttttttttttgtagttatcttcatggtcatcctcatcattttggcaggagaccagtctagttgtaatttcaggtccttttctggttactagtttcttaaatttttgtttcttctagaacaaatttttagccttcatattattctagaaatttatctagaatttgaaggtttgaggcttctttgaaataagccagtcgattgtggcattcaggcagagaaggtggatctataattagagaatagagtagtggtagtaagagaatgagagctaaaaaagagtcagctaatgcagtcagaaagaagaatgctagaattttactatagtagagctacaataatttctgtggttatggtttcaaagagaaggtatgggaaggagtaaccaaataaggtggacatttgaaaattatgatgtattgtattttacaaagatagccccaccccaatgcctctcatctaaaatcctctccaacaatgtgaccttgccactgtaccattaagaggtgacgtctctgtcccatgcccctgaatctgagcctgtcatgtggctgctttgaataagagaatgtggtggaagtaatgcagtgctagttctggcatagccttaattggcctgacaacttccatttcttgcctcttggtggcagccaccatgtgagagttgtgactaccttgagaccaccgggctataagaagctgcccctccgtgtagagaggccctggaagatgagatgccacttgaagacagagagagggcaaggaacagtgaagcaccaaatgtgtaagaaaagagttcacctggaaaatggaagagagaagacaaaattaccaatatcggaatgggagaggtgaaattaccacagatgctacagatactaaaaggattgtgaagagaaattataaacaaggctatgccaattgacaatttagatgaaatggacatatttcctgaaagacacatactaccaaagctcacttaagaagaagtagataacttgggctatctatatgtattagagaaaatgaatttgtaatttaaagcctttcccaccaaaaatgacaacaaaagaaaaaccccaagctcagatggcttcactattgaattccaaacatttaaggaagaaatacccattttgcacaaaatattccaaaattgaagtgaaagagatacttcccaactcattctgtgaggccagcatttccctggttccaaaaccagatgaagacaccacaagaaaataaaactacatgttaaaatgtgtcatgaacatagatccaaaagttctagcaaaactttagcaaaccaaatacagcatcatgaccaagtaggggctatcccaggaattccaagctaaatgaaacatttgaaaaatcaatataattcaccatattaacaaactaaaaaagacacagaaaaggcattttgcaaaatccaacatgtgttcctcataaaaactcatagcaaaatagaaatagaaggaaaccttctcaacctgataaaggaaatctatgaaaaatctacaggtaatgtcattcttaacagggaaggactgaatgtgtttgcctaagatcaggaacaaaacaagattgtctgctctccccacttctgttcaacattgtattggaagttctagccagtgctataaggtcctaagaaatcagtggtatccatattgaaaaggaaaaagtaaaactgtctttatttgcagacatacttatctatgtaggaaatgagatggatattatacaaaactatgagaatgaatgaatgattttagcattgtggcaaaatataagatccaaaatgtaaaatacaaaatcagttatattttttacacctgcaacaagcagttgaaattgaaatgtgtaaagcaatacactgaaagctgtatattgaaaactgtaacacattgcctagagaaattaaagaactaaataaatggagagatacatcatggtcactggttggaaaactcattattgtcaagataccagttttcaccagattgatctatagactcaatgcaatcctaatcaaaatctcaacaggattttttggagaaattgacaaactgattccaaaatccatatggaaatgcaaaggacatagaataggtaaaacaactttcaaaaggaagaacaaagtaaaaggctaatactacctgatttcaagatagtaattaagaaagtatgattttggcataaagataagtatacaaacaagtgattccttattatttagagtggttttaggtttataggaaaattgagtggtagatacagaatttcccatatacccagtgccctcacgtatgcacagcctccccatcatcagcatctcccactctagtgctatattcattacaatcgaagacacatcatcatcacccaaagcccacagtttacaatggcgctcactcttgatgctgcacattgtctggctttggacaaatgtataatgacctgtatccaccatcacagtgtgagaccagagtagtttcactgccctaaaaatcctctgtactctgcctgttcaccccctctcacctcctaacctctactctgcctgttcacccctctcacctcttaacctctgtattctgcctgttcacccctctcacctcctaacctctgtactctgcctgttcacccctctcacctcctaacctctgtactctgcctgttcacccctctcacctcctaacctctggcaacagctaatcttcttaatgtctttgtagttttgccttttccagaatgtgatctagttggaatcatacagtatgtagccttttcagattggctttttacacatagtaatttacattcaagattctttgatgccttttcatggcttgatagctcattttttttaagtgctaaataatagtttggatgtgccacagtttattcattcacttcctgaaggttcattgcttccacgctttggcaattacaaataaagcagctataaatatctgtgtgcaggtttttttgtggacatgagttttcaagtcctttgggtaagtaccaaggagcacgaatgctgggtagtatggtgaggatatgttgagttttgtcagaaactgccaaactgtccttcaaagtggctgcactgttttgcattcccaccaacaatgaatgttgtcccacattgtcaccagtattcagtgttgtcagcagttctggttttgggccattctaatacacatgtagtagtatctcgttttaatttgcagattcctaatgacatatgatgtggagcatcttttcatgtgtttatttgccatctgtatatcttcttgaatgacgtgtctgttaaatttttttggccaatttttaatcaggttgttcattttcttattgttgagtttagagagttttttgtatatttggaagagttcttcatagatttatcagatatgtcttttgcaaatattttctcctagtctgtggcttgtcttttcactcccttgtctttcacagagtagaactttttaattttaataaagtctagcaaatcagttatttctgtcatagattgtgcctttgatgttacatctgaaaagtcatcaccaaacccaagatcatctagattttcttctgtgttatcttctaggaattttatagttttgcattttacatttaggttgtgacctactttgagttaatttttgtgaagggtgtaaaacctatgcctagattctttttttttttttctgcatgtttatgtccattggttctagcactgtttgtagaaaatactaccttttgtccatttcattgtctttgctcttttgtcaaagatcagttgactgtatttatgtaggtctgtttctagactttttattctgtcccattgatctatttgtgtattctttcaccaataccatgctgtcctgattactctagtatagtaagtctttaagtcaggtaatgttagtattacagcttcattatattccttcaatactgtgtttgctcttctggatttccctttttatatcagccttaggaacagttcatcaatatctacaaaataacttgttgaaatattgattgggattgtgttgaatctctatgtcaagttggacagaaccaacgctgagtcttcctagccataaatatggaatatccatttatttagttctttgatttctttctttggaattttatagttttacttatacagatcttgtacatactttgtcaaatttatacctaaatatttcagttttgggggtgttagtgtaaatgatgttgtgtttttaatttccaattctgctgttcattgctggtcacagttaatttttgaccaaggcacaaaggcaattcagtggagaaagaatagtcttttcaacagtgatgctgaaataagtggatatccctgtgcagaaaaaaaaaaagcaaaaaaaatcaagcaaccaaacaaatggacttcacttatattttgcaccttatacaaaatgaatttgtaatgggccatagacctaaatgcataaaaattctggaaacaggagataatgtttgtgacattgagttaggcaagtttttagctacactaaaaaagactttccataaaaggaaaaaaactgtcaaagtttaaaaattacttctttcaaaaagcactgtttaaacagtgagaaataaactgacaaacagggagaaaatgtttgcaaatcatatatctaataaacgattggtatccacaatccactgttactctcaaaacgcaacaaggggaaaatagtttttaaaatgggcaaaatgtttgaatggacacttcaccaaaaaaagatacacaaatgtgaaataagcacatgaaaagctggtcaacaccattagtcactgatgaaatgcaaaggagatgccacaacacatctcttggagtggctgaaattaaaaagactggccaaaccaaatgttgacagtgatatggaggaactggtactgtcatccactgtggctaggtatgtaaatagaacaatcacttttaaagacagtttgacacagccaggcacggtggctcatgcttttaattccagcactttgggccaaggcagatggatcgcttgaggtcaggagttcgaaaccagcctggccaacatgacgaaaccccatctctactaaaaatacaagtattagccaggcatggaatcccgtctactctggaggttgaggcagaagaatcactcaaacccaggaggcggaggttgcagtgagctgagattgcgccactgcactccagcttgggcatcagaataagactcaaaacaaaacaaagagagtttgacagttccttaaaaagttacagatatggccaggcgtggtggctcacgcctgtaatcccaactctttgggaggccgaggcgggtggatcacaaggtcaggagttcaaaaccagcctggccagtatggtgaaaccctgtctctactaaaaatacaaaaattagccgggcatggtggcacacacctgtagtcccagctactcaggaggctgaggcaggagtatcgcttaaacctgggaggtagaggttgtggtgagctgagatcacgccactgcgctccagcctggggaacagagcaagactctgtctcaaaaaaaaaaaaaaaaagttacagatatgcctgccatgtagcctagccatttcactcctagtggtttaccaaagagaaatgaaagcgtatgtccacgcagacttgtaaatgaatgtttgtaggactttctttgtaatagacaaaatagtcaaaaactggaagcaatccacgcagccatcaaccggtaaatagatagaacagacggtggcatatccatgcagtggagtactactgggtgaaaaaaagaacagtgatacacactacagcatagagaaatctcaaaataattacgcagagtgaaagaagccagatgaaaaagaggaattaccatacagtcccatttgtatatatctcgggagaatgcagactaagctgcagtggcagaaagcaggtcagttattgcctagtggggacagaacgagatgtaaggagacaggaggtttggggagtgaggtcacatgggtacatacaaatgtcaaaacttaccacagtgtccctttaagcgtgtgcagtttattgtatgtcagttgtaccgcagtaactccaggggaagaaatcacatgagaaaatgcttatataagtaaatgacagaaagcaccacaactatatgaattagaaaaattcaaataagttagaaggatgcaaacagtaaagttaagagcagaaattagttttgtaagcaacaaagatgtagcagtgagcagtaacaaagcctctaagatgtcagtacttagagcaggcaggttgattaaagtcaacagaaccggtgaggctgatcaagaagacagaaggcactaccaaaacgtatctggaatgaaaacacggatatccttcagggtccagcagagattgctacagtggagagtcctagacacttcagcactgataggttttaaaactgagacaaaatagaacattttctagaaaagtgtacattgctaaaagtgacttaagcatatgcagaaaattggaatagaactctgcctattaaatcacacacacacacacacacacacatacacacacacacagagaataaattaagaaaatagaaggaaggagagtctgtggagagaggggaagtggttggcccagacaacattgagtgagttctagacatcgtttgtgggatgatgatccccattttatgtaatattttccaaggatagaaaagtagggaagaattctgcagctcattgtgtggctcataactcaaaggttactacaacctttatctccacaccagacaaggacagtaaaggaaaacaaaacaacaacatgtcatggaaatacacatttatacacttacattatctttaaaaatttagcaagccaaattctattttatattttttaaagcttcattaattcctcttaaatctatcatttcaatgtgattttaataaaaatcttattttttcatagtacttaaaagttgaatcccaacatggcaatagaaaactaacaatataaaaccatagtaatcaaaagtgagtggtaattttcggcagaacagtggcacaacatacaatctgaaaagacctgcagacccatggggcagcactggtgatcaggcctgcctgtgtttaaaagaaaatgtaaactagatggaggcttgtctctctcacagaaaattaagtccaaaaataggtggcccagagaagctctggtggctccatggtctggagcctgatccctctttgtcccgcaccatctaagaggtctcttctgagttcagggtcttcataatccctagagctgacgaaatccctgagtacccagtctgaattccaggcacagggacacttcagccagctcagctcatcatccagagctcaggcacagggctccactcgctatggggcagctggggtggccgggcttacacactcagccacctggaagaggactggggctctgtcatgcaggaggaagggaagaaaggcagggctgcagccagcagtctgtgctagacgtggtgctcgcagaagacatggacaaagtagccaacgaccagtcctggagaaacaggctgtctgtgcagagaagcagcccaccatacactatccaaagcacatgctaggacagttaaggacctgagtatgcagagcagtgcctggcagttgcagggttcttcagtaaggcacagaaaaccccaattataaagaaaagtgaataaatttgactaaattaaaatttcaggaattatttactataacccacatatttggaaaagaaaagccacatattgggaagagatttctgatgtctcatgtgaccaacaaaggattcgacttggttacaggctgactcctgcacctgcatagcacagagccatccatttggaggatccttgctggggcgtggggatgtcacacacataaatgcaggagtcggggctcatggacctgaacccttcagatccaagccttttattatatagtaattagactttacctcaaggaagaaacaaacacaagctgatagaacctagcatgggtgggccaagaaatagcaaatggccagaaaagttgcccggaaagagccctggtggccaaaatgatgccagttggctgcagctgtgtccctgctctgggagagttgagagtggggagcagccaccttggagggccaggtggatggggctgggtgaggctgaactgttccccttacacaggacacagtgacaggcagagggcccagggccatggtaggttgggggtggggtgggagccacagcactgccattggaggtcaccagggtgtccatcccactggcaggcagtttggcggtgaatgcagccccagagagttgtccacaagaccatggggtgagaggctcccatggggttggccaccccacggtgattatgttggcgcgggagccgtgggaaggaacgagagtcttggttcagatgacctcggcctgtgtcctcagctgcacagagctgtgggaacaaacaagaccatccagaggaggaccagcagcctgtctattcagagtcggctatggcaagggggccagagcactgtgttgggcagactcaaaggcacgcacaggaagggggatggctttattgtagggaaagggggaggctttgggtatgttctgatggaggtaggggaagccaagatgggctctgcagaaggtggcctcccgtgcagctgcttgaagaacccaggggcatctctggctggtcctgggttgaaagcaggaaggaatgggcgtggggcaaccactaggaagctgtagtccttcctgaaagcctggctgactgggccgagtgctgtggaggctgtggtttgggtcagagtagttctcctgccctgtgtggtctggccgacgtctgtctgcagctcagtctctcaggccgggccctttactgaatcaggggacagatcagatgatagcagtctggactctgttcctaaagaaatggcacaaggaaaatgaaagacgaagaaggccaggcacagatgcctagacccgggtgcactgagccgaggccatgctgtgagagtggggacacctgtaggttccttgggtgtcagccaaacacacttcatggcacgctgtgagtgggcacctcccatggggtccgcaggacaggtggctgtggacatgtagtgggtatctctaggagacgtcctgcctgcagtcttggcagagctttacttgttttatttgcatggacgctgactgtgtctgacaccctctcgctggcgctaggcgatttcatcctgatgaagtttgtcccagctgtcctttgtgaggtgcattagtggaagctggtgccacaccatttcccacccagggcctctgcagagctgtagacactcttggaattctctttcaaagcatacgttcagaattaatgactcctaacaaatgaaggtttctgcaggatcactgctttaaagtttgcccagaagacctaattcagcttaaagatgctgagtccatagaggcttctaatctgtagaagaaaggggcctgtgtttcttagaggtattgaatcatttcatgctttttctgtaagttagggaaaccttcattttcatttccattttggaaggtggaaggaatgtgtcataggaattggaggatttgtccattcgacacatatttattgatcttctgtatgtgccaggtacatattgtaagtgctgggataggtcagtaaagaaagcagacagaaacctcttcctgcactggggtaggatgggagcagagagtccaacatggatctgtaaattatgtggaagtcagaatggggttggagggcttgggcggcagggaagggagacctcaggcagcaggtaagcaaaaggcttgagtggctgggaagggaggcctccctcagaacggcttttgtacagggacctaaagtgggggcagccatggctgcctctgggattggtgttccagctggtggacctgtggacagaagctttgggcaagcagcaaggaggtccctgagggtggccagaagcttggggacaggtgcagggtgagaggtgacagggctgggggatctggccggaggactgctggcattttcttgggagccactggactgttttgtgccagggaatggcctgtgctggcccacgtgttcacaggggtcaagaggagagggcttggggcaggcaccgggttccccttaggagagggcgtcatgacacaggcaggggggcatgacttgacccatggcgtagcagtggcagtggccagaagtcaggtcctatatctcttccaaaagtggatcccaggtgatctgctgatgactgctgtgacagggatgagcagggtgagggtgaccccagagtggggactgagcagctggaggtcagtgctggggcatatccagaatgaggcgtaaacaggtgaggttggcggctgtttgtcatgtgctgcctaccccacttgccagctctgccctgctaggctcttgagggggcatggagtggccctgagacttcaggcctccaaatacaactgtgggcattgtcaggcagaggctgtgccacggagtgagtgacagaggggggatatatggaggctggttccagtctgggcgtcagcctcctccagtctcaagtcctgccacatccgcagatctaagcccgaatgtttctcatctgccctggcctccctgtccccacactgcccagtcgaccttcatttctgacctgtactgctgagcgtcttcccctgcagcgtgtgctgagcatcttcccctgcagtgcgtgccacactgtgctgagcgtctaaccctgcagcgcgtgccacactgtgctgagcatcttcccctgcagcctgtgccacactgtgctgagcgtcttcccctgcagcctgtgccacactgtgctgagcgtcttcccctgaagcgcatgccacactgtgctgagcgtctaaccctgcagcgcgtgccacactgtgctgagcatcttcccttgcagcctgtgccacactgtgctgagcgtcttcccctgcagcgtgtgccacactgctgagcgtgtaaccctgcagcgcgtgccacactgctgacgccacttcgtaaaatgcgcatgcgccagcccctcccctgagacactccatgaaattagattgggccactccagaggcctctctctgccatctgaataccgccccctccctcatcaagctcctggctgcttaggggcccctgccctgcccctctgccctggctgcccttgctgctgtcctgtgtcccctgccccccaggctgggacatgcgttcctccctcagcctcacagccccctcctttggggctaagcttcagggtcaccccaggagcattccttcaagtacatacacccctttttctttttcacagaaccccgccctttctcccaaattgattttacctcaatttatagttcttcatttgtctttttattgcattattgtttagctcctgagctgtatctccccccaggtacttcacaccctgtgtatgtagcgcccagcaaagggtgctccagacacagcaactcccaggctgagcagagcatctctgctctttgtggggctcagaaagagagaacaggcatattgtgaaggcatgtgtgtgttggagctgataatgaatacctaagttgccattggcatgcatcattggtgtcatgcatgtcagctgcacacgtgcagtcgctgtaaatccccacaccctacctgcctgtgcattcagtgccattgtcacttgcagagaacaggaaataagcagtttaatgttttgaaggacctcttgaagagctgtccttttttaagaagtatagtggtccccgcttctccgtagatgtgtctcaagacccccagtagactcctgaaactgtagatagtactgaaccctgtacgtgctggtatttttcctgtaagtaccttcctatataaagtttaatttatgattagacacagtaagaaattaacagtcactaataataaaataagagtgacttgaacacaagcacagtgatgctgtggccatcaatcttatcaccaaggcgactgctaatgggccagcggcatctgcaacgtggatggttcacatcccgggctggacagcacaagatcgcaccacactcctcagaacggcatacagttgaaagtctggaagtgtttatttctggaatttttcatttaatatcttcagatcacggttgacagtgagtaactgaaacctctgaaagtgaaacctcagataaggggacctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgcactccttcgtcagttggttgggatcctgcggaattgccagtgcatccctgtaaccacgcaggcttgggctgggctgcgtcgacactgagtccgagctccctgaagactgtgctttcttctccctccagctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcaagtatctctagagtgtgctgatttaatctctgtcttgattttgcaatgttttcatcctcatgaatgaaaaaaacaccacctgagctgctctgtggctatcaaaagaacatcagagtccttctaaagagacccaaggtgatgtttctgaggctctccgggccttgtctctagggccttttaagtgagtctctctgtaagattaatctcctttaccaatcacaaacctagccattcatagaagaattgatgggttcacacctgtcatcccaacactttgggaggccaaggcctagtggattgcttgagcccagaagttcaagaccagcctgagaaaaatggcaaaaccccatctctacaaaaaatacaaaaaaatcagccagatgaggtggggcatgcctgtggtcccagctacttgggaggctgaggtgggaggatcacctgagcccaggaggtcaaggttgcagtgagccaagattgtaccactgcactccagcctggacaacagagtgagaccctgtctttaaaagaaagaaagaaagaaagaaagaaatgaaaaatgaaaagaatgaaattatgactgggctgggcacctgtctgttttcctctcactcaggcactgtattcattcctgtctcagcagcagagactcaacagacactgaaaattatgtcagcattggctttcccagactaaccctgagccaggtctccgggacgtttacgctgtcttagagccaccagggtgtccacagcggtgagctgcctagagcctgccctgggctccctggagaggccctgttggctccgagagatggtgacaggtggaaccaggggtgccaatggcaggcagaggctgtctccctggtgtctgcacctaccctcgattcccttcattgctggttttcttttttctttttttagaatttcagtggctaacagtaaagtgaacaggagcttttgaattcaaaggtcctaacttctaagctcacctttatttaaaaggacacagttaaggtatttttatctttttaaacatataatttcactacttttttaaaagctcaaaactaaaaccataatcctaacctgaaacacgtttattttggggtgtgtgtgtgcttgtgtttgtgctgccttgttttctagtgcctggcaactagcacgcctttaatttgagaaaaagcagtgtggaattttatttgaaagcatgcctgtcagagcacatgaaggaggcagggatggggaaaaacagttgtctttaattaaattttacagttccgtaacttaaccattgtgttttaagaaaaacaaaatagataaaacttgatggtaggtaggttgaaattgtagcatcaatgtcttttgaagtattttgttgtgtattggtgtgtgaatttctcatgattcagaaaatttccctctttgctctctgtcttctgtacttgagcaaagagtgctttaattttagctgtcactcatcttttatatgcatagatacttaaaacattgcatgtggaatatgggacacataggtgatactcaaaaatagttgttaattagggccttgttgaatagcgctgtctaagcaatatctcatccgtaactaaaatctgcaaagacagaatcattttgctaaagaaattttctaagatattgaaagtagagctcatttataaaagtcagtgtatttttatcatatttcacttatgtgaaaagcatctatatctgttaaaagaccttgaaagatagtgtctgcaagatagagacttcaaagttactgatgctgctgtttatcctttcctcctcaatatcttctctggtctttttttttttttttttttttttttttttttgagacagagtcttgctctattgcccaggctggagtgcagtggcgtgatcttggctcactgcagcctccacttcccaggttcaagcaattgtcctgcctcagcctcccaagtagctgggattacaggcgtgtgccaccacagccagctaatttttgtatttttagtagagacggggtttcaccatgttgaccaggctggtcttgaattcctgacctcaggtgatctgtccacctcagcctctcaaagtgctaggattacaggcgtgagccaccgtgcctggcctccgttatctctaatcttgatagcctaaagcacattaccaaacccctcccctggtccccgctgcagggggctgtgccgagctgattcagcagcagcagagagagcctgggttggagccatgaggctgcccctgcgtcagctctgcctccttggaagcttctgtgtctcgggttcttcatacgcccagtggcagggatggaccaggcaccccttgcaatccttctggacaaatgtgccactgtcctatgaaaataaaaggacaccactcaagctccaggaggcagaaccttaactcaaatctgagccaataaacaatgtcactctagcaccaaagtctatttcaaaatgcaaactatttgaaatatcttatttttggtaaatgctttattttggaaatgggtttttgttgttgtttccctgaagagagttcagatcagcaaagcaagtagctttggagaagacacctttagacgaggactcctgtgaatcagcaggacagcgtagcaggacattaggtgagccacagggtggagcaggatgggagggcagaggcttctgcttcagaattgaagccgaaggcaagtaatgctgtgggtgttactggagacaaaaggaaccaaacaagaaaaatctggagaggcaaatgttgatgtcttaatagatttgggaggtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcgcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctctcgagctttctcagactttctctcaaatgagtttcacatccagcacttgcaagtttcaggacaattccagcttcttatttatgtccattgatctcctgagtgtgagctcctcagctggcccagtttgttgtccaacgctcactaagataaaccaagaagaaggagcagggtgcccaaatgccgcatgcgatggctctggggaccttgttgacagacagcctgctccggggtttgcagacaaggcttcctatcctgctggttttcatgttgaatgttggcacgaaacgttaacaaacaaggctacatgatggggtagggtccttgtgaagagcttgcatttaggtatctctgggaggacagcacagggacccaagggggctggcagcaggcccaggtgtgtggcaggaagaaggcaggtgcctgctgagctgctatccacccgagaccatttgacattatgggcaggaagagcaagggaagctggtttaatgaggccctggctggagtgagagagaaggaacatcactgtgagagtgtggaaagtgtgtgtgtgtatgtgtgcgtgtgtgtgtgtgtgagtgcatgtgagtgtgtgcatgagtgcgtgtgtgtatgagtgtgtgtgcatgtgtgtgtgcacgctcacatgagtgtatgagagagagagtgtgtgtgtgtgtgtatgcgtattctccaggtaagagcaggcaccggggttgtgggaaagaggtgtcagtaatgtgagtttcctccttgccctggtttctaggaggagtgaacgtgccatgagtcattgtagaagagaacgaccaccaagcttggctccaagtacagaatcattcttttcatctgacaatttttctttccattttactttctgttttcctcccctttgcttttgctggaccgattaaattgtctttcccctttcttccgactggtgggaagttctaaatcttatttctattctgaccagtggttaccccaattttttaaaacaaatatgtttaaatcactttgaaaaaatgttggcatcaagaattaatatttgtaaagatccaaacttgggaaaagctgaaatattgggctcatttttattccacactcttcccatcctcatcttcctagattctgatgacatcatcttgagttttagaaactcattttatcgtgctttttttttaaaagcctttcgtaatgagtcacatagcctcatgatcaacaattgtttagatgaagccgtaagagctcctggtttctcttctaaccagttttctgtagccagtgctcctgcccttaactccacatccagatttatttttcactttgctggaatatatccttaattggggtgacagggtgatttcttggttggttgtttttgtttggtttttggagaaaagtcctgtgtgggtggggccctggatcttgatgttacctggcccttgcctgtgtgccaggtggactggggactgtggatgtctgggctctgccctaccccaaggacacgtcaagacctccatgccacccctccatggtcaccctttgtcacagagccagtttgagtttctttcctttctagaaggtacctccttgttttctctcctgtagcgttacatttatctattttccctaaaattcaggaatttcaacagattaagcctaggtgtgtggttagtttgtttgagtttctttcctacttactaccctgaaccctctgatctggattgttgagtcttcacttctgagaagtttccttctgtcctgtcacttctgctagaagcatcttctctgccctctctgttgtccctgaaaatgctgctgagcagaactcacaggcctgtgaccagtgtctctcctctcatctgatgtgcttttttgactgtactgcattctaagagaatgcctgacttctgtcaccatctcaggagtgaactgttttccccgcggagcaggctccccgggagctcatgcctggcccacttccctgcaccacggccgccacacggctccgtctcttgctctagttctcctttctgggagagtgactccatttggggctcgtcatctctgttgggttttcagtggctgcatttggggttcctcatgtctgttgggttttcagttctccttttgcatactgagagaacaactttctagtgattggaactgtctagaaaagtttcctgaaaggaattgagctcccctgactggaagagttcaggttggaattggatggacactgttgttacggacacggtgataggggatctggctgaaaggattaacccacgtgatctccaggtgtcttctaaactcgagatcctacggagtgcagtttgcttgtttttaaattctctgtgcagatgactgtaatgctacagtacagttaccattacctattgtatcaatgacacttttgaaggtttttaaaaataataatagttacacttcactgactgccgtcctcaggccatctcccgggcatgcatgtgctcaagtcaggagccagattcttacatgcttccctgaatccacgccgcagccctgtgggccgggcctgccgtcacccttcacagtggaagcagccgcagccggcagacaccacgaggcttgcagctcacagccatattccactgtccctaggacaagtacagcttgaacccacatcccacctttcaccaccccaagccttgcctcccatggacgaagacagtgcacgagagtgccttggggctcccccaggagctgcttcaggaaaaggaggagctggcaggatcactgtgagcctctcagccccactcccccggctgctccccttcatctacatccagttagcatctcctgcccatgcagctctctggacatgagcccacctcactcaggaccacagctctgaggctccttccacagctggtgttctaaaaccctgaggtctcctttgagaaaggactgttatgtggccagaggtcctctgtgtaaagccctcagcacctggctggggttagtggacaaccaggacaaggcacttccgagctggcagagaaagcctgagagcagccctggggagtgggctggaagggtcaggagaacccagccatcttgctctgtacggattctaatggcttgtgtttatttctctgtcagctcaagggctgcccttaagacgatcacaatgaaaggctcaaaggtgctctgctctcagcttaaatggcaggttggttttggacccagaggggctcagaggctccctcctgtgttgcatggcctgtatcatcctcactgggggtgctgtgcacagttttccttatactgtaacttatgcccaggtcttgactctttcttatttgcagaataaaggccactttcagtcgagattgtaagtacacattttccttgatccactaatgaatgtctgatagtttctataacatgaacccataataaccctaaaatatccattaatcattatgtatattattcatttttgattaccctactgtatgaggaacctattggaaaatacctttagggtagaaataagaaaaaacatcaatgccagctcttctgagttttttaattgtagcagttattaggccaattcacagtttctctgtgtttttgctttaaaagttctgattcagcacacttaatttacaacaacagagggattctcgttaccagccaagttgttcttgcttttattggtttctgtaccgcggcctgggattaactcattaccctagttccctctttgcaggctggaaagataagcatctcactcacgtcagcccccacactgcactggcctcagggactcgtagacgtatgcgcttatgaccatttaggggctttctgccccagaaaaagcgtatggttagtattggaagctcgggctattttcttttttccttgtttcctccatttttgtttcaagatgggacttgatttaacttaaaatataaaaaatattttgtactattgggatcttatatttttgttaatcatttagttttagtgaaaaatattgtaattctaaggtttaagtatcattcaacagtaatcctttattttgatgagaagtagtggaattgcaaaggaagataatataagcgttatccatttgtttatgaaagattcaattccattatggtcagagattccccagcagtttaaatggacaccctctcttctagccattcccccacaaaagaaatccttcctgattctgtctgcttgaagggtgtgaccttgaacatgctcctggggctgccgcctctacagagtgacagctcagggacctgcaggaactcagaacatgcaggcaggtgctggaggtagggcaggtgtgctggtaagatggatgacctcagttccactggcaaaactgtgccacaggagaaacctgagcgtgtggtaaaaaccaccccagcagcaatcagtaaatgcaggaacagtgacctcaggaagacatgaggctcctaccagtgcctgtgatgaggccagcccagccctgtgtgtggttagggcacacctgaccaccccgacaaccagggaaggacggtgttggagctctgagttcttggcatgaggacatgatcttggctgattgttttccttcagaccttctgcagaattgaatgcacatcaaagaaacaagcagaagaaaccatgccagctacttgtattgaataaaagtattttacttacaaacttggattatcaaacttatgaggaaaataacacaaaagagaaagatctatatgagaaaacagaacaactgaaagaaacaatttagaaaacaagagaaataagtaatgataaatcttattagtatgttatttagtaagtgctgaaatcaaatattaatttgaaggtctagaaaatattcagtattttttgagtgtgcagtgggcatggttctgggtgttgggattttgcagtgcacaggacaaacaaaacctcttcctcatggagcttttgctctgatgagggcagggggatggtgaagtcagataagtctcagataacttggaacagaaaggcagaattatgagacagtggccagggtgctgcccaaaacctacccaatcagaatctcagaggtaggattcaatgtgcttattgtttaaagcttcatatctgattctactgaacatatctgcttaagaactacaaaatatatattggctgtctctgggttttatagctttaattttctaaggtttgtgtgaatttttggaattgtccatagtgagcaaatgttatttttttaatgagaacaattttttttatttttaaattatctttagtgtcttttcacaactttattgaggtataattggcatatgataaactgcatatttaaagtatacaatttgatacattttggcctatgtttaggtctgtgcaaccatcaccacaataaagataatgagtatacttaatccacttcaaaattgtcttagtactccttcataatccctccctctccccgatccccattcccatccccagtatgtaccatctgtctatatagatgagtttgcattttctgggattttacataaatgtcatcataaggtttgcaccgttttggtctagcttatttcactcagtttaatcacttggagattgatctatgttgttgggtttatccatagttcattccttttcattgctaagtagcattgcactgggtggataaaccacaatttgtttttcccttgaaatattgatggatatttaggttgtctccagtcttttaatattataaagctgctgagaacatttctgtacaaatctttgggcgcttacttccatttctctttagtagatacctaggagtggaatggctgaatcctaagataggtgtatgttgaactttttagaaaactattaacctgttttccaaaatggttgtaccattttcacattaccaccactagtgtgcgggagttgtagttctgtcacttatatgccggcacgcagtacgagcggttgctttagaaattttagcaggtgtttagtgatattccattgtgcttttaatttgcattgctctgatgactaatgaagttgaatgccctttcacatgctgatttgccatccctgtgccttcttcaataaactgttcaaaacttatgcacatttttactgagttgtttaacatcttattactgggttttgagagttatttatattttctagatacagatcctttatcagatatatgatttgaaaaatgctttctcccaatcagtggcttgtcttttaattctcttcatagtgtcttacgcaaaccacataattttaattttgacaaaatctaatttatagaaattttctttgatggatcatgcttttgatattatgtctaagaaatatttgcctaagtcagtactacaaagatttcttcttatattcttggaaattttacagttgcagtttttacatttaagactatatttcacttgagttcatgtttgtgtagggtatgaaggatgaactgaagttcattttttggcatgtaagatatccagttgatttagcaccatttagtgaaaggttcctcatttcttcatggaattgccttgtgcccttgtcaaaaatcagctggcatgtatatatacatgtgggtctgtttctggactctgttgtttgcctttaatctctttgtctaaaggccagtattacattgtcatgattactatagttttattataagttttgaggtcaggtagagttagtcttccaactttgtactttttcaaagttgtcttggctgcttaggtcctttttgtatttccatagcaattttatagtccactcatcagttctacatccttattgcactggttaggacctccagtacaatgttgagtagaagtgatgacagcagacatccttctcttacatgtcatcttgggggaacacattcagtctttcaccattaggtatgatgttggctgtaggattttttattgttgttttttgttttagagacaaggtctcactctttcacccaggctggagtgcagtaacgtgatcatagctcattgtaacctgaaactcctgggcccaagtgatcctcctgtctcagcctcctgagtagctgggactacaggtgcatgccaccatgcctggttcatttttaaattttttatagagacaatgtcttcctatgttgcccagattggtcttgaactcctggcctcaagcaacccgcctgcctcagtctcccaaagtgctgagattataggaatgatccaccatatctggctgctgtaggttttttacagatgtctttatcagctcaagacattttttttttctatttatagcttactcagcgtttttaatcaagaatgtgtgctggattttgtctgatgctttttttctgctcttagatgactgttgtcattgcagtgacttaggcctatagtcccagctacttgggaactaaggcaggaggatcacttgagccctggagtttgaggccatcctgggcaatgtagtgagaccccatctgaaacaacaacaacaaaaaatgagatgagcatttagttcatttttcagtttgctagtggtgacgttaaaaaaaaattaaaccaactttgcatcttgggataaacgttatatggttattatgtgctattctttttatatattgttggattcagtttgctaaaatttcatttagaatttttgtatttatatttgtctgtagggatattgggctatcattttagtttaatgtctttgtcaggcataaaatgagttggggtgcatttctttctcttcagttttctggaagagtttgtttggatttggtattatttctttaaatatatggttaaattcaccagtgaaaccattgggcctgaagtttgctttgtaagaaaattctaactacaatttatttttctataatagatttagggctattcatgttatctgtttttatcttttttcttgagtaagcttcagtaatttgtctttcagggaatttgtccatttcatctaatttgtctaatatattggcataaaagcattcagaatattcattttaatatctgtgatatctctaatgatatcgtcttatcccttatattgatgatttgtatcttctcttggttgtttttttctgatcagtctagctggaagtttttcaattctgttcgtctctaagtgccaacttttaggttcagtgatttttgtcttttgttttatatttcaataatttttactctgattttaattatttcttttttttccgcttacctggtgtttcaattgcccatctttttgtagttttttaaggtgctagttgaggtcattgttttaagaccctttttactgcttttgtagcatttaaaaattatgatatgttttcattttcacttatattaaaatactttgtcccttgggttatttagaagtctgctatttagtttcaaaatactagggattttacagagatctttctgttgttggttttttagtttcatttaatgacttcagtccttttaaatttattagacttggttttatggaccagaatatgatctatctttataagtgttccacaaaacttgaaagaatgtgaatctgccactttggggtagagtgatctgtaaatgttgattaggccaagttgtttgattatactatttattttcttttatattcttaccgatcttctacttggtctatcagttattgagaggcaggattgaaaatctcttagttataattgtacattatctatttcttccccttttttagagtttttacttcctgtattttgtagctctgtgattagatgcataaaaatgtaggattgttggtttatcttaataaactgacctcctttaccattatatgatgaccctctttatttctggtaatagtgtttgttctgaaatttgttttgagattaatataacctcctcaactttcttttgattagtgttagcacagtgtatcttctatccctttatattaaagtactttatcttaaaaatatgtttcttatagacatatatttatatatatttatatgtttggatcttgcttctctctcccaccatggacaatctctgccttttcactgaggtacttagaccatttacatttattgtgattattgatattattaggtttaaatttcatcttgctacttattttctacgtgtttcatatgttctttgttcactttttcctcattttcttactgcttttgccttaattgggtgtgtttgatgattccattttgactccttcttgacttttgagctgtaacttttgttaatttggtggtggtttttagggtttatagtatgcattcttaccacgatctcccttcaagtgatattatactacttcacatatagtaaaagaaccttacaacaggatactttcgtttttccatccccaacctttgtggtattgttttcagacacttttgcatgtgttaaaaaaatccacatcttattattttcatcttaataattatcttttaaaggaatttaaataataagaaaaaaacctcttgtatatttatccatgtagctatcatttccagggctcttcattctttgtatagatctggatttccattttggtatcattttttcttctggctggaggacttccttttacattccttgtagcacaagtcttctgatgatgaattatttcagctttggtatgtctgggaaagtattttgctttcattttgaagtatattttgctgtacaaatatatttctgctggaatggcagggtcctttttctcctttaagcactttaaagacattgcttccctgacttgttgtttgcgttgtttccagtaagaaatgtgttgttatctttattcctctgtgtgttttttgctctgggtttgcttaagattttctcttaatactagtgttgaacaatttgttctgttgtgctttggtatatagttttattcatgtttcttgtgcttgggattcattgaaattctttaatccatgggtttgttggtttcatgaaatttggaaattttttattcatctttcttcagatatattttccgttcccccttctctctcctcaccgtcatgaaatctaattacacatatttcaccctacctaaacctgccccatatcactgattttctgttctttttttctctctttgtgtttcatttttggtagtttctgttactgtgtctttaagttcactaatcttttcttctgcggtttctattctgtggttagtcccatcaagtgtattttttatctaatacattgtagttttcctctctagaaatttggcttaggcctttttatatctttatgtctgtatcttctatatgtgaatgtcaggcacttttccattctctcaggaggctgtttcccagccttgattgagtaacatgcctactctgatcagtgctccgcaggatattcaaggacaccctctgcgtatctccagggctcactctgtctgcatgtctcttccttccggtactctgtcttatgaaatctggctgacttggtttcccttgactctcaattcaggggatctgctacactctgcctgggttccttactctgaacagtgaactgtcatctgggttttgatatctctccaagggagggataaatggtcattgaaagcaagtgagcatggtgacggggtgggggtggcctccacagggcacgaagtgagttgtactgagtcatctgagagtgcagtgtgctgcttctggccagtgggcttgacagttcagtgtctgggttcagaatatgagtctgcccatgtctaagcatgttctaaagattcatatcccaaattagttttgattttggtggcctataacatccatgtgatatgaattatcaagctcaatatataaatgcagatacatgtattcaattccgagttatgcaagtgtctttttaaaaactttcaaccctgcagaattagcctgtgattagttaagatgagatcgtttaaacacagcaagaaaataagtacaagggtacttcaaaaagttcataaagttaaaagataaaaaaatgtttaaagatataaacattatttctcaacataagctccatcaaattcaagacatttttgtaagtgctgatcctagccatttagattgtccctaaagaactgaatggtggctaggtgtggtggctcatgcctgtaatcccaacactttgggaggccgaggcgggaagatcatgaagtcaggagattgagaccatcctggccaacatggtgaaaccccatctctactaaaaatacaaaaaccagctgggcatggtggcacgcgcctgtagtcccaggtacttgggaggcagaggcaggagaatcgcttgaacccaggaggtggaggttgcagcaagccaagatcgcaccacacactccagcctggcaacaagagtgagactccgtctcgaaaaaaagaactgaatgtcttgggagtttaaccatgtcagtgcagtctttcttacattagtaactgaagaaaaattccttaagcatgccccttaaggaatttttgagattaggaaacaaaaagaagtcagaaggagccaaatgaggtggatttgcaaccaccataaggtggatggctcatgatttcctctcgaaaccctcacacacttgcccttgtttgatgagaggaataaataggcgctttgtcatggtgaaggtctctggcgaagcttccccagggggtttctgctaaagctttggctcactttcttgaaacactgtcatcataagcagatattaccatcctttggccctccacgtgaacccaacaagcaaaacgccttgagcatcccaaaaatgctgccatggcctgtgctttggccagtcagcctgtgctttgactgggccccttctgcctcttggtagcctttttttttttttttttggattatgcattttcttcaggattgtctttgtaaaagctatttttatctcctgtttgatgtttgttcttgcttcaattttagcagaagtcatgtagctctgataggagcgcttttcaaacagatgtcttaatcttcttagtgcctcaaactagatcctattcagacatgtttcagcaagttagtacaagtttattttggtgccaaaaaattttgaaatccatgaggttttttcataataagcattttccatgaactttttcaagactcttgttaagaattagggtttcctattgcatcatggatgtcacacatgcaaagccacgtgacctgaacatgcctggcctctcagtggcaggggagcacatgcaggcatgagcgccagaggtggtgtgatacaggagcaacccccacctgcacgacctcatgggaccctgcattagtctcagaagtggctcccacccatccactctcaggctgccaaggttcctggctccgtcagtgccagagtgagaaaagacacacttgtcaggaagtctcatgatttcaggtttctgtcaatcttctgcccacctgccctgtcagacaagtgcatacccgtgggtcagttctgctttctcagcactgctcctattctggtggccgtggaagagtgtgaggccactgccacggcagatgcacgctcaagtctgcgtatattcctcggcaggcagaattcccccaccacgcacttctgtggccatgtctgagcacagtgtgccgcccgtggctgctccctccctgggggtgaaagcgggcttcacaccaccttcctgtgtcttccgtttcaggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggtactgaggcgccctcaccgcaatgcgccggctccacctccccaatagcttgtctgtcctcacacctactgttccttaagttgtttcgtcatgtcatcatgcacagcttccgaaaacgatcacttggaatgattcttccttcagattgttttagcttagaagtgtggctacgtccctgaaaccttaatgccatctcaaaggcagctcttttcctccctgctgcagggtaacacccactgccaggccactgtgtgtggtggaaacgtctcttactctcagatattgaaagtcattatgcaaaacgcagggccagtcaccctgctgtcccctccttctcagcaacataaaaattgcttggattgtgataaccctccagtggagtttttaaaccttttgaattagctgtggggcccttttttccccagaataaaactttatatagtaagtcagggtattactagtttgtgtgtattcttcagtcaagtagatggcatctgtttattctgagaccagcattgtgcactggcatgggaggtatagccagaagggacagtgcccgggagggtcctgttcaccaggggcagcacccaggccagctgccacaagtccaaggtccacacagaaggagttactggccgcatgagggaaggcctccgaggtcatcagggtgatgacacacataacatccgtggtgcttcttagagttaaaaatgaaacgtgaatccactattggtggtttcccagaagcatgtcttcagaactcgggggtctgtagctgcctgtttgaccagcaagactggaacttggcaataactcagcccttaggagacgccgcaccttgttctgtgtgaagccgttcccttggcagaaggcgccttcctctgggttgctttccccccagaagccaatgcagttctgaaggccatgttttggtatcttattaggtgttgttttcatctgttacagcgtcaacagttgcatttgtttttttatcccttcacaggttccctcccacttactacgctccaagattaccaaacccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcacgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctattcccaagccgtccaggcaggaggaaggcagccaaggcaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttcggggagccctgggcggggcggctgttggggggaactgggttcggggtgccctgggcagggggctactggggggcggctgtgaggaggagttgggttcagggagccctgggcggggtggctgtcggggggaactgggttccgggagccctgggccggggcggggggcggctgtaggaaggaactggtttcggggagccctgggcggggcggctgtggggaggaaggtgacgtgcaggggaccagaggctctgcactgctcctaggacagctcatctgtaatcagaaaaaaaataaataaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactactctggtgttgctgagactttcttttcctttcaaattatttctgcccttggctccactagcaggcctggggatggacacccacatgcataacctgaaaaggtggctgagtcccgcccaagagctgcagctctgcctccacgtggtcttgtcacctgctgtgcttgcaccagtgctactggaatttccccaccttgggacagtctcccctcagtccccacccctgttagattcttgacttcactgtcttcctggagagcgtgttggcgcctctcctatatataaggtggtgtagaggaaaagtaggcagctgccccactcccatcctgcatataaaatggatgttgacacatgcccgtgtgactcgttaccctcacgttacttgtggctagaacacaggaagaacctacacactcaataagaggcaagggtgacacgggtgctggggtgcagtgaaaaaaaccaggtgctaagtgccaccatagaactatgttatttctaattacaacactggaaggacagtcacaataagtggaaagttggcagcaaagcggcatttccgtgtcgtggctgtaacagtgtatatatgcttcacgtactgtacaagcacaggtgggccaggctgtctaagaagggagtctggccgtggtctgtggacatgggatttgagatggttttgattttgtgttcttatgtgaaaagcatatccgtttgtctgatgtttctacaattaaatgaaaaacaaatataggaaaatattttgaaaagtcaaaagcatcatacaagtaataaaaaaagcactattacagacaggtaacttgattttctcatttgcatcaattttgaaactatttcatttcccacaataaaaacgttaaaatatgttgcagcaaaaacaagcttcagagaaaagaatgaagggaaccctctccctgatgagtgaatcctttgaacagtgattcttcgggagctgcctcgggggccacaccagatggaatactcggactcactattctgtcatggaactggggaaatgtccgaatttgaccacgtaagatgaaagttttgctttttacgagatactgtatagtgaatctcgtagagcctggctgtaaatgttgaggttctcgagcttttattcagtacatgcgtaatgaaggccgacccggaaggcactatttcaggtgcttggaacaggtcggtgaacacaacacagactcccccccaaatagctgctgctctgcaggaaagcaaataacacaccagacgccagtgtcagggaatggtgcctgggaagaaagaaaaagcaggtgaggatagtgcagtggggcgggctgcaatggtaagtactgggatcagagtagcctcacagagaaggcttgcaaggcagatggtcagccagagggggcctggcgagcccggggcactggaccaggcatcagcgtgccactgctggaggctgcagtgccaggaacctggcccaccagtaggtgaacgcagctgttatttaacgtcacatttgataaactcagaatgatattaaaaacaaaggtaaacactcgaaactcgtcacttcctactttttgctgcattttactgcaatctgtgttcttactgtgtgcatactctgcaatggtgggcacgcccctcctaggctgcgtttgggaactcacatcagtagcttggaatcagttgtggtgggaggtttcacaccactggtacccacagacacggtgactcaaggcttgactcactgttgtgattgtctctagacctagcaagggatggaggaagatgcagatcaaactgcaaatgtagctgttacattgtgaatggcacagaaaattgaagaaactgtctcacagcctctggaaactgttatctacttaagcaaagaagtcactcagtcactgaacaagtgaagctctggcattcgtcctgctgcttcgccttcatctgactcatcggtgaaaacatccccagcattcttgtcagaaccac

SEQ ID NO: 12766 - DNA, 156894 bp, Human; identical to SEQ ID NO: 12765
  misc_feature (1)...(156894): n = A,T,C or G

SEQ ID NO: 12767 - DNA, 14699 bp, Human
  misc_feature (1)...(14699): n = A,T,C or G
nnnnnnnnnnnnnnnnnnnnnnnnnnnnnnnnnnnnnnnnnnnnnnnnnnnnntcatggctcagtgcagcctcaacctcctgggctcaagtgatccttttagcctcacaagtaggtgggatcagaggcacacaccaccatgcctgactaatttttaaaattttttgtagagatggaatctcactgtgttgcccaggctggtcttgaactcctgggctcaagtgatcctctcgcctcagtctcccaaagtgttgggattacaggcgtgagccactgcactcggacatgatgttttgatattcaattgttgcttaacattttgtttccaaattttcccagtaataaataatgggcacatctataaatctttgtcaacattttttctccttagaaacagagacctaggccaggcgtggcggctcacgcctataatcccagcactttgggaggacaaggtgggaggatcacttgaggtcaggaatttgagaccagcctggccaacacagcgaaacccagtctcagctgggcgtggtggtgtgtgtacctgtaatcccatctacttgggaggctgaggcaggagaatcgcttgaacccgggaggcagaggttccagtgagccaaggtctccccactgcaatccagcctgtgcgacagagtgaaactccatttaaaaagaacaaaaacaaaaaacaaaacaaaaaggaaacagagacctagaagtggtattacagcaaaggttttgaacattttaaggcttttgagcgccagattcagacactcagtagttttacatgagagtgctacaacatcctcactaagtagtatttgggttcatcataattttaaattattttggtgtgtcaatttgaacactagagtgatataaaaactaaaaacttgaattcaataattttacaattgtattccatcttaaaatattttatggtaaacttggataaagtatataaataatccaagggtgtaaagtagaaagtgaaagctcccttctcccagttccagccccctgatgttgccaatattaaacgttgtatatccttgcagacacgcatctttgatttttgccctcatgtacattactcatttaaaaattatttcgttgagtagattcctaaaagtaagactgctgtattatatgatctttttaaagtatgttgctaaatttcccctcccttctcaaaaaattccaatttgcacaaatatacatgcatacatgcacacagtacattaaggtggataccaaggataaaacatgttctctgtttctgaaaatagagaaaagaccgggaagaagtttaaagttggctttcagcccaccaatagagataacactatataacaccattaaccatgtggtgcatgtaatttagatatacatataattttatttatttatttatttttcagacagggcccaggctagagtgcagtggcagaatcacggctgactgcagcctcgagctaccgggctcaagctatccccccacctcagcctcccgagtagctgggactacaggtgtgctccaccagacccggctaatttttaaaattatttgtagaggcggggtctcgctatgttgcccaggcttactattttaaagtagatgtaggatacaaataaaaaaaaaatctccttccacgtaggtaaagcaggaaataccgtgccttgttaataagtaattccctcatgatccttttccccaggaacttgggtgagaaatcataaccttgtcctgatctttctaaacagcaatttagcattttcatctccctggcaacccaaggcgccttggccttggtcttccgagtgattgacagtgaccccacccaataaaatctttttatttgtcgtatctaaccaatctaacccctagcgcagagctagggggcgttcccaccggtgcgcgggcgagctgagccttccttacgtctgctgtgcgtcatcagtccgagccaagggcactattggccagttccgttcaacgaagtggttgctttttttagttccggcaatgagttgcgccggggcggcggcggctccccgcctttggcggctgcgcccaggggcccggcggtccctctcaggtaaaaggaggcgcgcagtcacagtcctgcgccgggctagcgagctagggaattttcgcttgaggtttgggtcgaagaggtcacgggggagaggttcgtaacgtcacaggcctgcgacggagcgcgactgcgtgacttcggcctccggggcgctggcgggcggggcggggtctgtagttagcggcgagagtgacaggaggacaggggttgtttcggcagtgacgcctggggagtgacgcaattgcacccctgtgcagtgatgtcacggcaggtgcggccagcgttccgagtcgaggacagttggcactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatgcactgtaaactgtgaaagccatcagtgtagtggaaggagcatcgaatttagagtagagagacatggttttggaccctggttcctgctttccttgtttcatctgtgctgccttagaaaattgtcatgagcccgggcgcggtggctccggcctataatctcagcactttgggaggccgaggctggaggatcccctgaggtcaggagtttgagaccagcctggccaacatggtgaaaccccgcctctactaaaaatacaaaaatttgccaggcgtgatggcaggtgcctgtaatcccagctactcaggaggctgagacaggagaatcgcttgaacccgggaggcagagattgctttgaggcgagattgcaccactgcactgcaacctgggcgtcagagcgagactttgtctcccccgcgcaaaaaaaaaaaaaaaaagaaatttcatgaagtcgttttctcaacgttaaattaccgtgtaccactttcgggatttttgcctaatggcagtactgcttgaacttttgattactagatgtgtttttttgtatagctatgtcccatttaaaaattaaattaatttccttgaaacaaaatccttatggtgaatgggaagccagtgtcacttgccacaaatgggtgagtaatcattaaaaaaaaacaaactgaaattaaaaagttatgaaattgtattaaatactgtctttctgttacaaaggggaaattagcaagtgttgggaaagtgttaaggctataccagctgtaaatggagttatcttccttaatgaaagagattgcaagagattttgaaagagtaccccttactacatggggttatttgctgcatatccataagccacttaatattttgtaggtaccacactggcatgtttcacactttgggaaaatatggacataaagtgatgcatttgagagctagcaccgagcctcaattttactttaaagtatatggtaatgcaggcaaaactccgagggttgttgaatgtgaattttaatgctgctctgttcagccagtgagcataacagaataagactcatttctgtttataaagttactttgcttcttatatcttatttgatcctcataactcagtaagaaaagtttattattgtatgttttcccttaaaaaggaaagagcctgattattgccttttttttttttttttttttgaggcagagtcttgctttgtcgcccaggctggagtgcagtggcgcgatctcagctcactgcaacctccgcctcctgggttcaagtgattctcctgcctcagactcccgagtagctgaggctgcatgcatgcaccaccacgcctggctaatttttgaatttttggtagagacggggtttcgccatgatgaccaggctggtctcgaactcctgacctcaagtgattctccctccttggcttcccaaagtgctgggattacaggcgtgagtcgccgcacccagccaattttatatgtaagaaatgtcgatcctgattttcccaaggctagtgttagagatgggacacatgttttatgcttctttttttctttttttgagacagagtctcactctgtcaccgaggctggagtgtaatggtatgatctcagctcactgcagcctttgcctactgggttcaagtgattgttctgcctcagcctcctgagtagctgggactacaggcacgtgccacgatgcctggctaatttttatatttttggtagagatggggtttcaccattttggccaggctggtcttgaactcctggtctcaagcagtccacctgcctcagcttcccaaagtgctgggattacaggcatgagccaccacacccggcctatgcagtctctttagtcagatatgctcagtgagatggaggggatcatggcgaggagtagaccaaagctgggtcactatgcttcagaacttaggtccacgcttctttgttaaaagtgtgacatttacaaccccatctggtagaagatttcaagttcagagccaccccaaatttcaccaacccacctcactaccttgtgtccaaagcactcaagcctttgtcatgaaagaaccacatatgtatctaaaatgaattttttccacatattcgctggctgttgaagttagcctaagtgaaaagaagtttgcataaaagacatggtagtcacggctaagagccctaaaacattacaaagtgataccaatgctggctgggcatggtggctcacgcctgtaatcccagcactttgggaagccaaggtgggaggattgcttgagctcaggagttcgagaccagcctgggcaacatggtgaaaccccgtctctactaaaaatataaaaatgtagctgggcatggtggcacctgcctgtagtcctagctactctggagtcctagctgctctagaggctgaaaaaggagaattgcctgagtctgaaaggtggagtttgcggtgagccaagatcgcacctctgtctccagcctgggcgatacagtcagagtctgtctcaaaaaaaaaaaaaagtgataccagtgcagttcgaagctaccattacaaactaaatgacccttaggtcactattttccgtatctgcaaaatgaggtgaatacaccttacacacctaagaatgctgcaaaactcctctctggcagggaaaaaaaccttttgagttactctaatataaggctcagagaatataattaaggtgttaaggttaggagatttatttttaaagataaaatataatctgtcatgaagaatttacattttgaagatgagagttcatttgaattgattttggagcataatgaagtgaaatctaggctccaaggctagtctcaaaatcgaatgcccaacggtgtggggtttttaatttttttttctgtttttgtttgtttgtttgtttttgtttttagacagagttctcactctgttgcccaggctggagtgcagtggcacgatcttggctcacgggcaatctctgcctcccggtttcaagctattctcctgcctcagcctcccgaggaggtgggattaaaggcacacgccaacacacccagctaaattttgtatttttggtagagatggggtttcaccatgttggcgaggctggtctcaaactcctgacctcaggtgatccattctccttggcttcccaaagtgttaggattacaggcatgagccaccgctcccggacaggtgtggattttaagagaacttagtctgtggttctcagccttggctgaagagaagacttatgcacagagcttctaaacaatatcagttcagagagccccctcccagagattgactggggaagagcacggtgtttttgaaagctctgtatgggcctctcctgtacagcctgggctggggcgaagtgggccagagggttggtgaactggagaaccatgctcatctagaagcggttgccatgttaactgcctggtaagaaggtaggctcagcatttccaaatcttcatacacttaaagtgaaaccagaaatccagatctttaggtaaaatcctctgttttaacactgtaggttaaacagagtccgtttatgggcacgcctggcccatggggaactgatttgtgacctccatcccaaagtgccctttctgctgtctgtaaaaggaacatctggattttacctgatcgtaacgaagaataaacacttgcatttcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcaggtgggtgcttcttcatctccctcaccctggtctactgaatgggcagatccaaaggacttcaagtaatgaatcatgggaggtcaagcgttccctagggagatgccattgtctccaggagagtgaaggttggttcttggtggagatggggagcaaaaagcatattgttctttttatggataaagcacagagagacatctagtacatagacaggtatgcggtatatctttggtatcagtactccatggcgggggcaggcagtaatgaaaaaaggttaagaatcgctcagcacagcagtcaactgtgctgaaatgttgcagccctgccccctaccgtgccagagaggtattgtatcccaagaggctatgggaggacctgaaatttgtagttacacagacctggttcacattttggctctctcccacctcctacctgtgcgaccttgaggatggcacaggacttctctgggtttccatttccgtatctgcaaaatggcctcataatggcctgggtttgggtaaggaaccgggtctggcccataaaggtcaagttagtacaagttaaatggcctgccctgaacccttgggcaagctacttagcctctctgtgcttcagtttgttgtgtatactggcgcagtcatagtgtgtccttcacagggattgtgtggattgaatgaattgcttgcatgaagctatttgatggcccctggcacttaggacgtgccatctaagtgttagctgcagctagcattctccctttttcctctgatgtaaataatattcagggccgggtgtggtggctcacgcccgtaatcccagcactttgggaggccgaggccaatggatcgcttgagcccaggagtttgagaccagcttgggcaatgtgatgagactccgtctctacgaaaaatacaaaaattagctgggtgcaatggctcacacctgtaatcccagcactttgggaagctgtggcgggtggatcacctgaggttaggagtttgagatcagcctggccaacaaggcaaaaccctgtctctactaaaaatacaaaacaaatcagccaggcatggtggtgcatgcctgtagtcccagctgcttgggaggctgaggcaagagaatcacttgaacctgggaggcagaggttgcagggagctgagatcgcaccactgcactccagcctgggcaacagagtgagactccgtctcaaaaaaacaaaaaaaacaaaaaaaaccgcacacacaccacaaaattagccaggtgtagtggcatgtgactgtaatcccagctaatttgagaggccgaggtgggaggatcgcttgatcctggaggttgaggctgcggtgagccatgagcttgctactgcactacagtctgggtgacagagtgagaccctgtctggaaacaaacaaaccacaacaacaacaagatgatgctattctagtaatctggaaggaaattacacaacagccaatgttctgccttcctgattttgaaatgggttaaacatgtcatttcttatgtgtgtagacccttgtcatttactgggcacattgtgggcctgagagacttctgctgcaaccatggctcatggcagtcttaactggaattgagataatagactgttttgtattcttggtgctctcttctctttgtcacagattcctttagtctgatgttttactgtttccattgacgttttgaggggaatgggggagacagcagttccatcattttctccgtttctgctttgctccctgtatgccgcttggatgagtgggaggcctctatggaatgcttgcatgtctttatttttatgtttcttgcagaaaatgtgggatcaagaaaaggaccatttgaaaaagttcaatgagttgatggttatgttcagggtccggccaacagttctgatgcccttgtggaacgtgctggggtttgcactgggtacgtgtctctctagaagagcttatgcaagcttggggatctaggatgattaaatccttcaggtatcatgttcacaattcttgctgtgtcctcttatgacctcattctgtttacttcatatttttccgaggttaaattgactgcctttttttgtgtgtggttaaatttatttaagatagaatcttaatgtcagtactttaaaaaaaaaggccgggcgtgatggctcacacctgtaatcccagcactttgggaggccgaggcgggcagatcatgaggtcaggagttcgagaccagcctgaacaacatggtgaaacccccgactctattaaaaatacaaaaattagccgggcatggtggtgcgtgcctgtaatcccagctacttgggaggctgaggccagagaatcgcttgaacctgggagctggaggttgcagtgagccaagattggcccactgcactccagcgtgggtgacagagcgacactctgtctcaaaaaaaaaccaaaacaaaacaaaaaaaaacaaaccagagccagggtctcactctgttgcccaggctggagtacagtggtatagtcgtagctcactgaaacctcaaactcttgggttcaagtgatcctcccacctaagcctctgaggctgagtatcttggactactggcgcatgccaccacgcacagctctattttttttgtagagatggggtctcgttatgttacctaggctggtctcaaactgctggcctcaagccatcttccctctctggcctccccgaagtgctaggattacaggcgtgaggcactgcacctggcctaatgtcagtattataaatagaaaatacagtaaaaataaacaacagagaaaaaaagctagtagaattcagttgcagccaaatactgttccctgacaacgattctcaacctgagatctgttcactcttttaaaaaacggagaagaataaatggtataaaagatcaaagatatactcaccccaaatgctgacttctcttggccacggtcaggataaaacagcattgaaaagagaatggtttttcttaactgtgtaattccaggtttaacactgggatccagtgtctcctaaaacagtggttctccctcagggtgagtttgtccccctgatgaggacatgtggcaatacctagggacattttttttttttttttttttgagatggagtcttgttctgtcacccacgctggagtgcagtggcgtgatcttggctcactgcaacctccacctcccggcttcaagcgattttcctgcctcagcctcccaagtagctgggattacaggcgcccaccaccacactgactaatttttgtatttttagtagagacggtttcaccatgttagccaggttggtctcgaactcctgacctcaggtgatccgcctgcctcggcctcccaaagtgctgggactataggcgtgatccattgtgcccagccctcgggacagttttgattgtcaaaacttagttggcactgctggcatctagttggtagaggtcagagatgcagttaaatatcccaccatgcatgggacagcccctgtcacaaagaatgacccggcccgatgtctggtgcagaggttaagaagccctggccacagatggtctccattaccggtcatatctgtctcttacttttctggtctgggtttaacaatcccaggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcaggtatttatccgtgctctagaacggggctgctcaaggaggaaaatggcagatagcaattgggtaagaggaaaacatgttagagattgttaggggatgatgggggtttagaggctcaggtcagtgcctcagtttaaaggtgagcaaactgaggaacagagaggtgaacccgtctgccctggccatacagcacagacagagctgggactagaacccttgtctcctttgtcttttttctttttatttagagatgaggtcttgctccgttgcccaggccggagtacagtggcacagtcatagctcactgcatcttcaaactcttgggttcaagtgatcctcctgcctcagcctcccgagtagctatgggactacatacatagccaccactcacagctaattttttttttttttttttttttttaagagatggggtctcactatgttttccaggctggtcttgaatttctgagctccagtagtcctctctcctcagcttcccaaagtgctagaattataggcatgaaccaccacatccggccagaacccttgtcttttgagccctgtcctgttcacttattttatttttaatttttaaaattttttgtaggcacagtctctctctatgttgtccagattggtcttgagctcctgggctcaagtgattcttctgcctcggcctcccaaagtgctgagattacaggtgtgagccacaccacctggtgctgttcactttttttttttttttttttttttttttgagatggagtctcactctgtccccaaggctggagtgcagtggtctccgcctgcattgcagcctccgcctcccgggttccagcgattctcctgcctcggcgtcccaggtagctgggattacagacatgcaccaccacgcccagctaatttttgtatttttagtagagacggggtttcaccatgttggccaggctggtctggaactcctgacctcaggtgatcctcctgccttggcctcctaaagtgctgggattgcaggcgtgagccaccgcgcccggcccacttctttatcattggtagattctgagcagatgctgtgagcaggaaccctttagattgaataaatgaatagatatcctgagataattttccacagcaaataagggaactgtttagttttttagagtctaaatctgaggttggcaaactatggcctgtggccagccacctgtttctttaaataaacttttattggaacacaagcacgtccatttgtttgcatgtctccggctgcttttctggttacagtggcagagttgggtagttgcaacaaagtatttactctctggccctttagaggaaaagctggcctccctgtcttaggccataataagaggctttagcctccaaaatgaaatggaacagcaggagagttggaaggctaacttgctttggtgtctttttatttaaccagctgataaagaaatttcgggatgaagagcttgagcaccatgacataggcctcgaccatgatgcagaattggtagggccctactgttacctgttctgctttgggactccttatttgggaggctgaaggggcaggaggtttctgttgccagaaaaatacattttaaagtgacagcgaaagggagagaaaaccaatgacgttgctttgacaaaaagcaagcaaacgcattattgctccagattgggaatctcctttcttgctttatgccttctccttttccccagaagctttttttttttttttttttttttttttttttttttcccagacacagtctcactctgtctcccatgctggagtgcagtggtgcagtcttagctcactgcagcctcctccttccaggttcaagcaattctgcctcagcctcccaagtagctgggatgacaggtgcatgccaccatgcctggctaatttttgtattttttatttttagtagagaccgagttttcactgtgttggccaggctggtctcgaactcctgacctcaggtgagctgcctgccttggtctcccaggagcttcatttcctttcctgtgagaatctggatgactccaatgctttggcagtagtagcagaggcattccgaccttttgaatagctttctttgaaactaaaataaattgttccttagatctatttcttatccagagaaatccaaagcctgccctgccagccctgaatcttacaaccgaaaatgagcacataacatgtttctttgtttgcttattgtttttaacaggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaaggtactgatctgctctttaacaagaatttgtaaagggttataaaaggtttacaagaatctcacctcatggtcaaactagttaagattggatagatttatctataaggtattattaaaaattggggatgacattaatagtagactgatgcaaggatgacatttgactctgtcttgaacaagatttttatgtaatagtaaaggata

SEQ ID NO: 12768 - DNA, 95561 bp, Human
  misc_feature (1)...(95561): n = A,T,C or G
ggaactttcacgaaactttcaaggagtaatatctgttaaatctaataaacaatttggccttgtattttgcaaacctttttctttaattttcctagtgcagttatcccttagtatctgcaggttattggtttcaggacccccaaggatagtaaaagctaaagatgctcaagtctcttaaataaaatggcattagtgtctacatataacctatgcataccctcctgtatactttaaatcaactctagattacttataatatctaatacaatgtaaatgttatgtaaatagttgttatactgtattgtcttctatttgtattattttgttttttacaatttttacaaatttttcaatctgtggttggttgaatctgaggatatggaaccaactgtgattaatttttcttatattttaaaaaagttttggttggtgatggtttgaaaattaaaaacaaaacactgttccttcttgcagatagtttgagaaaaaacagcccagattataaattgaaaaattaataacttttggtgaggtcccaagttaaccatgttttttcattttcttagagttcattaattaattagagttcactaattaatttccagctgatattctttgcttgtgttttcactctgagaagttaccattttaccagtcaggttagaagtcaagcagtaagttcagtggaaaaacaagtaataataaatctacttagtgagaccgtactgtgcaaccgactctgcacagagaaaaacaacctattacgtagatatttttattcccattttattcccattttagagatgtgaaacaacttaaccacagcacagagcaagtgtagagacagaaccgggattccgatgaagatctgtctggttccaaagtctctacacttttactacactgttctttattaatcactagatagaaccatacacatattgttacatcaggcagaaggtttcgagggttctattaacaaagtgctacgaatgaactgggtggaagaaagtacataggtctcccattcaagggttcatcagccttcactaaggaaatttaagtcaaagtagctgacagtgagtcagcattttggaaggcaggtagagatggtgaagaaataaggaaattcttctatgagtcatgatagatatttaagcttgttaaaaaatgtttttgactacctactccctttgcctacagagtccagttaaggtatcttaaaaattatggaaataaaaacaatcggtcgctgtctgtcctcgccaaactcaaaaaaggctaagccttttgtgcttaaacacatactcatcagtaactattctaccttacactgaacataactaagctaggttgttcttcttgggaatgtacttgcaagttaatactgcactgcaactataaggttttttaaaagacatcagttgtacattataaattaaatctagtttaaatcaatataattcaatttatcctagcaaggaagttttttaaggatggtctgattttttttttacaggaataatctttgcataattttacaccccatacatgagatgattaggattcaatctcaatcagaaaaatccctttatggtgtccttatggctttcctgtatcctaacagaaaaatcctagcagaagcatttcccctttacccagttcctgttctcttatcacagttctattcctccacactcccttcctgctaggcacgggaatttgaaagggcagggaaaaatcggtgaaagtttgtcttctacttgggtaatccaacaccaccgcatccagtagtatataattctttttgcatgtatatcagatcctccccaatccctctcccatacctctttctcacttttctctcattatccggtcctcttgttttccttgacccccacattcctgtctaaatcatcctcctggcctcaggtccttatcgccttcctgagaccctcatgtttagtgttccctcattcctcttacacctaggatttctcctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccaggtaaccaggacgcccagggccccgcccagcgtccgaaggggatggagaggggccggggacctgctggattgttgccccaattcgcggattctggtttctgaaggctacgccggaattccttccccgggacttgggaaccacttctgcctccctccctggggcgtggaggctgaggaaaaggaggttaaaactcgctgcttctttatcgattcctctacctttcatattccgatctcgttttctccccgatggaggtggtcccagttaattactttctcctgtctttcattccctctcaaaccttttttaagacagttccccccgcccccattcttttcccccacatttcctgtctttctctgtcactttttccaaaaccatcctaaagtcaatctttcctcctccaccccttcttatgtctttggtttttgggttcttgcccagcccttttctctcttttcatggcttcaccttcttaatttctttcatgcttttctctacactctgattttcttctcgcctccctttttgcttaaatatgtaaataaaaatgtctcctgtgcttctcttttctaaatcttccagctgaaagtcagtatcaaggaatctgagtggtttttatccccagtgataggtttaagaaaacaaaatgaggggtagttttcttccttcttgtgttactggttctccacgttgtcatttctcttgtaacagatgggaattttatcctggaattttgaggaggactttatgcagctttgcagagagcttttatgaatattaactagacgcgttttggatgcagtctttttctttgattttaaaataatgatttaaaaattttttaaaaaataatataagacctgtatttgctttttatgcagccacgatgaaatctggttcttttccactgaataatagtctaattgttattagagagtgattcgataactgctgtgtgaaaacacacaattttcattttctccttcaatcagttgaagtggctctattataattcattttggattctgctaaatatgggtagttattgccttttttcctgttgatgttcagcacctcactggggaaccactgtctgatcccgtcattctacattgccatatgcactcatagctccctgcacagtcgtttttcagagtctttaataagcacactataattgttggcttaaagtgccttttctaccaggttataagctattatacttgagggcaatcttaatcatcttcatatctccagcacttaacatagtctcagcatgtgataggtgctcactaaatggttttttttttttcgaatttgtagcctgaattatccaggaaaggaggatttttctttgcagtttgattatatatattgcacgtttgaatcaagtattttttgaattctgtatttattgctttgaaatttggaaagctgaggattaacatgttcagttgtgtaattcattcagaaaacaggttggaaaattcgaattttatgggaaagttacaaatgacaactatgcctcagaatagcataagaggcaaccagtactctcatccaaggcagagaagttagaaccacatgaagcagcacagtatgttagaaagaaggaagtactggaagttaggaagctcccatgctgaagtctctggctgagctagctctttggtcttttcatttagactttctagtctacagttttctcatcttttaaaataagaagcttgatctagaaaatctgtaaggtcccttggaactctaacattgtcatttttaaaattttaatgacaatactaagatgaatgcattgatattaattttaaagataattcctttgcaaataacctttgttttggatttttgcaattacacgaaataagtgtcctttattattacaaactaatatacctaacggtgccacttgaacatatttatttcctaaaacagaaagcccagcaagtataaagattatatatgtatatgaacttctctataaaaaattatgttactgacaaatttgagaaaattaagtactcctcgagagaattgtgatatagtagattagcctaatcctctctggacaaaaatataagtatgattcctattttccataagagaatgccagctttcattactctcctctggaaggtagaaaagtaacatttacttaatgtctactgtatggaagtttccctgctaaattctatgtatcttttatttcattaatcatcatacctgtttgtggcactctccttaatcaacagtatgtaatagatacattatagacactagttagaaagcttaattttaaacaatctaggctaacacttcatcgcaggtgactctaatacattgccagtgtggcctgctttggtctcatagctatgttaagtgtctatctagattgtttaagttatttcttttgtttcattagcctttgacaaagcaaaattattgctgtttggcctatattatctcagtttttgcagaaatgattcccttaaattgtagtttatttttatgctttctgtttttatacagaggcctaattgggaaactgcctttggaatttgttttgatatctctggcagaataatagttaatattgttaaatgtgtcacagaatgtttttcacacatgcattaacataaatttctgctgagtttagctacaaagaaaattatttatagaaaaaattatgtatgctccttgtttgttagtaagtggtaactatataactgcgtctttctctttagcttagtaaaactttagtcaaatttatatctgaaggtggtaatatactcatctctaatttctttaagtacttttattattacatgaactcaagttaaatattatgtgttatgtttaaatgtattgattagatgtctgaagcccttttgggaagtaggaaggatgatacactaatccatgtggttgcccattgttttttgaaaatgacatacttggccgagtgccatggctcatgcctgtaatctcagcacttgggaggccaaggtgggaggatcacttgagcctaggggtttgagaccagcctgggcaacatagtgaggccccatctctaaaaaagaaagactttttaaaataagtaaaaatattttaaaaaatgaaaatgacatactccattgaagttggattacaggctgttgtgcaatctgtagttcacaataaacatgtgatgagtcttactaagtatctgtagtcatttcagagttctcttgtctccagttatgccttctaggtcatcatagatctgatgcttttgcccacaaaagggcaatttcattcttcatatgatatccaggtagtagtttcctaaccagctatagttatgtcatcctgcatctttaaaaaaaaaaaaaaaaaagtaatcgtcagctgggcgtggtggcacgcacctgtaaccctaactacttgggaggctgaggtaccagaattacttgaacctgggaggccaaggttgcagtgagccaagaacgcaccactgcactccagagtgggcaatagagtgagactccatctcaaacaaaaacaaaaaaaacaatagttgtctttggtgagtcctgcttaatattgccatacttcagtaaactgttcagcaactcttgtatatcttgctgttggccattcttcatgtatatctatccccacagaaagagagagggagttgtggaaaacttcactttagcatcctgataatctagttatattctgtaattttacttttgttgggtgtgctctgattcttgatataagtatgactttataagatataggtaaaataatactgtaggtcagatgtgataataagagtaggcttgagtctcagaactgtaatgagttacacagcagaatttgacattatattggtaataatctgccatcttagtctggttttccatttttcagtttatacactattataaaatgcactgctttagtgggtttctttgattagtttgtattgtgcataatcaaatggtaagatatctagtgccgaataggtgctgagtgaacatctaaataaaagaatgttgacggaatgttcaccactggtcttgtttgttgttcccattcaaaggattaaaaaggattccttctgttgaatttggcctgaacacttgcaatttcaggtctaagctgaagttatttttatgggagactggacatcttgagctgattttactgttctgtgcccagtcctacacacaatgaggttattatgtcctcttcaactacctatttatccatctgctactcttgattacttttgccccttttgctctaacttgtgttgttagtcgttttaattaatgtgtgttcttgtcatccttcatataacctcaggctttagttattctgggtaccatacttgtttatcccagattatttggttttatcaatttgtagtatataatttcattagcattgatgagcatcttatatttacatttaacttccattaaaaaaatcaaagggggggtacacatactcaaagtagttctcaactaattgcatttataaattgcatgcctgccttaaaattatcatcatttgaaaacaggaattcctagatttctgtttccatggattttgattatacttatagcctgaagaagtagaggagtttcctagatttctaaaacacattttgttgcaaggtctcatctttagttttagcctcaaggtcacttaagagtgacgtgttggaggccaggtgcagtagctaacgcctgtaatcctagcagtttaggaggctgaacagtttgggattgcttgagtccagaaattccagaccagccagggtcacatggcagaacactgtctctgcaaaaaataaaaagttagctgggcatggtagtgcatgcctgtagtcccagatacttgggaggctggtgtgagaggatcacctgagcctgggaacgttgaggctgcagtgggttgtgatagtgccactgtattctggcctgggcaagacagtgagaccccgtctcaagaaaaaaaagtgatatgttggtaggaaatatgcttttatgttgtttttctagtagtggtgatggatttgtgtacaatcacacatttttacccattccctttgtcactcttggcatgtctgctgagacagctggcaagattagaggtagaaattatagctgtaaaacagagtaaagctaccagattgaacctacaaccttggcattattagtagtaccttgtatcaaacattgaacatattagactaaaaattacttatttggatttcattacttaaaaaccctcaaagatctaagttctcttagataagaaacaatattggtctgacatagtaattatgtagcttttcagaaagcacatatttgaagaatgcaagttgatagtgaacctgagactgggtcccgtatatatctgtatttttcctttttatgctattatcaataatttcctattagtgtagaccagtagttctcaaagtttggtctccaggccagtagcatcagtatctctttgggatttgttaaaaatgcaaattcttgggccctaccttggacctaactgaattaacattttaggggtggagcccagctgttggtgttttagcaagctttccaggtgatcccgatggatgctgaagtttgagaaccactgccttggatcttttgctaattggtgccttttgtaatgcaatcaacattagttaaaactaagttaaggtctatgttagaagtactgtaaaactattacttgagagcatttttgtaaaaatgttgactaaagtagtaaaaggtaaaagtcatctcttgtcgatttattagatttgatttctaggaaatttcctaaggcatttttctttgagtaacataaaacaagaatatgcgttttaggctttttcttaaaaatagattcttagtgagaaagattagtggaaacaagcatttttaaaaaaagtacagttgaccctcgaaccacatgggtgtgaactgttcagatccacttttatgtggattttcttctgcttctgccacccctgacacagcaagaccaacccctccttttcctcctcagcatgtgcaacatgatgagggtaacaaactttatgatgacccacttccacttaatgggtagtaaatgtattttcttttcctttgtgattgtcttaataacattttttttcattgttagagttcagtatattggcgtgcagcctgaaatatgttttgatgggctgtttatgttatccgtaaagcttccagtcaacagtagtctattaatagttaagtctggggagtagtttggggagtcaaaattatatgcggattttcagctgcgttgaaggtcagcaccccaactcctgtgttgttcaagggtcaactgtattatgaacaagtaattccaggaggccatcacctgaacctgtaaagtttggattatgcccaggggaaggagataacctggatacagatgaccagaaagcagtaagtttattttggaaagctgccaagttaatgctattgtattcaaaatcatcagagccaaagattgcgtgcgattcaggatttgagtaatggaaattctccagattttagtgtggaatatttttcctttgtaaggaagatggttttgaatatgtaaagtacttgctatctttgtgtctactgtttgatttagttaaatcggtagataataattaaacactattagaggtgatagtcaaggatagggagtgattttaaaaacctgctttccacaggaagtcaaattaaaaatggaactgtataaaaagataaagttggtactagattattaaaataaaaaggactagggaagatgccttcttgaaaataataacttcagttccctttcctgtagctttattatgcaaagctaattgtgcctgtccctcctaatatgtttctatataggtaccaatgttgtcattaatacaaactgttaataagcaagcttcataattcttcccttccccaagtacataggacctatggccataatcactggtgaatatttattctttcaaagactcttactttgtgtgaataactcttgggctctttaaatatttttagtctagagtaaataagagcaaatgctgtgtattaaatatattaaaaattacctgtaaaatatattttaattaaaaatttaaacactgttatttggaaaattcttttttttttttaagttctactttaggtttagcagcacataacaaaatacaaactgacagtggcttaatataggagatgctaaatttttttccacatgaaagcctggagatagtcaatacagatctaatatggtggatctgaagtatcaaggacccagattgtcttacattccagggttacctcatgaaccaaaattattgttggaactccagctattatatcttcaggaggaagggaagaagaggagcatactctctctctttgaaggatacttttttggcagtcacatgtcattttttttaacttacatccagttggctaaaacatggatggtcccatggccatacgtaggtaaacaagaggctgggataggcagtctcatctgtgaggcctttgtgctgagctaaatttggaggttctgtcactgaggaataggagagaatgggtattggagtcatagcagcttttccccttgggtacagatgaatcatttaaaagaaagacattttccacctaaagtctgcaatatttcacttatgccagagacacccttagagctgcaaatgcgatgaccaaaatagaaaacacactgaaagagaggaggtaatacattgctgcagaccaaaaaagagaattgtatcttggagcactctgaactcttgagtttagctttctatttttttgtgtcttgtcttgggtcagatttttataatcctaatctggaaccataaaatgaaagtggtacatttaatattgacaagatcattaagtgatggggaaacagaaatcaaaggaagaatggattgccgtgctatattgtatttcacttgaagagctcaaggaattgcacggtaaagtagtagtggtaatgaagttgatggcctactctgcttacttccaatttgacatccatttccaagccatgtatccatgtattttatcctcttctagaatgttgcatcgggttctacttaggtattttctctcatttcagttgtaaggatgtggtttccataagggaaataaataaagctgaccattttaatttatgaatgcttttgccaatattcagtttgtttttatatctttgacctaaacattttattaaaaatgcggagacatctgtgtcttatatattcttttgtcacctaacttaaatattaatattttaagcatataatttcaaacataaggagtttataatttggatgtgaatagaagagcatatgtatataagtctcctttggattgataaaacatttattcatcaggctctgaggatttaatagacattaagtcagaaacatatccatttctcttctcggcagaattgcttttactgatagcagcaaatgagcagttgctgaggtagggaggaggccttgtctggaggttatgcattagcaaaagggaaaataactggctgatgatgggctggtgattacaagccttaatattcttgagcgagccaagaagcccagcaaagttcaaaaataaaattttgttctctgttctctgttaccaatattagataacaacattcttttatcataaccaaaggcattgcctcaaaatagcaacactgaaaacaagccttgctttcctagtggtagacagttatagtaataataatgttaatattaaacacaacaataatataaatagcacaacatttattgcatgcttactatgctgggcatggtgctacatttcttctatgcattttctcatataatcctcataactgtataaagtagagagtgttaatgtttccattttacagagaagaaaacggaagattagagagggtaccttgacatgtgaattcaagtccatttgacttcagggtctgtgtgctctaaagaacacacatgcctgaagatctagtgccccaggtgcagaccaaagctttgtagttagagggcagtcccagggcaggttgattgggtggtagtgataaggacatgagtttccttgacctgctattttgctggagaaggataaagatacagtatacattcaccaagtgagagtttgtatttggagagaattttacctttgaattttgtttgccttctgacagaaaataggatgtttttttttctttgcctgagattaagaggatagtatcatttcattcattacctgatgattaagagggtagtatcggtagtatcatttcattcaaaagaacagttttacattttgaagatcatgtaaagtatgaagcaagtaattgccaaagcctcctccccaccactccctgccctgcaggctttgcacaatgatttagaatattttagggttccttaaatttctgaattcccctaagttcctttgtgtttatttacagttaatgtgttaagagccattgacatttgaagatcatcagaagtgaagataaaacatctcaaaaattataatgtaagtgaatgggaaaatgcagatataaaaatggacaaaagttaatattgccaacagtatttctggattatatattatcccaaatgaaatttgcacttatgagtaacaagtagtttcaaacttcagttccatttccaagtccctgtccttaaaattctgtgttctcttctacttggggaaagcagtcactaagttttagtcatccagttattttccattagaattcttttggcatccatgttctgttttcttccttttcctccttagcaatttgcagtttgacttgagaagaggatgacaagaattcatgttatatgcaaaatgttatagatactaaggtctttgctttccagctattgatgtgtgttgtgtatgttattcaagtgtaattttactactgttttgtatgtttcttagccaaaaatatgaccagttagttagccgccttccttccccctctttctctattctttctttttttcccctcctctttcccttcctttctttctgcaaataattgtttaacatctactgtgccttacacactgtgctagattctgaattcctaaaagcttggtgctgaaatgaattatatcatcttttcacactcttagagggattagagatcaaccaattagtgtttttcaactgtggctgaggaccacctatgtatttcagtcaactgtgaacttggtgaacatttaacttcctaggtttcagcgtggacattctgaatcattgaggtgacgttaggaatcggcatttaacagttgaagaaccacccatccaaatgctgttggatgctagtctagttccaaaagttttcagatgtggaaatagatctagagaactctaataatttaccccaaagcacaataaatgttagagggccaggaaaggttgtggttttcctctgaggtcatagagctatttagtgtcagagatgatctcctaattcccagttctagactttaccatgtagcatcatgatttttttgcagggccatataacttcactgtatttcctgtctatagaaccctctgcttataggatgtataagattataaccaatccatcactgttcctgaaaaaaataagaggacatatgggttatgtaaatgaaaaacatactgtttcttcatttttagtcagatatgtgactcattctggttttgaaatcattggatagacttggtgaaggaaagaaaaaacttttttttgtatccatgatattatttctacctggatttaagtttcatgcttacgaaaatgaggatctgatttcattttttgagtgaaatagtaggtacaaattttatagtgttttgcaaatagtaggtgcttgataagctatactatgaacagtttactgttaaaacttttcttcatttgtattctgtgaagtacgctagttaggagtgattttatttgcttcatacagaatctgatgctttatataccaagccagaaactttaaataattgaaataattttattgtatttataatactatattttatagttgatattcacaagatctctgagggactgaaatttataaagtatttttgaactataagagtttgaattcgttttagtattgtgtatattttatattgtattatgtatggtatattgatagttactgatttgtaactttatatgagtaaatctcgttatcttaattttggaaatactctgtaattctcaaattactagagagtttaatgatgcaatgcctttttttaatatttcaagacatttttattctatgatttttaaaaaacgtcattttaaaatagcctattgatttctaaaaaattattatatttttcaattataaattttcttttcattaaaaacttttttgttcttttcataaccatggaaacaagattgtacttataagagctctagaaaggaaccttatctattatgtggttttctagtttatgatttctaacaactaatctggtaaatagggaagagtattcaaaattagggagagatatccttggcaggcatggatcactgagtaatgtcagtattttgatttttagcttaacctttctggactacaaagagaaagatgttgaatgctctacctttcctactgagagttttaacttagtaactgaaaaaaaaaaaaacccacctgtgttaacttcatttatatgactttgaagtttgtgcagaaaagttgtatctcattacattgaaagggtagtgaaagattaattgtataataaacagttttgcttgtcttggaaaaacaaaatatatctatctggatagcaaaaataatggatatatgactttctaatttgaataatgaattcaggtttgcaaggtggagtgagaaaattacatgacagatcatttttcaagacataaatttccctgttttctatacttgtccaagtaagtgtttgttgagcaagtgtttagggaatagatcaccttctctcttttagtgtttttgcctgtatactttagtttgggatggaagggttaatttcagagctctaataatctgaccagttttcagtttagtttgattcttctctcagttaagtgatatttaaataactttttccctcttggctacttatgaatctgtgtgttttcatttgagctgtcatctgaatttgaatcggaggtttttgaagagattctgagaagctccttaaacggggtgctgaggctgtgagattggtgctggaactcaaggtccttcctgccctccagtcctcacccctgtctcccagggacacattcattttccgcagaatactttggctttcacctctttatttatttaaatttcccaataagttctttgaagaaacaatactctggagaaaaaacagacatatgtaaattattttctatacaaactggttgttcagactctgctgcattatgaaatcatatgcctgtgttatattttgggaaatgtaattaatagacctggaaataaattgataactgtgtccagggtcacatgtaccttagaaccttgggattttccaaactaagtgccaacatgcaccagttggaaggctgtcccagagctcaaatctcctttgtttctcggaagaatacaacatgttgtctcttatttctgtcaatcagatgccatgatgatcatttatataatcgtttttatcttatgaattggctaagtttaatgcagggttctggcacagcatttttaaacattattaaaaattataaattaatttgttttgggggggttgtttttctgttttgaggatcctgcaaatattctgacaataagtcttttgtgtctcaaatgttttatacacactgcaggccttttattattttttttaaataaaatcttcaacagaatgactaatagagcatgaacagtgcttatgatactatagtgcattgtgttaagtattgagagcaaaatttgcgttcctagaaaagcttgttcacaatcagaatatagaaggcatgctttaatgttcttgggcaaacatgctgtgtatgtgctcaggacattacttacaagaaaatcactttttaaaaagaaccttttctttttacggaatattgaagaaaaattgaattggcagcaagagtgaaacagtttaaggcaagtggtttagatcttattgtaatgactatggtcagtagaaatgcagcctctcctaaatcttctagaggcatttgtttactaggatatatgaaaagatagatgacttgaagtttccaggttgttttcactttagagtatatactctaaagtgtatatactctttatatgtttgttcatctgcatctttaattttcagaaatactttttcaattttataaaaaatatttttgttaaattataaatattagattctgttcattgctgtgaagtaccttcaggtgttgctgtgattgacaataaagtaatgataattccattaacactcggccaaaccagtggagccagaaagggtcaatacttttctaacggttacattgaaaaatactggtggtgaaattggttttgtgattgaagttttgggtctgtcttctgattgactatataaaaaatcatgtagggtgtgtgtgtgtgtgtgtgtgcgtgcatgcgtgcgtgtgtgtgtgtgtgtttatatttaaaaaaatttctccccaatatttgtgctttgtattatgtgattcatcagttaactaaaacttgtaagtttaaaagtatgtatattcaattttcctagtgcacatgaagacattttacattatagagctgaatgaaaagtacttttagggcctagtgctttgcttaattttaatttaattagtggatgccttcttaaaagtagacttcctattctcttcttgtatttccacaatgctatttgttgaacactttctaccagttcagtacttaacactaagtactttctatagatcttgctttttgatccttattaaaatattttgatccttattgcaagattttataatgcatcattatcattttataaatagagaactctatccccagtatttagtacattgatgatatcagtaaatgtttgtggaatggaggggaggttaaaaaaaaacaaaataaaggagatttaggaagttcctgctctagagaggacaggagggaagatggctgaggcctttagttagaggtggaagacctcagtctccatccttccgaggaagctaagttggtgttttgaggtgtggaatatttggatgtgatcagtgaacccctgctatctggagacagatttttctgcctttgcagcattaaaagggattcttataagtccagagtttgagtcagaatatgcttctgtagtaggtaccaaacttcatttgtttagacataatcttaatttgaaagtttcttaggaatatttgtaactaaaaacaaaatctacatgaaacaacagcaaaaaaataagtgaagagtgctttgtcttatttattgattctattttgaaaagcatatagagagtaattttccccccccaccaataatgtttgtataactttgttcacctaaatgctacactttgaaatagtagaacttttgagaccaaaagagtggatcattgcttttaagaatagtgtaacaaaggaaaaaaaccctttgttataataacagcagagaaaaaaatgtgtgggaatgactaagaatcagatgatgggattactgttttgatcttatggtggaaagaaaactctctggctgagatggtggcaggactattagaaaaccaaggcagactagtgctgtactatattattctgttgctataaacctaagtcttattatttcataggcatgtgtatatgtatatattccagagtgctggctatactctgataagttttgttgtttttgagaaaatattttctttatcaccacttcattcatttctaagggttccagtttcaatctacgtatagataaccccctcacagcaccattaattgaatagagtcctttccccaatgcttgcatttgtcagctttgtcagatcagatgattgtaggaaggcagcattatttctgggctctctattctgttccattggtctgtgtgtctgttgtttttgtaccagtatcatgctgttttcgttattgtagccttgtagtatagtttgaagttgggcaatgtgatgcctccagatttgttctttttgtttagaattgctgtggctattcgggcttctttttggttccagatgaattttagaatagtttttttctaattttgtgaagaatatcattggtaatttggtaggaatcacactgaatctgtaaattgcttagggtagtataatcattttaacaatattgattcttcctatccatgagcatggaatgtgtttcaatttgcttgcatcgtctttgatttctttcagtagtgttttgtaattcttattgtagagatctttcactttcctggttacctgtattcctaggtattttttttataggtattgtgaatgggatcgcattcttgatttggcactcagcttgaattttgttcgtgtatagaaatactactgactttcatacattgattttgtatcctgaaactttgctgaagttgtttatcagatctagtagcttttgggcagagactgttgggtttactaggtatgaaatatatcatctgtaaacagatagtttgacttcctgttttttatttggatgcttttatttctttctcttgcctgattgctcttgctaggacttacagtgttatgttgaatatgagtgatgacagtgggcattcttgtctttttctgtttcttaaggggaatacttccagcttttacccattcagtgtgatgttggctgtagctctcactattttgaggtatgttccttcaatgcctagtttgtggaaggtttttaacatgaagcgttattgaattttatcaaaagccttttctgcatctgtcgagatgatcatatggtttatattttcagtctgtttatgtaatgaatcacaattaagtgatttgtgcacattgaaccagccttgcatcccggggagaaagcctccttgatcattgtggattagctttttgatgcactgcttgattcgatttgctactattttgttaaggatttttgcagctatgttcatcaggaatatttgtctgaagttttcttttttcgttgtctgtctgccaggcttttgtatcagagtgatgctggcctcagaatgagttaggggagtccttcctcctcatttttttggggggaatagtttccataggaatggcaccagatcttctttatgcatctagtagaatttgtctgtgaatccatctggtcctgggctttttctagttgttaggctttttattattgattcaattttggaacttggaattagtctcttcaggttttcactttcttcctggttcagtcttggaaggttgtatgtttccaggaattttctatttcttgtaggttttctagtttgtgtctatagaggtattcatagtagtcactgaggatttttttgtatttctttggggttggtggtaatgccccctttgtcatttctgattgtgtttatttgaagctcctctgtttttctttattagtctagctagtggtctatctaccttaattattctttcaaagaaccaacttccactttccttgatcttttgtatgttttttgtgtgtctcaatttcattcagttcagctctgattttggttatttcttctgctagctttggggttggtttgctcttggttccctagttcccctgggtgtgatgttgggttgtcaatttgagttccttctcatttttcgatatggggatttaaacttaactcttaacactgctttagcgatgtctcatagattctagtatgttgtatctttgttctcattagttttaaataatttcttgatttctgtcttaatttcattgtttattcaggagcaagttgttaaattaccatgtaattgtatggttttgagtgatcttcttagtattgatttctatttttattgcactgtgatccaagagtatggttgatatgaatttggtttctttaaatttgttgagcattgttttatggctgattgtgttgtcgattttagagtatgtgccatgtgcatatgagaagaatgttgtttttgggtggagagttctgtagatgaatgtaaagtctgtttgatcaagtgttgagtttagctcttgaatatcttcgttagtttcttgcctcaatgatctaatattgtcagtggggtgttgaagtctctcactattattgtgtggttatctaagtctctttgtaggtctctaagaacttgttttatgaacctaggtgagctcctgtgttggatgcatatatatttaggatagttgagtcttcttgttgaattgaatcctttacccattttataatgggtataataatataatgcccttctttgtctcatttgatcattgttggtttaaagtctgttttgtttgtttgtttgtttttgagacagagtctcgctgtattgcctaggctggagtgtaatggcactatctcggctcactgcaacctctgcctcctgggttcaagggattctcgtgcctcagcctcctgaataactaagattacaggcgtgtgccaccacacctggctaacttttgtatttttagtggagacaaggttttgccatgttggcctggctggtctcaaactcctggcttcaagtgatccacctgcctcagcctccggaagtgctggtattacaggcggaaccacgatgcctggccaagtctgtttcatctgaaattaggatagcaaaccatagtttttttttttgttttccatttgcttggtaggtttttctctatccctttactttgagcctatatattatctccttattttagtgtgaatatatctggcctactatttttattgctgttgtttttaatatagtggatatgttgtaaatgctgatctctaaaagagttctgattttagtttagaaagatttcttggtaaacaaatatttattgagtctgtgtatttcaccaaactagaaaacataaatttgcttgaaaacattagcaaagaaccagtttttaataggtatgaattaaagatgaatgtgctgagggaggcgtatatccaggaagagtgggaataatctagaaagtcttcctgagaaaattacttttgtttcttagccccgtacatatttgttttttgctctaaatttatgtcttatgcattttaacagtaacttcattttctgcattttagcactgttgtcaattacaggatgccggtcccctttccccagcctgcatttttgtttttaagcagtggtatgtgttgtgttgtgtgtgtgtgtgtgtgtgtgtgtgtgtgtgtgtgtgcgcaggtgcgtgcgtgtgtgtgtaagaatatcacactttagacggtattttcacatcagagaactgtgaggctggatgagatcattaaggagaggaggagtacgtagagaagataagttcaagggcagagtgagtttaggggcactccagtgttatgaggttaaggaggtgagatggaaccattacaggagacctgagaggattggctagggaataggagaaaaaccgtaagagtatagagttctggaagtcaagtgtggaaagtgtttcaaggaggaaggtgtgatcaactatgttaaatgctgctgatagatgaggaggaagtattaacaggtttagcaaagtggagattattgatgaccttgacaaaagcatttttgttggtgtggtggaggcaaaggcctgactgaagtggatttaggaaagaatgagaagtgaggaattggaagcactgcatatatattaccggaaaggggtcctgatccagaccccaagagagggttcttagatcttgctcaagaaagaattcggggtgagtccatagagtaaagtgaaagcaagtttattaagtaaaggaataaagaatagctacctactccataggcagagcagccccaagggctgtggcttgcccatttttatggttatttcttgattatatactaaacaaggggtggattattcatgattgccatggtacttgagggagtgtagcagtaaggacaaccaaaggtcacctccgtcactatcttggttttggtgggatttggctggcttctttaccgcatgctgttttatcagcaaggtctttaagacccctgtcttgtgccgacctcttatctcatcctgtgatttagaatgccttaatctcctgggaatgcagcccagcaggtttcagccttattttacccagcccctattcaagatggagttgctctggttcaaacacctctgacatatagacatctctttcagtgaattttgctataaagaagctcagagaaatgaagcactatttggagggattaagatgagagaaataatactttgtttctatgctgattagcgagattgagtagagagggaaaattttatgatgcagtaactggaggagagaattgctggagagattttcttgtgtaaacaagaggagatagagtttaatgagggattttgtttgtttgttttttgtttttttaagatggactcttgctctgtcacccaggctggagtacagtggtcttggcaagatcaagtgcagtgatcttggcccactgcaacctccacctcccgggttcaagtgattctcctgcctcagcctcctgagtagctgggactacagtcgtgtgccaccacgcctggctaatttttttgtatttttagtagagacgaggtttcaccatcttagccagggtagtgtcaatctcctgacctcgtgatccgcctgcctcagccttttaatgtgctaggattacaggcatgagccaccatgcctggcctaatgaggggtatttaatggcaatatggatgatttctccatagtaagagaaagcaaggcagaatatatgtgcacagtgcacacaggttatagttggagagcttgtggaaaatctgtgtttggttctgtatttttgagtgaaacaggaagttagagcatctaggaaattcagggtggagaggatgatacagggtgaagaaagcaaagaaaatatgaaatagtaatctagcagaatgagagagtgtatgaactagagaaatgttgtgtaatatctaggcagtattaagggtctagttgaggtaagcggccatgaattcaaaatgagtccacgctctgtggtggtgttttttttctgtcaactcgttcaactgtgtgggtatggtctggaatagtcagaaagttggctttaagcagctttccgtgttgacaagtaagtactatgaagtaagcaagggcaagggaacgactgtaataacaggcatggagttttaaaagctgggaaaagcgagaagtgagaacatgaaataggtactctggagtgtagtaggaacagtggaggttttggtgaaattgaacaattcgaagtgttggttgggggtactagagaaaaagagctgatggtcagacagtagagtgtttgaaatttaaattagggagtgattgcagttaattggtaatgccagtccggaggatatgatcattgaggtgaatggctgaggtagaatggaagacaagatcattgcggaagaggaattcgattaactgaatggccaaggtgtttaaatgctcatttatgtaaattggaatcagtaagaattacagcagttggcagcactggaaagaattatggtaagcctgaagctaaagtcttaaggagtgagagagagtgacttagagacaggcaaatgatgtcaacaaagagggtggtacatgctgtagtctgatggcatgaggttgaatacttggggtttttagagacagagaggtagaagaatctgaaagtggcagtgagggacaaggcccagttttcaggcctagtggtgggagaggaatattggagagaaaataaaagggcttatttttctgtctgagaaggctgttggggaacagtgtcctcaggtaaaaactaggctttagtaagcataaaaggtaaaaagaccctttaagaagagctagagataaaggtcattttggtgatggctaaccttaaaattcagaaacagaggaatagggagtgaatgggaggtagaatgagaagggggattagaatctggtagttctgactacttgtgagaactgttgaaaatagaggtaaaagtataatgatgttagcccttacagtttttaatgtggatagttgtaagactgtccatgttaaaatgcaaatgatgttgaagggaggaaagggtaaggttgtgcaagggacactcacaatctggggcttccacttcacttttgctaatggtattggagaggctgacagagagatggaaggacagacagtcttacttcctcagagcacatggatttccaatgccctttttaaactcttgctgatggaggctgggggataaggaaatgggttggcctgtctggagcacaaggagctgaataaataaccaattatatgatataccatcgccattttacatagaaagaaactgagattcagagaggtagaacaccctgcccatggtcacatggctactaagtagtagggtaaaagaaaacgaagcagtctttgtggatgaggagtcaaggaacagtaagattctatgagataatatcatattgccatgaactcttatcttcatttactatcagatcttataatatcacatggattcatactgaattctaagtgggggattagattaccaatccatctttctcatgtggaatgcattccttgttttttgttgtccaaaaactttaaaaatatttatgggaaataggcttaaagatacttactgtctctgtagttcattcttaacctgtttccaaatccagttaagctttatctgctccaaggagcattcccttattggtctcaactgaacttcatcctcatgcattgagtttatataataaaaataaatattggggtatacgtttgtgttatagctccccagttagataataagcactttgagggcatttctccttttagttctgtactccttatcagaagcaatatgagttagtcaaaaggagatccaattctgtatctgcttctctctctctctctggctgtgccactaatttgatactatattccaaaccatttacttcacttctctgggcgatactttatctataaataaggggagggatggggtttcactagaatgatctcagaaatcccttacatttttaatattctataactttctgattggctgtgagaatagttggctactaatgcagtacttgcatgtgaaagggacagttttaaaaaatatttggtataattctaggtactgtatagcttagtgtccttgaaaggtgttggcagtagccaagcaggatcagagtgagaaataaggctggagagagagtgtggggccagatagtcaaatgctttgactagtagtgggtatttgtgaatgtgggactgagaagattaaagatagaaggttgaaaatcatttgcacagagatggtaactgaagatgtgggaattcatgatatttcagagagaaattaagaagagagaacagaggcaaggtgagagctttcaagagaatctatatttaggggacaactagaagaaataacttagaaaaggagagagtcaaagcaaagctagtaaattttaatgacaagggaagcttagagagcaaagaattccaggagggaggtagtgatgatagcatcaaataatgcacagaggttaaggaaggtgagaactcagagaaacaaggcccctggttttgttcctgaggtcattaatgacatctagaaaacagcatcagtagagtagttgaaggtagagttcaatttgagtgttattaatgattctcatgtagattcaggtaatcaatattgagttcctactaaatgtctggtattgtgtaagtttatgcatgtgagtgtgtgtgcgtgcacacgcacatgcacacacacacacctctcccaaagtagactggatggggcagaatgatgtgcatgagaggaaggattggctttgaacttaaaaaaaaaaatgttatctacaaaaggaaggaagggtgcgtttggatataggtaagtttattgaaggaagggcaagaagttgaggcagtccgtgcctccataccttaactttttcattcatgtcaaataagtatttctaaaacattatagagactgtgttgacattgtaattaatttatcattttattaatcagtccaatggacttttctctcatttcccttgactgctctgtagtattaggtagtgttaactacttattttgaatagttgcatttgctaagtattaaatcttgttttatatcttgtccctgggctacataattccattttatggatttgatttagctgtcacctagctgtaacctctccatagaatgttaaagctgtatttctgcttgcttaatgaatatatccactttgatgttttgcaagaacctcaagttcaatgttcaatgatatcaaaatctattgaattatttccacataccacatcctagccaaacctgctcgctcttctatattttctatctttgtcattatgtggcctcgttccgttgtctattcagtgatcttactgctctaatacaataacttattaactgacctaagttcctctagaatttttttcccagtggatgctccataacctgagcagaatgtctctgcacatagaactatttgacacttctactcagaaatgtttgatggcttcccattgtcctcagaacataatctggatttttagcatggtatcgaggtttattcacggaacatagcttgaacctttcttgcctccacaaagcccagttacataggtttccccaaatgatctatttatttaagctgttctctgtctggaatgtttttactcttttgctttaccatcaaatcctactaacaagtcactggccagcaaatatgacatctttcaagcttgcctcagcttttcccagtcatatttagtcctttcctcctctgcgctcctgtagtttttttttttttaaccattcttatagcattcatcacaatcagattcatagacagttaaaaaggagtctatctctcccatgaggctataatttgggagcatatataacattgttgtatcacacttatatcttcatagaacactcatatcacactgataagcagtaaatcaacattgcctgaatgaatgaatgaatgaacaaatatatgatcaagtaaaatctaaaatcctttggccttgctaccacctcagtcttaaaaaatttcaagacagaaagcagcagcttctcaaacgacctgttttcttctttactgtctaatttggcacactgatttttcagtcagcaagactggggatcatattttgagtcttccttctcccttgttttcaggtcaagtcagctgctaaattctattctgtttccaaagtgtcccatatgtccactcctattttatttttattgctagtttaggctctcagtaccactgactggaaaagatctcctaatagtcttgtaacagattttccttctcttgtaatctattctttgacttattgttaaaagtcttcctaaagtacagaaactttcagaggtctctcattgcttacagaaatatcaacttattattcagcactttctactctgtaatccaaacctaccttttcaggcttatctctaactgcattataagtacgctgtatgccaataaaagtgatctgccttctccagttgctttaacatgtcttgaatttcctactttgtcctttttcatgctgttcctttgcttagtgaaattgttgagagtattgaacctctttagaatcttctggccaacttcaaatgccacctctttcataaaagcctttctcgagcctctaaattaaaactttatatgaacttttcatatacagcattgttaggtggtctctctccccaatattattgtggatatatttggaaatgttagacatttgaaatagaatcactacttagctacataggtatagtttctggtaaaatcacataatataaacaacacccaagggctctgtttctccaaaccccagggatttgtttctctttctcacacccatttatcatgttctgtttgtgtgtttttttgtgtgtgtgtgtttgtagagacagcgtctcactgttgctgtgcttgtgttaaagtatactagtgaaagttcaccaacaacagcaagggtcatatttatctctgtatttctaggggttcctagatgagtagtatcttacatattgtaggcactaaaaaaggcattggttaaactgagaaatgggataaccaaaataatatgctgctgaagggagatgatcatttatagaatcagaactaagaaaaaaactttttttttttttttttaaaaaccaaccaggccattagtaattatagaaagaacaatttcagggcatcacttgatagtggcagaagctagattccaagagattaagcagtaagtgggcattgagaaatggaggcaatgatgatagacacataagaatggaatacggtctgcagatttgggaagagacttgtgaacaaaaaccatatgtagtatttgaaagaaaaaggagtttgctgtcagaaatgcaagtaccaagattactccaaagtgtttccattttttcaagttggcagaaaagtactccaagtgagtcaggcaggccactgaagcgaataaccagctctagtgtgccgaggtcacaaagttagagtaagtttgtgaatcacagactaagaagacttgtaaacgtaaccttgttgaacgctggcaaaggtgatgtcctggagtcaatagagtttacgttagtctggtccagtttagtctgattaaatcatttagagagaagagttactgaaccaaccgtgtatgtattgttaggaggtctctctctcttaaattattgtggatatattttgaaatgtaggacatttgaaatagaatcactacttagctaaataggtgtagtttctgataaaatcacatgatataaatgaaaatatttaaaggaattgtggctaatatttgttgatagatgtcatttctatttgtaagtaagggtgttgaatttgcacagtgatagtccagagctcctgaaatatatgtagttgttggatttaatttccctttgactccattgtacataaatattctcttaaagactttattgtaagaaacacaatatcggattaattctatttagtctttgtgtctttatatttaagactgtgattacataattaaaatactaaaaaatttcaaatatgaagctattttagcacacatgcatgtgtgcatcgtgtgtgtataaaaaatttattttaattttttagtatttatctgtatattgtgtggatgttacaaaaggcagaatactcatttcagaagccctggaccactttagaactaaaagagatcatcggggccaagattcttaacctttaagtccctaacattgtaagcacttcaggaaatagctctcatgggattttcaaagaggtctatgaccaccaaaaaagttaatcaccaacagtctaattggtacttttcacagagtgacagtgaatggggagtgggaattaagtgacttggccaaggatactgctgttagctagataggactaatcctggtttctcaattcccaactacttctttaaccatcccagtgaaaataacatagtcaaaaaccagttcccactagttttttttttttttttttaaagattgtcattcttttaagacaacctcttaaaagaaatgtttgtctcagtattccaggaagtcttttgatgggaatgggacatgatatatggtatacagaataatatgcacacaataacaactccagaaggaaaactagacttccaccttccctacccatgttttatccctctccctcctttcacagatttcttttttgttttatcttgcatgttctagtgatggcctctgatgcatttaattagaataattcaatcttctgatcattctcattcagtctttcactccttaacaaatatttcctgagtgtctactttataccaagtgctatgctaggtcctaggagtagaatgttgagcaaaaccaacaggatcccttctccttgaagtttgatgtcttaggaagcgtagtcattaatcaagacaggcatggtgtcttgcatctgtaattctagcttcttgggagcctgagcggggaggatcacttgagtccaagaatttgaggctgcacagagctatgattgcactgttgcactccagcctgggtgacagaggaagaccctgcctcaaaaaaaaaaaccaaaaaaacaaaaaaaaatcattaatcaaacatttgcaaagatacgtaagaagagactggttgtaagtgaaaagaatgaaaagcacaaagtgctatgagagtggctatgggagcactggttttgtctggggcatctgattggattttcccaaggaggtgatatttcagttgagaggagtttggcagaaccatgctccctgcagaggggctagctaatttcagaatctcaaagaaggctagtgtggttgaactggggagagcaaggggagagggagatacaaagaggaactggagaaggaggcaaggattagattatgtagcaacttgaggctgtggtaaggtattgatctttatcttgagagcagtagggagccactgaaggattttaagaaggggaatgacatgggttgtttccactttttggctattgtgaataatgctgctatgaacattcatgtacatattcatgtacattcatgtgtttttaatatatattttgtttttctctggtaaataatcgtgggtttttttgtgtgtggaaaaatattttcatttctcttgggtttatttttaggagtagaattgctgggtcatagggtaattgtgtgtttcaccttttaaggaactaccagactgtcttccaaagtggctataccattttacattcccacaagcagtgcctgagtgttctgattattccacatctttgccaacacctgctattgtctgtttttaaaaaaattttattatagacagtatagtgtgagtgaagtgatatctcattgtatgccccttgccttttattagccaggcttttaagcctggcatttagatttcagcaaattacagccttttatctgtttagtttgaataaactacctatttacaaaatatgccttgtagtttctcaagccctttatttttactttttttccctttgtgtgtgtgtgatttccaaagccttgatctgattcattcactcattaaaggcccaacctcagtgtcttctgtttccttcattagcacatggagccatctgaaatagttgatatttggccatctgacctataaaaacagcaatttcaaatggttcaacttaatacatttcttggcttcctctagtcataactattaccattccttcgggtttttttttttttctcctggcccttgtttgtacctctcatggtattatgaatgcttgtgtggtataatgtctcttatgggtcagaaatctgaagtgcagaggctgtttcataacccaatgttttgtatatagaaagggcgtggtaataaaatttttttgcaggaagaaaagaacatgaaaattgtttcttcatgaaattatcttgtataattggagtgtctgtcagtgggagtaaacagttttgggaaatgtaatgtagaaaacagtaacaggcaaaaggagcattcgatttttactcatattttctcagagaaaagttattattggtgatgtaatcatgtaccctcttcccttggtactgtcttcttctttttagtcctttttaggacttaagagttttctttatgtagaagaaaagtaattttaagcagtcaatttcaaattggagttctttttcttcaaaatttcaagaaactcttttgaaaactttaatcttctatgatagtttcacttttaaactgcatttgcaatgccaagacacatgcttccatagtgggaataatatttatttttctaatacttcaaacataatgccatccacgagacgtaagttcttattttgtaaacattaggccactaattatagttcttgccttcgaacttttgccgttataattttatttatgtaactaacctgacttgagggataatatgtgtacagtaacactcagttgtcataaataataatagctacatatgccacgtattcttctttcagtgttttacgtgttttattttgagaaggttgtttgctcacagaagattgtagtaaagaaagaatcttgaaatagtaaataataactatgtggggagaggagcttttaggtgagtaaatgcaatataatgttacaggtattatgatagaaatatgtacagtgtacagtaaaagaagcagtaggtatgtctacaagatagatgggacaaagagggcatggaagattataaaggacattagaggcagatacaatagggttatcaaaggcacagaggcatgaaatggctacagaacttaagaaatctgcaagccattcccagtggttccagatgagtaaaaactacagctggatatgtagaacaagggccagatcgtggaaaactgagtgttatgctgaggggttttggcttgattctgtaggcagtgaggaatcaatgaagatttaagcaagggattgatatgatcagatttaggttttggaaagatcactttggttttggtttgggatgatatattggatgagtaggagaaaagagacaagttatttgcactagtccagagaagtggtgttaggatggtaaaaagtaggatagagagaagatatacccaagggatggtagggaagtagactgtacaggactttggatagattggatgtgatagctgtgtgggagaagaggatggttatggtttaaaaaagtcacttggggaatgggagaatcattgagcactgtgttgggcctagctgatgtttctaatcgtaagtcctaagtggccccagtttgaagatttccttcactagtagccaagaaagatggttatgttggtccacatttagggattagcaggacagtcgtggctaatggatacggatataaggacactgatggttaggaagggaagcgaagtgggcaaaggagagcaatgaatcatgaaggataataaaaaatggaggggttgagggtctgggtgtctctactaggttgaagatgagatgaagggaaagttaagaaagttaaatatttagaaagggttggcatctagtcaaagattaatttcctcaagtttaagattatagtggcagggtaattcccagaagtgataaagtccaaggtgtaatgacaagatgcacattgctgaagtgggaatgtgtatgaggttatgtaggaattgaggaattttgagctaggttgttgacagtttatctttatggataataaaattcccataatgatggcagctttggagtagaaagaaatgctagagaggaaagtgagccagatgagaaaacccttagtgagtgaggaggatgggtgggtggatgatagtaacaaggaggttgtatactgaaaagccataaaccttagaggaagaaggtttttatatgtgaagatgcaaaactaatagtaatgtagaagcctgagagttcagctgggaaaatgcttgtttcatctttgggcgttgttacatgtgggaaaagaaaagagtctcttattaaagtctgcagggaagtggattcctgtgaggagaggttagttgaggcagaggtgaaggggagaatcctgttgaagatgtaggggagtttattcactgtggactaaaacattcagataaagattaggaagagaattagtagttgaagaaaggcttggacagagaaaagtgggtgtaggaaacacaaagtaatatggtaatgaacatatgcgacagagtgttgactagaagttttagcatttggaacaaaggcccaggttgacaaggaaaacaggaatgtttggatggactgagatgaagtatataggcctaggaaatctggggaccaaaatggtatcggttacttaatgaggttagagactgcagtttctacttcaagttcaaatgccttgctaattacaagattcttattatttggagtttgtaattttaaaaagaggtggccatgtaactgaagttctctagtctaatgtgggaagtgttaagtgcagttatagacaaagtctatgaaagtgtagaagactgagagtttagttccaactggaagaccttcttggaacactccaagacttcttggagaagttagttttttaaaccaggtcttaaagggtaggtaggatgttattaaatagattagggtaaaggaacattctattttggaaaggcctgaagcagaggcatgaattttgggaaatacagagcttgtttgtggaacagttcataaaaaataaacatagagagcttgacttcaagatgagcaagggagaaatggaaaaaaagcagtggaaattagcgtgtgttataccagtagccatggtgactacaagcatgcacagagccagtatgacagaagaacacaaacaactacagaaaagagaactatgcatcctactgtgcccacggccaccttcagtctgagtagctgctaaaggcagcactttacgtttataccagaagttttaacagttctgctgcacctgcatgcttacttgctctctcatgctctctctgtctccctctctccctctatcctgtgcactctctctccctccctctctccccctttctctctctctgtgtgtgtgtgtgtttctgccgtaatcacaagaacagtactatgatgtattcccacactgtacccctccagttcaatatttgcctggagagtaaaaccctttgtagactggttatacagaaatatacattagtgcttattaaactataacactgtggatcataatatctacctatgtttatgtgtgtctgaagagaagttaataattaaaggctgtttaccacacttttgctagaaagactgattctttgaatctgagactgcaaagtataagttgcagtacctggatttgttattttctctctcttagatttatttactttatacttgggctctaaagagccatttggtttctttctttctttcttttttttttttggtgagagtcttgctctgttgcccaggctggagtgcagtggtatgatctcagctcactgcaacctctacctgccaggttcaaatgattctcatgcttcagcctcccgagtagctgggactacaggcatgtgccaccactcctggctaatttttgtatttttagtagagagggagtttcaccatgttgcccaggctggttttgaactcctgggctgaagtgatccaccctccttggccttccaaagtgctgggattacaggcgtgagccactacacccaaccagagagctgtttggtttcttggtgctacatgctacaatagtctgtcaatattatttttctagataatacactctccataatttcaagttatattcaattgcctttaagagtttttctcccagaagggcataggcgtataaaatagcattatacatttgaacttgccccagatagactttatgagatgttgattgctatattgtgtttgactgtctagaacagactctattacagtgatttaaaaaatttaagttcatttattttatttaaaaaattttaattttatttaatttttcgagatgagttcttggcatgttgcccaggctggtctcaaactcctgggctcaagtgatccttctgcttcagcctcttgagcatcttggactacaggcacacacagctgtgctcacccatttatgttacataacaagaattccagaggtagagagttgttggctcagtgatgctacaagaacctatgctcatcctattctttggctccttgtcctcagcaggccagcacattgctaatgtttataagatggctcttgtattttcaaactttatattcttattttaggcaagagaaatgggaaaggacaaagactaccctgctgtttctgctcccctttattgagaaaataaaaggtttctatagccattagcagatttcccactaaatcccactgactggaattgactcacgtggctctcctagccacaaggaagagaatagcaagcctcttgtcttcggcagggcacaaactaccctgatcaaagttagggagaaaggggaatctatttgaaggagggagctaacaatgtctgtcaaagtactgtgcttaaaatttggttattttgcctgttattttaaggcaaatgacatttaatcagaatttagatacaaaaaaaaggaaaacatcacagcctatcactttttctttccttacattataaaactatgtaatataatttcttatgactgcttttttgtataatagtataggttgttggaaatactatgttgtgtttgcactggaatgccacttttcattcatttaaatgaagtgacaatttcttttttggggaggtgattttcacattgtataagtaatttagttattcttgttataggcaggtttgtaatgaataaatgggattcattttaaagctaaatggttcttaatattatcacaactcaaaggtgaagtatttcatcaaaatctagtgaaaaaaattttgcattctggtataaggaagacttttaatatgttttagaaaaatacatttttgaaaatctgaactttaacacccaattcaaagtatttgaggtttttctaccattgatcttaccttaaataattttaactttgttttactgataagaggaaatgatatcagttattcaatttgtggcatattgtcacagatttttaaatttaacaaacataatacatgttaacagtgtacacaggtcctgaagtagattttgtggaaaataaaaaagaagtgggcttgagcacggtagcccatgcatgaaatcccgacactttgggaggctgagtgagaggatcgtttgaggccaggagtttgaggagaacagcctggataacatagtgagacctcatttctcccccgcccccctccccccccaaaaaagacataatttttgttcttggggcactagttggtgagacaaaataaacaataaaagcgtgatcaggtatcgaaagtttggccaggcgcagtggctcacacctgtaatcccagcactttgggaggccgaagcgggcacatcagttgaggtcaggagttcaagaccagcctggccaacatggtgaaacctcgtctctacaaaaatacaaaaattagccaggtatgggggcaggtgcctgtaatcccagctactcaggagtctgagacaggagaatcgcttgaacctgggaggcggaggttgcagtgaccggagatcgcaccattgcactccagcctgggtgacaagagtgaaactctgtctcagaaaaaaaaaaaaaaagttctataggaatttaagaaagtaaaagtaactgtagagtgattacttataatggaagaagtagatacttcaggcagggttgtttgatgtggtgggaaggtacaaggtacaaagaacttctctttccatcctcatctgctcttttatccattcacccttattcaactatttgtagtatctgagatgttctgtagactttgatacttctatacctttgcattgccttttgtttgttcttgaaatttccttgtttgttggtctgataatctcctatcttttgagactcagtttgaatatcatctcctctgagaagtcttccctgaactttctggccagaattggctgcttccttttcttttctcccatagatatttgtatgtatgtggggtgtttgtgtgtgtgtgtgtatgtgtttctatttagagtcataacactgcaccactttatttacttgtctgtgtcacaggcttgtgagcttcatgaacatggggatgatgtcatatttattttcaaatcacagtgcctggtgtagtggttttgtacattggaccactcaatgaatgttctttggatgaatgaatggatgggtgaatggataaaaagaaggaattagcctggagtgtcttcatgagtattgggagtctatccagagggaacttggatcataagaatacttgacccagcaggaatagtttgtaatttgttaagacttagagataagattgaataggcaaagcagaacttagttggctgtggaaattttaataaatattggagttatattaaatacaatgtctgaaattggtctttgaagcccccatttttccaacatactgtacttttgtattttgtagtgcctccacttctcattcagagaattcagtgcatacaaaatcagcttctgttgtatcatcagattccatttcaacttctgccgacaacttttctcctgatttgagggtatgtatactattttaaagttctgatgaagtactttctgttaaatatttgtggccaacactatcaatataactaatttagcaggagatactgatggagtattctcatagatcccggtctacaaaatatcccagaataggccagcaaatttggaatgcttacttatttgtaaaagaaaaatgtgtaattcatctctgaggttgatcacctctaagttctttgccaaaagatgattaatgaattttttgtggtataaaagatttttatgattattctcataataaccagtaatagctaacatttattgaatatgtactgtgtgccaagcgttgttctaagtgctatacatgaattatctcttgtaaaactctgaccaattctgtcaccattctacagatgataataacttgtagagattaagtaatatgtccaagatctcatagctaataaattctattgccggtgttccagcccatgcagtccagttcgggagctaagtcacttaaacactgtgtgatagttcctacacatctcattatagtttgtaagtattcctctatttattaaaggtctcgtttctatgaaattaaccacattagtgatatcctgtagcactctgtacatttctggatttatctacttttctataactgcttgtctatgaatgattgagaaaatgaattatatgtgtagtgctaaccctttaactttacttcataatcgttttttttttctccaaaaaacacgaaacaataaacatttatttctcatggttctggaagctgggaagtccaagatcaaggtgctggcaaatccattatctgatgagggtatgtcttcttgtatcctcacctgatggacagtatgtcagaatctttttattccaaacatgtggctgctttctcactggttacacttacacaattttagctaaaacattgttttccttaaggaagtcatttgctgttgagcataagttgaggatacttatatctttttcatccatttcattgtcaaaacagaattcaacaagaagacaacatctgtaaaatcttctgcatatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactctgtctcaaaaaaaaaaaaaacaacacaaaataattatgtcttttatgtctttgttttagatatcttatgtacatgtatatgataaaggatatgttttgttcttaaccatctgtcttgtcttgaagtatgtaataggcttaaatcaggcaaacgtgtctgtcttcaaaatctgtgttatgcatatttcctttgcaaactaaaggccagaaattattttattttattttattttattttattttagagggagtctcgctctatcccctaggctggagtgcattggcgccatctcggctcatttgcaacctctgtctcccgggttcaagcgattctcctgcctcagcttcccgaggagctgggattacaggtgcgtgccaccacgcctggctaattttttgtatttttagtagagacggggtttcaccgtgttagccaggatgaccttgatcttctgatctcatgatccgcccacctcggcccccccgagagtgttgggattacaggcgtgagccaccgcgcctggccaattggattattagactatgtccatgaatgtgatattgacatgtactgaaaatatgcagatctatttagaatgagttaaggagtctcatagagcttatgttagatagtaaacagtgtctatcacataatgattattttaatagagaagaaatgattattagcatttatttatgattagcaccacgacctcccttaccaacaatatcaactcttaagaacctaggaattgaaaaaaatcaaccttagcccgataaagggtatccatcagaactctacaataagcctcatacttaatgatgaaatactagaaatacgttcattaagcttagaaacatgatgattactatcgctacttttattcagcattatgctggaaaccctagccagtaaaataagaaaaataataaatgatacaagaaatgaaaggaataaacaaaactttcattatttatagaggattgtctgtatgggaaatctgagaaaatctatatacaaactaccagaactaattgtatagcttaccactgttgccggatacaagataacataaaaagatcatgcttttgtaccttagcaaaaatgtttagaaaatgtgatttaaagaagatcccagttacaacagcaacaaaagtaccttacttaggaataagttaaaacgagatatagaagaactttatgaagaaagttataaaactttattaaagaagctaaaaggatatctaaataaatggatgggtaaatcaatagtctggaggtgtaaaatattttcaaatatatctgttaattgaatataattccaaaaaaattcaaaagtttgttttgcagaacttggcaaaattttagctgactctaaaatttatatgcaagggtaaaaggtcaagattaacccagaggaaaaataaagtggggagattcacccaatcaggcataagctaaagtaaatcagaataggaataaatcagtcaagtttagaaacagactgatgtttgtaggaactctgtatatgacagatgtataacaaatcagtgggagaaagaatgaactatttggtaatcaatgctaggttggccatgtttaaaaaaaaaaaggttgaatttctaactcacacacaccaactggattcattagattgaaaacctaaaactgaaaataagaactttaaaattttagaagaaaatatatgacaatatcattatgacttacgatatcaggaagaatatttaaaataagactctaaggtattaacttttaaagaaaagattattattttgattgtgctaaaatttaccaactttatgtgacaaattccgtatgtgaagactgtgaaaagacaggtcacattttgggatagtagacttgcaaagaatatgtgtaactgataaaagattagtacccaaatatgcaaagaacatctacaaattaataagagaaaatgcaacccaacagaaagttgagaaagtctatgaacaagaaattcaaggaaaaatatatacataatgtttaaccaatatattttaaaatgttaaacctcactataatcagggaatcagggatatgtcatttttaaagcaactgagaaaacttatttcacattcatcagatcaaaacaattaacaagtctgataataccaaggattgtttgaaaagtggggcagtgggaattctcatacagtgctgaaacagccacagtagagagaaatatagcaatatctacaaatgctcattcttcttagcagttccagttttactaatgtagaaagtcccacatttattccaggagactggaataaagatcttaattgtacattatttgtgtacgtgataaatgtacatcatttgatcattaataaattgtggtatattctatgacagaatggtatctatctagctaagtaaatttcaataaacaaaacatactatatattgattatagacatatatgcagttgagaaaatacaagctcctcctaaaacacacgagtaatgtattgagtatcttacagtttctctcttgcttcaccacatcaccaaaggcctgtttacctcagttctttttacctagtaccttttacatgtctgacttccaagaaaaaattacaaggcacactaaaaggcaaaatttatatataagaattatagctttctattataaaaatacttataaaatataagagaaaaattctataataactaaaaatgtaaaatatctaggaataaacttaaatatgcagaaaatatgtgaagaaactttaaaactctgctgagtggtaaagatgaatacttaaacagaaaaacataccttgatttgaacagaaaagctcagtatttttaagattttaatttttgcttattctataaataatatggttaaaatttgacaagataatcctgaagtttgtaatgacaagtctggagacaatataaatgcctttcagtggggaggatgattttaagtttatttatatgtttactattgaatatgtgcagtctgaaatgaatggtgcatctccatttgtttttcaagatagattaaaaatccaaggacagaagaacattgtgaataataagctcccatttgttggcgatagtaggtggagtgatagaagaggctgtgggtacataaacaggtgatactagtcaagagcaggtcaaatggaaagaatgaagacatgtttggaggctactggaataattccaagtaaaagttgctaaaggacatgtactaggataatgacataatgctttgtaaaaaacaaatctgaaaaaattataggtgaatgtaatgtacacaaagctatctgaacattgcagattatgggaagagaggagtcaaagatgatgattccaggtttcaaatctggtgacaatatgtggttcatttctcatctgccctcccctcctatgtgtactttgctgttccttctcttataagtggggtaatgctaaagttttcttcatcccttgctttccccactctctttcttccacattctctttcttcttcgtggtttcagctgtcatctctttttggatgactcccacatttttacctctggttctgatctctttctcagcctctggtccttcatatcccttgcttgcttgggatgttatcatgttatgatcatggtcttagtgtaatcagacatctgttcaattccagccactgttgggagatatatgtcaccttggaaaagttccttaacttctataagggtcaatgaccccatttataaatgggcatatgaatactacttatctttcaagggtgttaagagcactgaatgaataatgatcttctaaaaacagtacataaactgggctcattctccttggtatgaggtgaaatgaaagaaatttagataatattatatctattcacctatcttctgtctttcttgtttttggcatataatctattatgaaccatcatttattggaaaggactgtctgaagtatagctcagaaggacacatcagaaggtgtggggctcgtccttatggatggagaagtggggctatattggtgtggggaatgaaaggatgagacaggacaaaatgtagaaatagattaaatatgagagtcaaggaagcattaaattatgacttagctgatgtatagaataatatgttaccctttagagatacaggattttttgtagaagtttttgcagaaaagtgaaggaattgatatttattacgttgactgtaccttgtgtggtgcatttgttgcaactgatgaaacgatactgatacatttttatattaatactaaaatacatagtttgcattagggttcatactttgtggtgtacattctgcgggttttgacgaaggtatggtggcatatattcattgttactgtatcatgtagaatagttttagtgccctaaaaatcccctttgcgtcacctctttcattttcccctctccctgaacaccaggcaatcactaatctttttctgtgtccacatttttgccttttccagaatgtcatgtagttagaatcatctagtgtgcggtcttttcagagtggcttctttcacttagtaatatccttttaagattcctcaagtctttccatggcttgatagctaatttctttttattactgaatgatattcctttgtatgacgtaccacaattcatttatccattctcctgctgaaggtcagattgcttctaagttttcatagttatgaaaacttgtattttaagattaaaatctggaagtttttattgatattaggcattcgtttcttagggctgctataataacagagtaccacaaactgggtagcttaaaacaacagaaatttattctttcatagttctggagcctagacatcagaaatcaaggtgttagcagggttggcacctgccaaccaagagagctttgagggagaatctattccatacctttctcctagctgctcatgagggttagccatctttgatgttccttggattgtaaatgcatcagtccaatctctgcttccctcttcatggggcattctccctgtttcttcacattgctgtcttcttgtgaggataccagtcatattgaattaggggcccaccctacaccagtatgacctcatcttaactaattatatctgcaacaaccctatttccaaattaggtcacattctaaggcactggtggttagacttcaacaacgttattagagggcacagttcaacccatagcatgaagtgatgnnnnnnnnnnnnnnnnnnnnaaaaaaaaaaaaaaaaaaaaaaaaaaaaaagggcttccctgtgcttgatcttgaatgtactttgaaatgtgtaaccactaagatctatcccagatgccagtctgtggctctaccttgttagaatttttgtttgcatggttcatttggccacttcgtggcttgtcagtcaagttgtagagaaaatagaataaagtataattgatataaacagttttctttagaaggattatccaacaaaaaataagttactaagaaaatcctttttttctcttctgggttttagtacagtatgtaaaaagactgtggaggatagtttataactgtatagactcatttttccctttcaggtgattattatttagtgttttgcagatttcagacaaattctttcctatttttctaccatctaaccattccatgtgaaaactgacttaaacttgccaacttctagatcgagtttatagtaatttcctaattgtgtgtgtgtgagagagtgcatttttgtgtttgtgtgcctgtgtgtgtgagaaagagagagggagagaagagaaagggagggagtgaaaaaagaagttaaagtcacatggaaaattactgggcagtttgaaaataatttgatgaagtgggcatggaagaaaatcagggctgggaagggaggaatactaaactgattatgtagtaggaataaaaaaaattataaatttgaatcttgtgtgttttgaagtaagagttttaataagattatcagacttttcttgataataaaaggattaaatattgtattaaatgctatcaaatagcacattttatggaatcttacctattgatgtggccagagctccagagtcaggcagggttctgatgcatctcatagaaaacaggttggctagccagttagtaacattattttgacccaataagagaaagtgcttgatgtattctagaggatttctccaggagtgaattttcttccctcatatctgagggttatgtaacttattctccactaaagatatttacatgtgaaggcagaaaaacctaatggaccagagtggctttggtctcttggttcccaaccaccattttaagaagataggttcggaagctcaaactgggtggagcccaccgcagctcaaggaggcctgcctgcctctgaagactccacctctgggggcagggcatagccaaacaaaaggcagcagaaacctctgcagacttaaatgtccctgtctgacagctttgaagagagtagtggttctcccagcacgcagctggagatctgagaatggacaaactgcctcctcaagtgggtctctgaccccagagtagcctaactgggaggcatcccccagtaggggcagactgacacctcacatggccgggtacttctctgagacaaaacttccagaggaacgatcaggcagcaacatttgctgttcaccaatatctactgttctgcagactccgctgctgatacccaggcaaagagggtctagagtggacctccagcaaactccaacagacctgcagctgagggtcctgactgttagaaggaaaactaacaaacagaaaggacatccacaccaaaaccccatctgtatgtcaccatcatcaaagaccaaaggtagataaaaccacaaagatggggaaaaaacagagcagaaaaactggaaactctaaaagtcagaagagcacctctcctcctccagaggaacgcagctcctcaccaacaacggaacgaagctggacagagaatgactttgacgagttgagagaagaaggcttcagacgatcaaactactctgagctaaaggaggaacttcaaacccatggcaaagaagttaaaaaccttgaaaaaaaaattagacgaatggctaactagaataaccaatgcagtgaagtcctgaaaggacctgatggagctgaaaaccgtggcatgagaactacgtgacgaatgcacaagcctcagtagctgattcgatcaactggaataaagggtatcagtgatggaagatcaaatgaatgaaatgaagcgagaagagaagtttagagaaaaaagaatgaaaagaaatgaacaaagcctccaagaaatatgggactatgtgaaaagaccaaatctatgtctgattggtgtacctgaaagtgacggggagaatggaaccaagttggaaaacattctgcaggatattatccaggagaacttccccaatctagcaaggcaggccaacattcaaattcaggaaatacagagaatgccacaaagatactcctcgagaagagcaactccaagacacgtaattgtcagattcaccaaagttgaaatgaaggaaaaaatgttaagggcagccagagagaaaggtcaggttatccacaaagggaagcccatcagactaacagctgatctctcggcagaaactctacaagccagaagagagtgggggccaatattcaacattcttaaagaaaagaattttcaacccagaatttcatatccagccaaactaagctccataagtgaaggagaaataaaatcctttacagacaagcaaatgctgagagatttttgtcaccgccaggcctgccctacaagcgctcctgaaggaaacactaaacagggaaaggaacaactggtaccagccactgcaaaaacatgccaaattgtaaagaccattgaggctaggaagaaaaagcatcaactaacgagcaaaataaccagctaacatcataatgacaggatcaaattcacacataacaatattaagcttaaatgtaaacaggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagacacaaagaggccattacataatggtaaagggatcaattcaacaagaagagctaactatcctaaatatatatgcacctaatacaggagcacccagattcataaagcaagtccttagagacctacaaagagactcagactcccacacaataataatgggagactttaacaccccactgtcaatattagacagatcagtgagacagaaagttaacaaggatatccaggaattgaactcagctctgcaccaagcagacctaatagacatctacagaactctccaccccaaatcaacagaatatacattcttttcagcaccacaccacacttgttccaaaactgaccacatagttggaagtaaagcactcctcagcaaatgtaaaacaagagaaattataacaaactgtctctcagaccacagtgcaatcaaactagaactcaggattaagaaactcactcaaaaccactcaactacatggaaactgaacaacctgctcctgaatgactattgggtacataacaaaatgaaggcagaaataaagatgttctttgaaaccaatgagaacaaagacacaacataccagaatctctgggacacattcaaagcagtgtgtagagggaaatttatagcactaaatgcccacaagagaaagtggaaagatctaaaattgacaccctaacatcacaattaaaagaactagagaagcaagagcaaacattcaaaagctagcagaaggcaagaagtaactaagatcagagcagaactgaaggagatagagacacaaaaaacccttcaaaaaatcagtgaatccaggagctggttttttgaaaagatcaaaattggtagaccgctagaacaaagaagaaaagagagaagaatcaaatagatgcaataaaaaatgataaagggaagatcaccaccgatcccacagaaatacaaactaccatcagagaatactataaacacctctatgcaaataaactagaaaatctagaagaaatggataaattcctcgacacatacactctcccaaggctaaaccaggaagaagttgaatccctgaatagaccaataacaggctctgaaattgaggcaataattaatagcttaccaaccaaaaaaagtccaggaccagatggattcacagcccagaagtacaaggaggaactggtaccattccttctgaaactattccaatcaatagaaaaagagggactcctccctaactcatttgatgaggccagcatcatcctgataccaaaacctggcagagacacaacaaaaaaagagaattttagaccagtattcctgatgaacattgatgcaaaaatcctcaataaaatactggcaaaccgaatccagcagcacatcaaaaagcttatccaccatgatcaagtgggatgtacatccctgggatgtaaggctggttcaacatacacaaatcaataaacgtaatccagcatataaacagaatcaatgacaaaaaccacatgattatctcaatggatgcagaaaaggcctttgacaaaattcaacaacgcttcatgctaaaaactctcaatacattaggtattgatgggacgtatctcaaaataataagagctatctatgacaaacccacagccagtatcatactgaatgggcaaaaactggaagcattccctttgaaaactggcacaagacagggatgccctctctcaccactcctattcaacatagtgttggaagttctggccagggcaatcaggcaggagaaggaaataaagtgtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatatgcaaaaatcacaagcattcttatacaccaataacagacaaacagccaaatcatgaactcccattcacagttgcttcaaagagaataaaatatctaggaatccaacttacaagggacgtgaaggacctcttcaaggagaactacaaaccactgctcaatgaaataaaagaggatacaaacaaatggatgaacattccatgctcatgggtaggaagaatcaatatcgtgaaaatggccatactacccaaggtaatttatagattcaatgccatccccatcaagctgccaatgactttcttcacagaattggaaaaaactactttaaagttcatatggaaccaaaaaagagcccgccttgccaagtcaatcctaagccaaaagaacaaagctggaggcatcacacatatctacaactatctgatctttgacaaacctgacaaaaacaagaaatggggaaaggattccctatttaataaacagtgctgggaaaactggctagccatatgtagaaagctgaaactggatcccttccttacaccttatacaaaaattaattcaagatggattaaagacttaaatgttaggcctaaaaccataaaaaccctagaagaaaacctaggcaataccattcaggacataggcatggtcaaggacttcatgtctaaaacagcaaaagcaatggcaacaaaagccaaaattgacaaattgcatctaattaaactaaagagcttctgcacagcaaaagaaactaccatcagagtgaacaggcaacctgcagaatgggagaaaatttttgcaatctactcatctgacaaaggcctaatatccagaatctacaatgaactcaaacaaatttacaagaaaaaacaaccccatcaaaaagtgggtgaaagatataaacagatacttctcaaaaggagacatttatgcagccaaaagacacatgaaaaaatgctcatcatcactggccatcagagaaatgcaaatgaaaaccacaatgagataccatctcacaccagttagaatggcgatcattaaaaagtcaggaaacaacaggtgctggagaggatgtggagaaataggaacacttttacactgttggtggggactgtaaactagttcaaccattgtggaagtcagtgtggcgattcctcagggatctagaactagaaataccatttgacccagccatcccattactgggtatatacccaagggattataaatcacgctgctataaacacacatgcacacgttatgtttattgtggcactattcacaatagcaaagacttggaaccaacccaaatgtccaacaatgatagattggattcagaaaatgtggcacatatacaccatggaatactatgcagccataaaaaatgatgagtttgtgtcctttgtaggggcatggatgaagctggaaaccatcattctcaggaaactatcacaaggacaaaacaccaaacaccgcatgttctcactcataggtgggaattggacaatgagaacacatggacacaggaaggggagcatcacacaccagggcctgttgtggggtgggggaaggggggagggatagcattaggagatatacctaatgttaaatgacgagttaatgggtgcaacacactaacatggcacatgtatacatatgtaacaaacctgcacattgtgcacatgtaccctgaaacttaaagtataataaaaaaaaaaagaaaaagaaaaaaagaaccttaaaaaaaaaaaagaagataggttcctggtgtttttgagttgcctctcttgttttgacctcacttcatttattcattgaatctgctttctctcttctcccattgctgacatatctgagatgcaattcctctcaagtaaaaatcatcaagtattattcatataattgcttctatttgttttataagcctagggtcagatttgatcacttttccaatgtatcatattcctctttatttctattaccatagactaatccaggattctatttctttcgtagattatcatcatttcatcttcttccttttcatttctttgccctccttgaccatgccatctgcccctatcaaaggcctgcagtgttttgtttttttttacatgactggtcaagtttaaagtccttaacttctccccagtattttattataaaaatttctgaacacaaaataaagtttacaaaggaccctgctgtatccaccatcagaatttttccattaacgttttaccctacttccttgtttttatctgacatccatcatctgtgtgtccctctatccatctatttatctggcttactttttgatgcatttcaaagtaaattgcagacattagtagttttccaactaaatatgtcagcatgcaaataaatatatgtaatttttcttttgatataaaatttatatctattgaaatacagaaatcttaagtgtacattctatgagtttagaaaaatgcatacacctgtacaacccaaatccctgtcaagatatagaacttgtcaccccagatactttcatcatgccccttttcagtccacactctcattctcatccccatagcaacaactgttttgaagtttttgtactatagtttagtctgttgcagaatttcatataaatggacccatacgatatggactgtcttgctgaaggcatcttgaaacccttcactaggataccctaaacttttactccatttttatttctcaagccatctcctttattctctcaggtagacattattccattaattttcctaagttgtgtcagactctttggaatattgcagctgtcttcagtcctcataagaaatgaaagaaagggaaaagatttgctgctttccttacaacagtgagatgcttactattctgtagctaaatctagaatatagtagttaggagtcagggagagattgatttatggttccctatatgacatgctttctcaaatattaatccctttgatgagtattagagaaagtgtgtcatatagggaatctctagagcagagaaaaaagcaccatgtcaataggccattttggtaaaaggcggtgaaaacttctgttgatgcttctattacgtgaataataagtacagatgctcctcgacctatgatggggttacatccagataaacccattgtaagttgaaaataccataagttgaaccactgtaagtcagggactgtctgtatttttttttttttcattttcatggtgttttgcaaatctctttatggtgcagttatcttgatttcatagttgctaacttttaaggtgggtattaatatcatgttaataacatgaatggtgaaactaagactcagagcgtagtatggtggtagtgaatgtggagtttttttaggggttcttaggatatgaaacataaggttttgcagtacaccacaaatcccttgtatattttaattttgattttccctttttagctgaatcacagtttaagatatttttttctttttctttttttttttctaaaaagtatttctgggttgtattttctgagacctggctatctgagaatgacttcctgctgccattaaatactttttgggagcattttccttcacagctttgatcacattttgttattgtcttgtagaatatggtattatagataaccttgaagctaacttgattttgctttcttcaaaggtaattttttttccacctatattcttacagtttatattttaattcttttagttcaaaaaaatttgccaagatgcaactaggtatgtctctgttcattgattttgggtggaacatggtaaactcttctgatcaacatcaattatatattggactttttgctcctcttgattattttttttttcctttagaaaatacaattcttttcttgattattttccatgatgattttatctttgttcttttccttcaaattcttacagcacttttcaagtttgtcctcaacattaaatctgttttctgaataaccaatgcaatttgttgctaattgcatacagattttatttctgctattacatttttaaatgtccttgcagtcattctcattcatttctcttgtttcattgtgtctctctccttatgactttctgtttctactctatttcttttttttctttttctttttcttccttttttttttttttttttttttttagcacagggtctcactcccattgcctaggctggagtgcagtggagtgcatcacagctcactgaagccttgacttctggggctcaaggtagtcctctcatcacagcctcccaagtagctgagactgtagacccgtgatgccatgcctgcccagctgattttttgcatttatagtagacacagggttttgccgtgttgtccaggctggtcttgaattcctggtttcaagcagtccactcgcctcggcctcctaggatgctgagagcataggctgagccactgcgcctggccttctctttgtgtttattagaaaatatggcttatttccttttgagtgtgccaagtaccttatacatgcttttacaaatgcctatagagaattattttcagaagactgctttcttttttaaagtttcgggttgatattctcttttctttgtaagtctttttttttttttctaggccttttttttcctagtctcttttctcctgtttgattaaggatagatttgtctagaatcagtgtttgtcaacaaacacagggtctagattgccccatccctgttctgttcacttgagtgctagttggagttccttttcctatctccagtgtagaattagttgtttatatacaacctttagcataagcctattgttaaaagtctgtcatctagagcagctctgctggacaaagataggatcttgtattgcttcttttcattgcctcgctctttgacattctggtcagagagaatataagaaagcctatgtgtggttctcaaagtgtgctgcttgcatgagttttcctgtctcttttctcactttatgaagctttaggaggattgtgtctcccatgtttctgtgtgcctttgccagaactaccctcttctcttctgtacataacataaatattttccgggggttgctggtcctttctgaatgtagaaatgtagagaaaaaggaagtcatgtggagcagtgctgtagcagccacaagaaggtatacatatgcaatatgggaactactgcccagcgttataagtgacataaacgttgtatttctgagtgaggtggtagaccggggaaagaataaagcatcttcctttctataatctttcacgtggttgatttttttcggtatactctgatatttgttttgttatctttgggtctaattttgttgctttcataattagtagaattattagcagattctggcaattagttgttagtttgaacttttattaacagtagacaacacttattacatacatcttatgtgttaacactgatataagtactttaaatgtattaacccatttaattttcataacaacctatgtgtggtactataatagttaccattttatagatgcggaaaatgaggcatagagaagttgaaaaccttgcctaagagtaccaagttagtatgtggtgcagtcaggatgtgaacccaagtctatatttttgtatatggcaagtttttgcctttttaaccccatcttcataggctggtcctcctttcctctcttctttccttcttctcttcttttatgactacataagactatttagggactggcaactagatagcgtgtttaaaagatgacctttaaagacgacttttctgaagtttagatgtggcacataaaaatatgtatgtgtgtatatactatttctttaggtattgcattaaagttactttatgaaacaaattgttaaactttcaaaagaatgaatttgtttagattgcaaatttattgaaaataagttaatttgttctttgtagttcttagttattggccgcaggtgagccagattgcggaagatggaggaattaatgggattggagacagaaatttactgtttgatggtgagagaggtgggaggaggtgaggaaggcttttggtagttaatgggggatatatttagcatatgacaatttgggtgtgtctgtgtgttctctgggttgtaactcctttagagaactgtttctgtatccacattcttggaatatagtgtagcatccttcaaaaggtaactacctggtcatatttgttgatcatgaatttatttaaactctttttcaacaagatgatttatcaacatcatttctaaattctctaaacattaaatctacacaagaacttaattttgtctgagtttaaatgtactatggcccttcagcatggctttggaatccattcaactgtagttcagatctacacactggcactttaactatgtgatcttgaactaattaccactttcggctgctttttcctcatctgagaaatgaggatataatacctcttttattgttaggctgtcttaggatgcagtgcaaaaacatgtacaattttttgtgtaacaaatgtagagtgctttgatatgatttaagcactcagtaaatgctttctagaaaaacattaacttcatatattatacatgccaacactacagtttaacaaatttgatttaaaatagtgtatgtgatatgatgttataacttcaagagcaagtatactcagttgaaatatgagtgaaaaagtagcctttgaataaaaaaatgtttctttttttgtctttcccaccccaggtcctgagggagtctaacaagttagcagaaatggaagaaccacccttgcttccaggagaaaatattaaagacatgggtccgtaatggtattttttgcttaatgtccttctccgttctactgtgcagaatgttcagtactctcagcatacagagaataaactggctgtcagagacacctcctgtctggcagaactctttacctgcagtcttcccagcatcttagtgtgttctacaaacgtaagcctagacccgctgctagtgtttgtgtttgaactcctgggaaacatgcaaattgaattatactttgcctcttctctggtttgttttactttctttaaaagtaggtggatttttgctaaaactgttgctgaagcctgtgaaggaaaattttattattttgaattactatattcagatattgagttgcctagataaaaacattgaattgtcaccttatacaagtaatttttcttaaaatatcttctcttctgtttgcttccttcatgtctttcttctctgaataaagtcaggttaatttttggatgaaatacatcatctccattgcatctgtttgtatgtagatgcccttctctgcccagcctaatacttataatatggactggaaactgaaaatgagcttacaagctgtgttttttttcctcatgcttttgttttgtttcatctgtgtgataatctacagatatctactcataaactctgagaaataaagtaatatgttagaagaatgaagtaaatgatttcttagttaatataactaccatgtttcattttgttaccaatcataatttttaaaaaggattttaaaaatgctgaattttacttggctaggtgtcatttctatgtgtaaaaacaagccaaaggcaggacctgtattctaaatggattattatttactaaatttagcttcctagtccttagcatgctatttgtcttttcttgctcttggctcttgattgaataacctctcagtctttttcttttccccagttagccttatatatacaccaagctcttgatctgaactacctacttacattttttcagaattggctattatataatgatagtagttattattattgagtgcttactatctcagtcattctcagagagtatattcttgagaataacatcaaccccattttataggtgaggaaggaaactaaggcataggaagataacctagctaataaggttatatctagcattgtgacaatttctttttcttattctgaacttaatgccgtaattgcagctcccattatgaaatatggctttattaaagaacttcaagttaccactcagtctcatttgttggctcttcttcctttaatagcaacacgccctaggacttcatccttgacccatttcccttttccctcctgtatactcttttcggttgaccatatctaaatttgtaacatcacttgccatatattggctgatgactccaaaatttgttatctccagtgtgaacccctgtcctaatgtaagtaaacaaatgcctctatcttaaacacacatccttgaatatcccataggaaccttatacccaacatctccaaaatggaaatcatcacgtttaactccaaacttactctttttcttgcattctctctctcagttgacatcaataccagctgtccatttactcaagtcagaaatctggttgtcgtactagactgctctttttttcttttctggactcttaacatccagtcagtgtctaagaatttcttgtatttatcttcttttctccattgtcatgatctcttgaggaatgatagagggtacagaacaaagcaaagactaatgatgataatagtaacataggtataaacccttgaatttttgtattgtacttagaactttagaagcatctttatatgtatattatctcatgattttagaataaaggggaagatgtaacagaaaagcactggcctgagaatgacattcctgtggtgggatataggataataaggctgagttttcttacatgagtaagaaaattgactgtggaaggaatccagaaatgttttagtaaccttgaataaagcttttctagttgaggtaaaaattcataagggaaaaatattatttgtgcaaagcaagtttgtgtatttttgtataatgatgggttcatttaattttaaaagcttccctctaaatgaaatatgcattcgaaacgatttaaaaaagtagtttatacttaaaatgttcctaagggaactattttgaaggttagaaatgattgtgaaaagatcagtctcatttcaaattccatacaaagcagccagtccttcgaagtgttgaatgagaagcaaagtcaggaggttgtaataccttattaaatatatttcatggccccaagttttcccagaagcccgttgaaagggtcttagaaagttgttgctccacagaattgtcccttacttccttggaatgatgaagatactcctttatctgctgatttggtgtaataatgacatactaggaatttatgaatattttaagatataaaaaccatgtattggaaattatgaactgtggcattttaaataatattttgagatactgattcctaagttatcctgcataatcagttaatgcatattttacaaaacataatgccatgtagatccattgtttatttgataaaacattacttgtgattatttctttacaaagtctggcattggttggtcagcagtacaatatcctcttcttatactgttatttttctaagaaattatattttaaatgtgtgtcatttcacctgtaaaattttccccataagtattaatcagatcaggagtttgtggaataacatatgttttggacattgcatttttagaagaatgttgacaaactggacaggaaattggtgaggttacatagaaactgcaatgagatgatggcgactgtgccttgacatgcttattgttgataccaccattaccagtattctttcacccgtctctgctgcagctacccacacctgttttatctagccaggatagtagcccctttgtttacttccattctgtctcatgggatgagaagtccctccaccttttcagcctatcccatttaattctgtgtttcttccccagattagtgcagggatggaagcttgggttgtaggattctgaggtctctggaaattactggttctgttatttttcagcataaattagtctaggaatcataacaattttataagatgagatagcaggttttaatagcacataatgtatagtaaactgtggacttcttgctttttcagccaaagatgtaacttatatatgtccattcactggcgctgtacgaggaactctgactgtcacgaattataggttatatttcaaaagcatggaacgggtaagagtcagattagatttttgtatgtacatgagtgtgttgtttgtagctagttttgttcatttctgatcatttctaattaaagcatttctgattaagattttgatcagctctataattggacagtattaattgctcagttttaattattttttctttccttctttaggatcccccatttgttttagatgcttcccttggtgtgataaatagagtagaaaaaattggtggtgcttctagtcgaggtgaaaattcttatggactagaaactgtgtgtaaggtaaatgttataatatgtatgtgattttctttggtttgaaaagctttgtattaaatagaacctctgttttgaaattggtttctaaaatataaaatggatttccaattagaaatgttattttagtatgacattgatagaagaaaacaaaatttagcagtaatagaaaaggtgattcatgaattagacttaattcttttgggcccagttcagtctacatattttgatatattcacaaattcataacttattttttaataatgatcatcttggccggacatggtggctcacgcctataatcccaacactttcagagactgaggcaggtggatcacatcaggtcaagagttcgagatcagtctggccaacatgatgaaaacgcatctctactaaaaatacaaaaattaaccaggcgtggtggcgggcacctgtaatctcagctattggggaggctgaggcaggagaattgcttgaacctgggaggcggatgttgcagtgagccaagatagtgccactgcactccagcttgggcaacagagtaagactctgtctgaaataataataataataataataataataataataataaccatctttaatgcacatagtactgataggataccacatagttccacattgatgatttcactttgagccttataaaaatcctgtgaggtaggcacatagacattactacctttaatttacaaattagcaacataaggctctgagcagttccactacttcgtagtggaagaactaaataactaaatatgttatattcatcatcacctatcttttctgtttctagttctcataatttttcttttttttttttttggaaacggagtctcgctctgttgcccaggctggcacaatctcagctcactgcaagctccgtctcctgggttcacgggattctcctgcctcagcctctcgagtagctgggactacaggcgcccaccaccacgcccagctaatttttttttgtatttttagtagagatggggtttcacccatgttagccaggatggtcccaatctcctgacctcgtgatctgcccatctcggcctctcaaagtgctgggattacaggcgtgagccaccgtgcccggccagtttttctacttctaaaacaatagtgtggaaaagttgatattgtagacttttcttatgttcttatttactggcattctttaaatgcgttgatacttgaatgaaacatagattgttacatttttaccattaagtcataggtatttaattctacgtaccacttctccaggtcactgttattaaggcctaattaactaacacccatgcacattgagattctacatcacattgttcctttctttttattctgccagtgccaaaagaaacagcatgtgtataattcaagatactttgttatgctaatcttagaagttttgtgactctggtattaaagctaatgacttagtaattatttttgtagttttctttttttttgagacaagagtctggctctgttgcttaggctggagtgcagtggcgtgatcttggcttactgcagcctctgcctcccgggttcaagtgattctcctacctcagcctcctcagtagctgggattacaggcatatgccaccatgcctggctaatttttgtatttttggtagagatgggtttcaccacattggccaggttggtgttgaactcctggcctcaagtgatctgcccgccttggcctcccaaagtgttgagattacaggtgtgagccactgtgcctggcctgtggttttccattatagtcagaagggctctgtgagtgtaatcgctggcaaccatgtgtcaagcacactgtttcctgatcacttttctgtagtttaagagtaagtagtgcatagaatataagacgatgtgaaagaagataattttgaatcttaatcattttaaatataatttctttccatggaacaggatcgttatcaataaacaaaaatatttgtagggcccctgacatggtactttcagagaactctgtggttaacagaatgattctgagtatctcacctagttataaagatatttactgagggaaaacaagatatcagcttaggttcccgcacatgtttattttaaaagatagtaaagccagcattctagttttggatcatatactgtcttacttatgtattgtgggtacactgtagtggagaggctttgtgtgtggttctacaaaatgaggcataataaagctattttgaattctgcctaggtaaaaacatttaaataaaatgatcagtcttaaaattattcttttcttataaattttttttaaaaaattttttgtagagacaaggtctcactatgttgcccaggctggccttgaacttgtaacaattcatgtttcattcaagtatcaatcaatgcatttaaagaatgtcggtagataagaacataggaaaagtctacaataccaatttttccccaccactgttttagaagtagaacacctcaagtgtccctcttgctttgtccacccaaagtgttggaataacaggcatgagccactgtgcctggcccttgaaattatcttaatccccagtttttttctaagtgctgttaagataccagtaaaccggaacatgaataactgcattcagtctgagcatagaaaactgcttagggacaaatggaagggaaacttggtctttagaccttactgtagagcctggataatataaactaaactattcagagttatgtgtcagtagatggtggaagaatgtggttatggagtgaaggaaggaacactttcaggcagggtttagttctatcaagtctactagtagcaggggacttaggaagagaaggtccaatgcaaatgaaccctgggaagggatagttagtaggaaaataatcaccagatataatgaactgaagacacgtatgaaatgtaacaactactaatcaggttttataaataaagaaatttatgacagaaaatgggctttcacagggaaagcacatatgctgatagtttgtatcagtcatgatattaatcttcagatgtaatatcgttaatctccagtggttacatcaaatactacctctttcactggcctattttgagtccataagcataggtaaatttcctgccctctgaattctgcttcatagtagagtaccttgtgtttctttcagtttttcccaataaaccattataatttccctgtctccaggagctgatgtctgatttatttttgtatcccacattcacagatcttaacattttacaagatagttccaagtaaccttatttattcatttaagtaagtagtgaacaattattaacttggttcctaaatcttttctaggatattaggaatttacgatttgctcataaacctgaggggcggacaagaagatccatatttgagaatctaatgaaatatgcatttcctgtctctaataacctggtaaaatgtttcctgtctttggaaaatttgtgctataattattgatgtcgtataaagaaacttgtctaggctgtctagaatctctacatttacatccctgctttgacatttaaccagatgtatagtgtaagtgtaacttagtctcttagatcaatttctttaggtatgaaataaaggaagctggactagctgatttctgaggtccattccagcactaacattttatgattatatgatcttgctattcagggtgtttccatgatgaaaagttacctgttgtcttcattaggatttgtaatctcctttttaattgggagccagttaacactagcaatttgggagggaggtaagggtaggcaaaccctgagttcccactatgtgctttagacagtgttagactcccacgtttatatcatttcacttctatgtagcctatggtggtagatattatttatccctgtttagcgatgaaagcaacatcaggtaagcagttaactcaagggcacagttagtaggagtaccatttggaatcaacgttggtcttatgactccagttcaaatttttttcacatcatagttgtgtttaaatgtaatgtctttatttgaaagtaaacctacaaaggctaccaaggataatctgaaagaaatacaatgatatgttggtatttgataagttttgttggcaagtgtctttgcttttttgtatgcttaaaaatatgtaaaaaaatagattttcaaaatgataaaacaaaaactataatacaaaaaaggatgctaatacataaaatgttcttgcagataaataaatgaaaactttggatatatggatacatttctgattcattacctttgtgaatatcttttttagctcttaccattgtttacttttttgtagcctctttttgcttttgaatacaaagaagtattccctgaaaatgggtggaagctatatgaccctcttttagagtatagaaggcaggtatgtactttcttctctttcaattttagtattttgtattcttttcattccaaagaaaactgggtggaaccatgtacgaaaaccagcatatctcataccacagtaattcaccacattaagagattaaagcagaattcaatcttgaaatctgttttagtatatcattcttcctattcttccttcagtataccacttcccaaagagtccctatactgcattacttaagccccacctaaaatagtcttttctttatttttaactttcctcctgtccactatgctttcttgagaatttaagacatattgattatttcttggtaatcattagatttgttatctagagtattctagaattcaaatatgaaaattcttgagcttttacttttgtatttaaatttcaaacgtagcattttaattataacatttctaatttattgtggttttgtttcacaaagccaggtagaggtaaagaaccaccaccagagagctaaagatatctaaatgacttgaagtggggtttgttaccacacttacatgtggaaagtgaagttgaaatttcctcattcagttataaagttatttggcaaaatatgaaatagaatacaaaataagtgggaatcaactaaaagccaagagtatacaagaaacaggagattcatgctaactcaaaaatccagtgtcagaagaagatgactaagcaaccaaaaagtctagcaggtgtctttagaaattataaaaatgaggactactctttgagaatctgggaagaaattgctgtcccaggagcattcagtgtagaactttggaaagcaggtgtctaaagaaaagaggtaaattattactgaaaaaaaataagttgaagtgtaaatgaacaactatacccatacagaaagagaattaagagattaggaattgtggcagtaagaatagagcattagcttctacataaaatggtatggatgctttatggtctttgacttactagatgaatttgttggcttttttttttttggcagcatgagaaactgtctctgagtcaactaaaaggtctaatggagaggacactgtatttgtagttagaagctgtagttttaagatttttttcttggatatattttaagtttattacagaagaaaatgaagatgatctcttaaaattaaggactaatgataaagcatcagattattcacttccccccctttaaataaaaaaaaaaaaggaagtggtaatacttgcattctgtacaaaattcaaaaggtccagcagggtatactgaaaggtaggttttccttgcaggacaaccctgtgtccccctagccattccagttcccctccctttaggaaatgatattattggtttcctgagtatttttttcaaaggtttcatgcctacaaagcttgtgtatatatgtgtgggtattgtttttttaagcatatggtagcatgccatgcacactcttctgtgcttttctttcttcattaatatattttggagatggtaccatcttcaaacatatagacctttcttttttttaaattgagatgtaactcacataccataaaatttactgttttaaagtatacagtccactgctttttaacatattcacgaaattgtgcaattaccaccacactctaattctagcacatttagaaaacttagttttgaattttagctctagttcttactctcacactcagatgtaggctcttgaatgaatcatttatggcacagtgccttcattttttacttggtgatagataccacgttatgggatgtttgaaggattagtgacatatagaaaggcactttgtaaactgtaaaaatctatccaaatgatgattattatatttattacattgtgaggctctgaaaaacagatatcatgactggctttatcatgtgctgccactaaaaaaatgaaagctacattcattcaacagatctacacttaatagtgttaaaagaaattagactatatctcttcaaaaatgggcaaaggctgggcgcagtggctcacacctgtaatcccagcactttgggaggccgaggcaggcaggtcgcttgagcccaggagtttgagaccagcgtgggcaacatagtgaaacaccatctatacaaaaaaataaaaattagccaggtgtggcatgcacctgtagtcccagctacttgggaggctgaggtgggaagaccacctgagcctgggagatcaaggctgtggtgagctgtgaatgtgccactgcactcaagcttgggcaatagtgagatgccatgtctcaaaaaataagtaaataaataaaaatggacaaagttattaataaccatttaggtttgtcatataggagaatgtttctttaatttactcttgaaggacatatacagtatgtagtgattatagacaggactatggagtttgtggataaggccaagaaaaatcaagtcatctgggcacagtggctcacacctgtaatcccagcactttgggaggccaaggtgggaggattgctcgagcccaggagttcaagacaagcctgggcaacatggtgaaaccctgtctctaccaaaaatacaaaaattagccaggtgtggtgacacatgcttgtagtcacagctatccaggggggttgaggcaggaggattgatggagccctggagctcgaggctgcagtgagccctgagcatgccactgcactccagcctggatgacagagtgagaccctgtctcaaaaaaaacaaaaaggaaaaatatcaagtcatgggtaaaaatctgtataaagataatgagcagtccagtacagtggttcacacctgtgaccccagcactttgagaagccaaggtgggaggattgcttgagctcaggagttcgacaccagcctgggcaacatagtgaaaccctatctctacaaaaaatacaaaaattagccaggcatggtggtgcatgcctgaagtcctagctactctggaggcggatgtgggaggattgcttgagccctggaggttgaggctgcagtgagctgtgattgtaccactgcagtccagcctggtgaagagtgcagagaccttatctcatgaaacgaacaaaaaagataacgagcacggtcttctgcagaaatacccaacataagttacatgcattacttaacaaacttggaaaacagttacttcagtcaagggaaagagaacttatccttagaactggaatgtaagtaactaagaaagccatggtcctttcagtttgtttgtataataaacttgaccctgacaagtggatactgaagggcagtgattttgcttggagagtagatatataccaaagatcaataattgtcagtatatttttagtagtctacaaagagagtgtctgagggctagccaattccagttttctgcttgaaaggcagtttttagtgaagataggtgtgtcggcttatctaagaatgaggaggacaatagccatgaaggtaatctaagtcattggttctcattcctaccccaccctgctacttacgtgaataatgtgacattccccatgagaacagtggttctcctggtagtgtttttacaaggatatgggaagtggggtgggagagagacaggagtacctttctgggttgggggatggtacattaggccctctgatgtatacttctcaagtgatctgacctttagctctgactccatgttttctaagaaaacttcagaaactaattttgcttcatatggaaacttcctgtggttcactgatttattcattcatgcatttatcaaattcatataataccttctaaatactagtggctaaaatatgaaacaaaatgataaagtccaggttcccaaagagtttgtgttcagtggagcattcaaacaaatagattaacaattacaatataatgtaatgaatagtctgatagagcaagtactgtagggagagaacatgaggccatctgggagctgaaagacgtttgatatagactagaccagagcatacagtggcaagggagagatctggagaaagcaggattgtagagggctttgctaagtctggtaaaggacttcatattttatatgaaaagcaataggtagccattgattttaagcagaggaatgacataatcccttttgcatcttaaaagattactgtggaggcagtgtagagaatggattatagagggacaggagagaagtgataatggcctgaattagggaagtggtggtaagaattgaaaaaagtgagcaaacttctggtatttctggaggaaaaatcatagaaattggtcactgactggatgtaagggataagggagggggaggagttaaagatgataaccaggtttcttggttgaataccatctctttaaacttgccaattcactgtactttttagtacagcatgtgaaaaaaatatataagtatatatatgatatatacatatataaaaaatatgaaatatatatttttcacgtgctataataaaaagtacagtgaactgtgtatatatatatatattatatataaatttttagaatctcgccgtgtcacccaggctggagtgcagtggcgtgatcttagctcgctgcaaccttcacctcctgggttcaagcagttctcctgcctcagcttcccaagtagctgggcttacaggcatgagtcaccatttctggctaagttttgtataatagaaacggggtttcatccatgttggccaggctggtcttgaactcctgacttctagtgatctgcccacctctgcctcccaaagtgctgggattacaggcgtgagccaccgtgcccggccagcacgtgaatattttgttaaaaacctctaattaagactgtagttctggaaataagtcatgggtaaaaatctgtataaagttaatgagcagcctggtgcagggtttaactttcatcttgaagttgtccagaatatctgaagtcaacgaaatcaggagggagggaaatatgtagaccacagggagcaagatgggaccaggctaattatatggagtaaacaggatgtaaggtagtaatgaaagaacagttagggataaatagaagcgctattgagagtgtttgctggaagggaattttctttcttaacatccttctgggtgtttggaaacagcttgagaaatacttctttaaaggagagtacattctgctctttgagatttttacaacaatttagtgaatacgatagtaaatttttcttgaggaataatgtacttttatataaaaaggatagatttggaatgctcatggaattctctactacttcctaatgtatagctttggccaaattacaaactgtgccatagtttctttatctatgaaatgaagttaatgaaacctgagtacagtaaaatatatctgtgtgtttgggtgtaaagaggctggcaaagtgcctacacatagtagatgctcagtaaatgtatttttcactttcaattctgtctttttctgtttgataagaattttcagagatcataaaatttaagatagattttcttaagtccaaccatttaatataatagcttaattttgtatacagtgaaggatggaaaatttcagttgttttattaatcctatatgtgaagtagtacactatttataaaatagcagatattgaaggagcacgagagctcaatagttgatatgttttttaaaaattgtttcaagcatttttcttgcctgttgcctgttgtcattttgccttgcattcctcccttacttttctaatatattttagattagcaacatccattagtattataatacctcagtgaaaaatgtactttacgtatgtaagcgatagctgtgcatgtagcactctggtggacacttggtgcctgacttctgatatttatttgtatagatgaatggcaacaaagtcaatcatccagtcaaactgaatgagaccctgcactttgggaggctgaggcaggcggatcacctgaggtcaggagttcgcaaccagcctgaccaacatggtgaaaccttgtctctactaaaaatacaaaattagccgggcatggtggcgcatgcctgtaatcccagctacttgggaggctgaggcaggagaattgcttgaacccgggaggcagaggttgcagtagccaagatcgcgccattgcactccagcctgggcaacaagagtgaaactctgtctccaaaaaaataaataaataaataaagaataggaacatttggccaggtgtggtggctcatgcctataatcacagcactttgggaggccaaggtaggtggtcaggagattgaaaccatcctggccaaccccgtctctactaaaaaatacaaaaattagcccagcatggtggcgtacggctgtagtcccagctactcaggaggttgaggcaggagattcacttgaacccaggaggcggaggttgcagtgcgctgagatcgcaccattgcactccagcctgggcgacagagtgagactctgtctcaaaaaaaaaaaaaaaaaaaaaggaatatttgaagtcttactgtttccttccacctcctgaatatgcttagcacaggtccacactgaatatttagtgaattaatgtctgttatattaacatcaaattgggttccacaaatgaatacgtatccctacattagaatatctaatcctgaaagcctgataccacaggctgacaacaactatcccaacactttaggagatggatagtagaggtcagagagattgaacaggatggcttctgtcctggtgtcgtttaatattttagttatatagtaatttgtcttatgtttcatttcacatgtagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagtaagtaggaagtttggatgagcctttgcaagtgcttttttactcaacataatgctgagattaatgagtaggagaatggattcaggatataaatagctacagcagcaggtctttcatggggatattggagattgatttatttagtaaagttaaaactggaagaaagacttaaagaggcttccagagagtgtgatatgggtattagataactgcacagaattgcatgattcttcactgaaaaagtttgctgtgtgtattagtcactatttatttatcttattgtatattctttagtcatgatgataaatgttcttttttttttttaagtcctagaaagaacaccttacagatttataactggatcttagaaagatgagcttaaataattttaggtacaaaattcatagattctaaaggcttttagaactgagcagttttactaatatattaagtggggtttacttagccctgtttcacagtatttttttcaggagataacatttcccaataatcaaatactttcctaaatcagtatctgactaaagaattagaccaagttttccacatcccagaattggcttgaaggaaaggtgatgatttttcttagcagcctcagatgtcctttcatggccaggctttggatccaattagaaagcagagctttactgagtactgtttttgagaattataaacagagaagtatgtaaaaggtgtgttaccattttttcctcattaaggttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggtcagatggtctcttagtaattataattatggtttcatgaatcagctgagtttggcagggccacagtgtagtaaaaagagctcaggctctacagtggtaaacatataggttcttgtcttggctcttcaacttgatggtgtgattttgagttagttatttaacctctttagacctcaatttgtttattggtaaaaatgagaataataatagttaacagtgttgttttgggagcaaaaatcatttaataaaaaataatgcataaacttttgcttacttacataataactaggtgttcagttattcttagcttcccacttctccaaagttgacaactaactgagcttatgactcactgaagtccctgtatagtactgctctaggaatagcgaactagtgttctcggtgactagtggtgccctcttctgaccgtcctccacctgaacaagttattcagactgaagaattggcagttagctgtagctgattgttccagcagaataaatattagcattgtggaaattgaaattttggttcagttgaccaaatctataggaggagggaaggagagagaagacataactacagcagcaggtaccattactgaaaagcgctcatcttttcaagtgtacatttcagtgcttttagtatattcacaaagttgtacaaccatgccactacctgaatccagggcatttttattctatgtgtttcggtgacaggttctgtatagttgttaccactgctgtctttctagaatgttgcaacaaatttgaattgaaagttcctgtcttattcccactcttcagaagtaatctttaacaggtatcccttgaaatactgtaaattctataattgtgccaaacgatttcccagactctcagtgtcagaaaggaagctgaacttctgttctttcagtagtttgttgctggttatgagttggtggttttgttgtttcaaaggtgtgggtcatatgatcacttaattttgtataatttactgctccagtattttcctaatttgtttctattagggctctaagaagtataattttacacgagttaggtaggagatagaatattttattcatgaaatataaaaagattaagtccagaaaaataaggttcttctttctagccatagcttattttgaacaccaaatattttctcattctattttgtagatgtagatttaagtctttgagaacattgatgatgatagcattctgtgcttttatccttgttctgtctttttatttaaagagaattatgtggttaaaaaagaagcaggtcattttgattgcaaagagtttatttctcagatatgaagattaaaatgaggtgaagaggcagggaggtgaagaagcataggtgaaccagacatgtggtctcagcacatgaaacttacagtctggtaatttcagtatatatgaaaggaagtcatctgtaagaacttatgtttgggtaggacttggcgtatgggctgggaaaatttagtgctttacagtgtttaaataccttcctatgtgtttcatatttaattttaataatggccatatgggcaagtcagactacgtatatattcattttgtaaagaagaacacaagaaagcgagtggttgtgctaaataagttgtcctgagccatccacattttcctgtggagttttccttgtctccagtaatatgtatcatcttttatgctattggatattttatgtcacttgtttacagatgtgcattcatttatgattttccatgatgtgtgcttttttccaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaaggtgggtgtgtgttactatatcccaaacaaagactctctctacccctttgtttatattagctttttacttataattgcaatcaacatgaaggtacctttctaaacaatgaaaaatgggtaaatgctttgatacttggaactactagtgaattttaatgtttgaatgaattggttttttatattgtgcatttggttatgttgtatttcttttgttccccctcccatcctatctgaattcgaaccatccttcagattccagttcatatttcatttcttccataaggtcttcccagattgcatccttttccattttctctgaactctttaccctgtctttccatctaatcaggaactagcgtgtactttgtttgcttttgtgtgtcaaccaacgtatattgctaatttatggagaccaagactggataaatcctacatatatttttttgtcctctcaggagctagggcagcactatccgtgtgaataggtacccaataaatattagttgatttgtgaagttaaaaccattctgatcagggaaatgaggtggagtggttgcatgagccacactgagtgctaagtcattcgcagagcacatgtcagtgctaatttacctaacatgctaatttaatctagttatattttcagatatggtctgtcagtaacataactcaccaaaatgtagacttatgtaaccacatatataaatattaagaggtaatgggaaatgcagtctttcacgttaagaaggaggatacttctgctcacattaaaatctctgaagttcagacagaattgaagagaaaaccaaactgaataagaattttaaatagaccatttttactattgtttccctttgagaagcttagaagcttgaaaatcacaaagtataaacactactcagagagcatgttcatgtggcccattcattaaattatgtgatgtgtaaatatacagccttaggcttgatttggaactaacataaatcgctgtgtttgattctgaaaactccagatatttaatttgcagtttcaacatggtctctaaaaggctggctataacagaatcaaatttccctagagttataagacatatagttgggctaaactactttattctcccccaatccttatcacacaaagaaagtttatttactcaatcactctcttctggtctctgctcaaatatcacctttctgagagagacctttcccagcctctttacaaaataagagttctaccagcattccctataacttctatggagcgttttcacttattgccatctggtatactgtatatttccttgtttatttgtgactggtgggcctcacccaaatagaatgtaaacttcagtaagcaggaactttgttccctgctgtatggcccgtgcctagagcagtatctaccttctagtaagggactccataaatgtttatttaatgaatgaatgaacaattactactttggataactcttcctgatcaatcttaactaagcctttgggttagtgattcttaacttcgtatatgcactagaattataggtggaatttatttaagatactgaattaggatcattggacaatgaggtctaggcacttcaggcttacaaatgactcttgatatatagtcaagatcgtcatagtaccccatttccagaatatgcttatagctgtgatcaaggggaggttatcatacttccaagcttaataatctgttttctttcattctcatctgcgtatgtagaactatactgtttttcaagtataatacaatatggccattgcagagaagaatagggctgtattgtcctttttttttttttttttttttaagataccatacttttgtgtttcttttttggttatatctaattatgtttagttttaactcaagattgacttcagaaaaggtaagttattttgcaaaggatttctgcatatttaaaaaaataagagctgaagttattttaagtaacagattgacatattctgtgaattttcatgcatagtgttacagaaaagtagctcactctaaagtttatactgtgcttgctgtatgctctgtgacataaaaatctttagtcaaaacaatacaataaatgctatagagtattttaaagagatccagtattattgctttcaggtacttatcccaatttggtttaagcattgttttaaatcataacaaggcttcaattgctatatcaattatttttatttaaatagatgatggaatatttgattcttagaaacagatctctttagaacttttctaagaagaatcttacaccatgatttatgtagcacccaaaggtacttttgatttggctatttcgttgggcaaattaataggagtcagcaattatgaggtttttctagttttaaaagcaaaatttatatatcttctaccatttaaaaaaattcttcttaggaagggacaaatgtttttcctcatgttattgaaataatgatccctgataagctgtattagtaaattttgaagaaggaagtatttaccttgtttaaaaacaatgtattaaaaaatctgttttccagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactagtaagtaaggaaccttgactttggatatatcacatgcattcatgccaaggcatgtgaaaaaaatgtgttttttaaaataagatattcatctgaaattgatcatttatctagtggggtaaacgtttttgcttgttttggaaagcattaagatatccctaacatgactagtctggagtcagagctagctatttgtcaagtgtctgacccagtcttttctgtgatctccactgggaaacatcggatatcattcagtgatgtccacgggtgtttctgggcaggcgttttcctaaataattgaaaaacttttagaagggtctttacccagatgctgtctgtaatgtttacctttagtatccagtagttaccagagtatactagcagtgtttatacagttgtcccttggtatatgtgggggcttggttcccagatcccatgaacaggccaaaatccacacatattcaagttctgaagctggccctgctgggaccatgtaaagttggccctctgtgtatgtgggttccgcatcctgcatttggctgaaacaaatctgcatataagtggacctgtgcagttctaaccgtgttgttcaagggttaactgtaacatgaaaggaacagacatttaaagttagtctgctcttttgaacttgaactgttaaataaaattgggtacctggagtgtttattcagatggctcacattttgccgttctctacacaatgtacttatcatgaaacggccatttaaaacaaactcgtacttcaaagaatcaagttttagtcagccaaagctgcacatgtttatataaatgtgttcaaaatcaaacattttggggtgttcgaagttgctatggattcctaaattgctaactctggttacctactccccccgttctttttacctagttatattctgaaaatagaatcttgacaattaaagggcacccagtcaagaggatttgctcacaaggttaatgtagagtaatgattctcaaactttttggtttcaggaccccctttacattgttaacaattatggatagaacttttttttcctaactccccaaacttgttacccagagaactttatgtgagttatatcaatatttgccatattgaaaattaaatttgaaaaaatttaaaaatatttcttaatttaggaaataagcttattatatattaacagaaatatttaaactaaaaaaaatattttccaaaacaaaaagtttaatgaaaagactggcattgttttacttttgcaaatttaatgagtttggcttaatagaagatagctgaattttatatctatttttaccttcaatctgttatgttttgttggttttagtatatgaagaatatctaaccatatacagatatgtaagtggaaaagcagaaagtattttaatagctttttcagggaattgtagatattcttctttgatactacgccagaacttgataaatggtagtttcttagaggttagttgttatatggaatccaaaatcaagttaatgaattttttttatcattaaattccattggtctcacttccattttgaatagatcttttacccatgtgtggttttgtaacatcacatattggttatttggaaaatactggcttattgagttacacagatcttccaaatgtaaatgcatttcatcatataataccataaaatcacacttgttaatcatcaccattggttttgtcagaaaagccttcaagtatttttaagctcattatggtgggcaaaagttcaccaaaaattgagttttcactcaaaagcttgaattttttcattgacaacaaatattgtcagctgttttcctttcagtgataattcacattgtaccttttcaaaaaaaaaaagtctttaagtctttctaaccacaatgcatacattaatttttctttcaagtaaaaatgatgagaaagtgctatctcctaccatactacatgcagtagcaaagagttaacacatatttcccgttttgtcacacaggccattaaaaaaaaagtgtacttaagggatgagatttaataaaatcagtaatttttactgcgttgttaagtacactggcataagagaaatggactttttttctttaatttaactgtgagtgtctggtagggtagaatacagtgggtacgaatgcagttttaattataagcattgccctgcttgatgcctgcaaaggcaccagaatttttatccttcataacttctgcatcattagtgcaaatgccaacacactgaaaaaggtaaataatgtcttaatattatggaaatagttttgacctcacagcccttggatgtttgtggaccacacttttagaattcctgctttggggtaaggagcaggattctgttttcagttatctgagtcaaaggtcctcagaggaaataactgagaaactaggtagatgactgcatgcttggagggtggatgtcaagcatttttgacaggttttctaagatgtgtgctaatatggttcctcctgatgaagacacattagtgctaagataggagggggtacccttcactcagtggtcaagatatgaacagagaatggtgctttctgaggccagtgtccatgtaacttatttctcagagagaaattaaaatctccaggacaaaaatctggcctctgaggttctgactgcttccatcttttattagcaaccttttaggatctgagtttattaaacagagtagtaattcatattataagcacttgtgtcagaaaatatctgagcagtttgcacatcaaaatgtttctgcttggcaggataatgggtgattttttacttactttgcaatgctctttaaaagactttctgaaaatttttatgtatttgagacagggccttgctgtcatgcaggctggagtgcagtgatgcgaccgtagttcactgtagtcctgtacttttgggcgcaagccagcctcccaccttagcctcctgaaagctaggactacaggtgcacgccaccatgcctggcttttaaaaatgttttgtagagatggggtcttgctatgttgcccagacccatctcgaattcctggctccaagtgatccttccaccacagcctcccaaagtgttgggattacaggtgtaaaccacagcacccgactttgaaaatttttagactattgaccaattatttttttaaaaaattatttccatcaaaacatgaaaaatccccctaagttcatatatttcactctttttgcttcagagagttggccatggagataagaaccatgcagatgcagacagatcgcctgtttttcttcaatttattgactgtgtctggcagatgacaagacaggtaatttatctggcctatgtattcttacacatctcctttcagttttcctgtcagagtggggagatttggtcactgattagcctatagatcattaaatggaaattcttgtaacatctccatgtccatgtgagagctatttattgtcacattatgaatcaggttaaagattaacacttgaaaatttgattctattagtatttcagtgagtagcattgataataactcctgagaggttttatcatttgttttgaacaaatagtgttaaataggctcacctaaaaacacatttatatattgctaagagtggagaaaaaataagctaggtaccgcaagcaaaataaaatattttaagtaactttaactgttaattttttttttgaatttcaatctgcttcttctgaaaatttttattttaagggaaaaatgtttatatagaaagcataacaagggaggcacatactacatccagttctttttattttttggcatagagagagctattatggcttttagaacttctaacaaatttatttgaaatattaatataaatgaatttaatcttttggaaagagtagaggggactgagaaaacacctggtttattgtgagatcactttattaatgaggcaacgggtcattgtcttaaaaatatgatttaattctgactcaaaccatctcgaaaccctgttgaatgcagctcattgggagataattatttacccaagggtttattagaccccaaaacaactggaagtctgaattgtttttatttagattgccatatgaatttaaagtagggcaagtgctggctctgcctggctttggatcatatttatttaggagcatatttttagcttcaataaaatactgtttatttcaatacaagaaaattaatggtaatggggtgaaataatcatcaattatatatttaacagtcccttgcctccataagcatttctacttgggtgaattatttagaaactgttgggttaaatgaagcatttttgtagctatgactatgatatgatgagactagtattttagcatatatactgaaaaggtgtatacaattcagttttggtttataaatcagacctttggtgtgttgggaggtaagaggaaggagaggtgcagtgtttaatactttcttggattaggtttgactttttcctttggaattggctttgaggcagtatatcaactacctaagtccctacaatccttttttggatgtttgacccaaaacattaggaccccacttttgactgttaccatattcagttttaaatagcctttgactcttggtagaaataaaattcgccatcaaaggagtaggaaagctctttgaaactgtggtattgttgatggttgtgtgtactgctttccaaggtgaataccttgaaggaaacgatgtgtttgaatgtatcagttctgatatgtttgctagaaaaaaagcacatttaccaatttcttgcaaagaagagtacacgataatctatagccaaccaccctgaatgcacccatctcatctgattttggaagctaagcagggtcgggccttgttagcacttggatgggagaagaatacatcataatacatttcttccttagtaattttaattttgttaactttatatatgctgtctatctaaaagtagtttaatcctaattttgagcctggcactaaataaaagaaaatcagtttaaatctgtatttttgatagaacctaaaatactttgtagccatctttattttatacacctagtgtttttctgtatattttcttcctgaatataaagcatattaactagtcataatgtttgttagcaattatcagttttataaatacttgaatactagtacagagacttgaatagcacatttgtcaaaacagaaccaactatgttatgacagccagattctatacctctcctcctatttccatcctcatctctgtcacctcagccctgagatcaggaagcaattgttgaagggccttttagattttaaacatgtaaagaaaacaaaatagttctcttctgctgagggttttaaaagcaatagctgcagttaatgccctgctattttactttctttgtgaggaaatgcctactgattacactgtcttctcataactgagctaacagttttgccaagaagatgaaaaactaatcgcaggcttagatccttgggattgctatttagtgattcaggatgcattcatatttcgctaataatagggctgttaagagtgtgaaaaataggtgggatttattttttaaaggaataaatgggacttgacaaagttttttacaattggttttgttgtggaaatgcttggtcatcttctgcttgatcatctgcttcattcagcttcacagccacaaaaatcaaggcctagtaagtgccctttcttgtttaggaaatctgtcatgttaccctgtctatacttgctaaaatgtaggaaactttaaggcaaagttgttttcatccatgttccatttacatgatgtttatactattttcctccactataaaggaagggatctaagatgtaaaagcttggaagcaatgtgtattttcacagtctgcaatctaaatatttatataatttcttatcacgtacagccctataattggtagaatcttacatagaagcttccaaataattctgaaatattagataggatggattaaacgaaaccttctaactttcaggggttcgtaatttttcatttgattagtcccctaaaattgtgttgtgtaaaactaagacatccagtcaagcccctggcttgggttagagagtgaattttctttttgttagatgctgccaaaatagtggcttacaagggactctggtttgatgggatggatgttccctgaaaagtttacgtcggtgcaaaagtaattgccatttcaatggcaaaagccgcaattacttttgcaccatctaaatatttaataggttggttgacttgtaaattatctgccttagatgtttacttttgtgtattgctgacattttctggagacattattggcattttgtgtgtaatccttaaaaaagaaaaacaactatgttcttgaaaatttaaagaatcttaatgttgtttgtggtcattttgggcagagaatgcctagagttgccagaattgcctaagtcaaaattcagcctgcaaatttagggttagcagatatagcagatacagaaacatcatgatcagaaaagtgataacatgatttttgaaaagaaaaccatacgaataatgccataatggcttggaataatgtagatttgaatgtttaacttcattttaaatactacctcaaaaggatctacccatgacagggatgaatatgcttgaagaatgtcttaatttatgtgtttgtgatgtttgatttgcagtttcctaccgcatttgaattcaatgagtattttctcattaccattttggaccacctatacagctgcttattcggaacattcctctgtaatagtgaacaacagagaggaaaagaggtaaaatatgaaacatgaccttccccatactatctctactgtatacttttccctaaaagaatgtactctgtgacagatttcaactgaagtcattcttttgggtcatactttatcttacatgctataatattgagggcttccttccatatatctggacctgatatattctgaagtatctttgtcacaaggctgaaggtgctagctagctgtctgctgagttcatgagtgggaagtggtttctgctaaagagaactgaagtacgtgaaatctaaggagcaccagtgtaccaatttttctatgtagaatggaaatcctttacagcaggtgcagaaaaatttaattagcagaaaatgtatattcgagtgaataggcagctcaaattcccaagtatatcctacttattgagacattttaggttaagtttttgagttttttaagttgtaaagtaataccataaaaaaattcaaatacggaaaagatagtatgtagaaagttaaagtttttcgttatcccttttccccaaaggtatcactgttaagtggggttggtattaagaagaaatggtgtaaggattacatttcaagttttacttctttatcaaaacttgtctatcctatgtatcaacatcttaatcatcttgattggtatctccctctgcatcaacttttattctaaaaaatgtggttacaaagtatttatgttttattttataaagcacagtaggaataagtacttgcactgaagcccagttgctgggttcaaatcctggatctatcacttactgtaacagttcgcttggggaagttaatgtctgcttttgtaaaattatgaagattattaaataagcaatacaaaataccacaagaactgctatgtagtatttcctagacttccttaaaggcaggtattaaatttttaaattcaccttatgtcttcagtgtctagcatgcagtaagtatttctatgcatagcaggcactcaacaacttaaggaatgttcattagaaatagcatagctaagtttcgaagagttttattttttgagagccttggggtaggaatcattgattatttttaaaaaaactttttaaattgataataatatgcataccatgaaattcactttgatagtgtatagttgactggtttttagtatatctgagttgtacagccatcacattttcatttcagaacatttcatcacctcagaaaacctgttaatagtcactccccattcacccctgccaaacactaatgtttttgtctctagatttgcctcttctggacatttcatataaatggaatcatttaatatgtaaaccttgtgtctagctcctttcctttaatatgctttcaaggttcatacattttatatcatttctttttatggctgaataatattccattgtgtggatatattttacttatccattcgtcagttgatggacttttaggttgttcccacttcttggctgttaatgaataatgctgctttgaacatctataaaaaagtttttgtacagacatgtcttctgtttgctggatatgtacaagagtggaattgttgggtcatatggtatctctttgaggaactgcatactgttttccagtaccctctgatcttaatataagttggtttatcactgaagtctccaagtccacttcctctaaagagattttaatgacaacaaagtacttcttcacaaatttcatctaaagtgtaaatggcttatgtggtggagaatctttacctatttttcctgcctacagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggtatgtgccttacaatatacaatgggagttttcattcatgcagtgcaactttgtctccttaaaagcagctggaaagattatctgtgcatatttaaaactttactccttacccattgatagttaacaattgtatagtagaaaaatactacactggggcagggtaatcagtatacctggttcttaggactgcttgtatgacattggacaaatcactgctctcttttcttgcatcttccctcctctgtctggataacctctagggggtcttgttttaataagctgaagaaagtagctttaggaaagttaaaagctgaacaaaattctggtctactgtgaatatgtttatggaatattaactacttagaactgtttaagactaaaaacctataaataacagggaatcttctgactactgtcttttaattgtcttgttaattatttgttgtatttggaaaagtaccagtttcaggagcacctacacagcaggttattctttggaaatactcaggggcactgggaaagccagtgaaaagattagtggtgtccacagtcccggtatttaatttcactgatgggttggaaaggtgccattggttccaacagctgaaaaaacatacactgcaacatttagggaatgatttgacctggctttggtcaggattgcctagttgaatattttatgttttgctcttgcaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaaatttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaatgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataactttgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgtaagtggatggatgacacattcctctactgtaaacttgcagataagaaaatggaagcagtattttttcacttctcacctgacagtacaaaaagctggagtagttcagtttgaatcctagctgagaaaaggggtgggatttagcatcattcaatcaccattctcctaattaggactcagagccactacaattcaaatgatggttatacaatttaatgacctgaaattcaaacaaggagataacaggagtttttaatagttgaaatggtggttgacacatatatttatcatgtcaccagagcactgtttctcacttcccttgtgtctatgggctcacaattattaattcaatcaagctacgaacctactcattagaaaactggacacagaagcacaagtttacaatttcaggagagtcacaaataataccccaaaatcttaaggatcctaaattaaagcctgttactgtagtatcttgtatcatgaggaaatctaatattcttgggctctctttctatgtaagcatgagtgtggcaactaagtactagttttttctcttcatcaatacattgatgtcctcctatttagaaatgcattttttgagagcttgtcacaaagcctttattaacaggctgttaaggaaagttgcagtgtttcctttaaaaaggtgctttattgactttaaatttataaaaggttaacatgtcttgatctagttgaaattatgatttatatcaacatgataattatgtgtacagttcatattccactcatactgtacaccagtaaaagcaaatattcaaagggttctctaagtttcaagattaaaaaccataatgccttgactgaatatcatgattacaaaacaggtattaagaactgtgaaggtatatgctcacaacatatcccttctcccattctcactttattccaaaatctcatttatttcactgacaatttgtttatactttcaaaaatccttttataatttttatagatataactcaaaatgactgcttgggtctttaaaaaattaacagattaaaaagcaatacaagtgcacttaacactgatcaaagtctgaaatgccaaaaagcaaaataaaaatcctctgaaatatatatgtatttttaaatatagaaaaactccaccaatagtagaaacaaagtatgtttaatggttgctttggaaaggggaagtgggcacctcatgccagggagatttaaaaatgagacttttcaagcaagcactgcctatagcatagtctcatattttgaaaatttaaacctaattttaattatatataaagaactattttaaaaaatcacacccacaagtaaaaaactggtaatctgtttacaaagtgcagcgtcagtacagcaaactcatctcaacaaaagattatgtgtggtttctcgggctttaaaactcccctggtttccatttaaatgctttaacattgagtcatcctgcatacatgaaaagcctgtgtaatgaagcctgggtcctttaacacctgctattaattaattccaacataagtgagtatgagacctgggaagtaaattgtcatcatctgattgatgaggtacagattatctgaataaaatttctgacctggttatgagtcagtaatcccaacacaaactactgctttgtaatgaattctgtatgctttgcatgtccttcaataactgaagattttttctccttttttctccaggtctcagtttcataaaatctttcttatttgtggtccctgtgattccagaacggctgctgctgtttccttcttcatcaagagtctttttggtagcttttaattccttcttctgcttctctaacttctgtttctccagctataccaaataaccaaggcaggaaggaaaaggagaatttaatgaaaatattttttttctgacaacaaaaagtacaagagtacctttttttggttaactctcatgctaactgaaactcaaataatacattctaggctttctttt

SEQ ID NO: 12769 - DNA, 41612 bp, Human
  misc_feature (1)...(41612): n = A,T,C or G
gagtgcgttggtgcaatctcggctcactgcaacctccacctccagggtgcaaaaaggttctcctgcctcagactccgaagtagctgggattacaggctcccgccaccacactcagctaatttttgtatttttagtagagacgtggtttcgccatgttggccaggctgatctcgaactcctgacctcaggtgatctgcctgccttggcctcccaaagtgctgagattacaggcgtgagccactgcgccccaccagttacattttaaagagaaaaaaaagatgcttattgaaagaacattactaacaactgtcgaaattgtgaaagtgacagcaaatcagtagagtcagtcagttgagccagatagcctctgagtctgtagttctttttttcttttttttttgtcgcccaggctggagtgcagtggcacaatctcggctcactgcaacctccgcctcccgggttcaagcgattctcctgcctcagcctccccattagctcggattacaggcgcctgccaccacgtccagctaatttttatatttttagtagagacagggtttcactgtgttggccaggctggtcttgaactcctgaccttgtgatccacccgcctcggcctcccaaagtgctgggattacaagtgtgagccaccgcgcctggctgagtctatagttctaaacaatcttcaacacataatagaaaatgtgaaagagacagacccaggtccaagaacgatctgaacttctcctggaattcatgatcaaggtggacagctagaagtatgtcaatgccagcaattgtcctcctttggatttagccctctaggattttaatttccttttctcttggatattctcttatctaaggacaagccaggctcacctttcttttattaagttacatatgcatagctggcatatcactttctttgcctttcttggttggattggcattttcccatgcacatatttacatatatttctcacaatatatttatataaaatgaatttcatcacttttttattgtttgttttcctcctgtatttgtgtttgtttttttcttttgagacggagttttgctgttgttgcccaggctggagtgcaatggtgtgatctcgcctcactgcaacctctgcctcccaggttcaagcaattctcgtgcctcagcctccagagtagcagggattacaggtgtgtgccaccacgcccagcggattttgtatttttagtagagacagggtttcaccttgttggccagactggtctcaaactactgacctcaagtgatccacccgcctcccaaagtgctgggagccacagtgccctgccctctggtttcttttataatgaacactttaggaataaaagcaactactcttgctttgcttgtgactttgttttgttttctccctttatgcctctctcctctgagaccttccctttcggtctgttcccggattaacatgcacaatctgatgatgcctgtctttctacagaaagtatttctgtataaatactggtttacaaacctacagaacgcctaggagtgcgaagtaagcacagaagtctatcactgggagggaaagaataatcacaagggttccaatcctaaacgggaagccaaggtaacaagacctagcgtttattgagcacttactatgtgccaggcaaggttctaatgccttacagtacatatttactaacctatttcgtcccaacagtcactctattcagacaggtattgccccagataagagaaacggaacagaagcagcttgtccaagatcacacagcagagctgattccagtgcctgcgctatatactattacatcctcttagtcactgaattcttctgattaatttgggaacatttcctgccacaaacgagtgagtcaagaggtagctaaagcatggcactgattattcaaattgaggtgctcaccatgcttctagaaccatggatatgagatggctttacaggcatgatcactttcagacccgcattttaggaatgaggaaacagattttcgagatgttaatttgcccaaagtcacccagctagcaagcagaagagctggggctgtttgaatccaaagtccacggcactcctaaccgctgctcaacgctgccccacaagaacgtccagctggcaagacccgggtggggctcgttgctctccccgcttcacctccctgcttcacggccgggggtgtgctggctaagttcgctcatctgccaagcttcaggacacagacctatgtgagcaagcgataaacaaatgcaaataaatgtaactttccacattagctaaaaattcagagaacgtcaagcccagggaaatgggacggatcccagttagcccgcggctccaatctggtccccccccaaccccgagcctcgcggcgagaaaggaagcggctccggatggagagtaaagtgacaatcggagaagggcaggctgcctttcctcccgggggagccaaggggacctgcagagggcggtttctctccgcttttcctgtcccaccccgtcggcctgccccccaccccctccggcctctgcgccaaccccgcgcgccacccgcggcttcctccgctcggggtcctcgttcggcctctgctggcctccgcgactccgcggtgcccgcccccgttgagttcaaaaggacgcgcggagcggcgccggcccttcaccagcagcccgtccgactggaaaggtgagcacgagggaagggcgggggcgccggagagccgggtcgcccacattcgccgcagccacctcggccgtggcaggaaccgaaacccggagcggccgaagctcagcgctccgctggggcagagggtcgcggcggctgggaacgccgctccccgacgcaccggccgcccccagcgcagcgcgctccgcggggtgctggtaacgcggggggctcggggcgggggcggggacgggggcggggccgcggggcgaggaccaacccagcccgtcgcgtccaccccgcgttcgcaggggcgtcgaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaaggtaacaccccgtcaaactgcatgcggcctcagacctgctcctgtggagagctgttggtacctggagcctgaggagatattcagggaaaccagaagaggacaagagaaaaaggggaagggacttgggagaacctggcaccagaggctttcctgggacttccaggactcaaagccataggggcccacccgctacattcctgtctttgcccctcttcctacagatctgcctcttctccaagaaactcaaccactagtgacaatgaccagcctcctgactactccttctccaagaggtaggtgaaggcctttcctaatcccagtgagaaagaattgttcaacatccccttccccagaccagtcctggaagcctcagcccaggtgggaagactcccacctctctctgcctgcctcacacaggaagggcctgggaggaagcaggaactagagtgtgccccttagtacggttttaatctgaagtcacatggacatggtgacttcacaaatctttgtaacctcggtttatcaaataattttatgtcggtaatcccaggactttgggagactgagacaggaggatctcttgaggctaggtgtttgagacctgcctggggaacatagtgagaccccattgctaattcaaaagaaagaaagaggccgggcgtggtggctcatgcttgtaatgccagcagtttgggaggtcgaggtgggcggatcatctgaggtcaggagtttgagaccagcctggccaacatggtgaaactccatctctactaaaaatacaaaaaaattagccaggcgtggtggtgcacgcctgtaatcccaactactcaggaggctgaggcatgggaatcgcttgaacctgggaagcacaggtgagccgagatcgtgccattgcactccagcctgggcaacaaagtgagaccggtctcaaaaaataggaagggagggagggagggaggagggaggaaaggaaaggaaggaaggaaggaaggaaggaagattattgtataagcctaaaggaagggctttacattcatctgtctaataatttatagctatggcaaagaatgtagcagaaacccttgtaattaaatgtggaaaaggaatcttcaaagataacagggaaatcattttttaaaaacctgctaaagatagtattgctaacctctaagctccggtttcatcattcacaaaatagggaaaatagtacctatcttatgatttatgaagattaaatgagacaacccatataaaacacctagaagagtgtgtagtatctcgtaagcactcagtcacgttggttattagcactgagtacttgttagaaacccatctttcccttgaaagtgattttgctggctttctcattccactcctctggtgatacagacccagcatcaaaaccccattgttccctgaaggtgtgcggaggccgggcactactgctcagcactctgagaatggatgcccaccttttagttcatcatcaggctgggccggacaaactatcagttatttattgactgttttcagcatgtgctagttagggagagagaggaacaaacccttggttggtctatacacctttgtcttcctatacacagtcacatttgtcattaggacaggcattctctgcttttactgatgtggaaacaggtgagtgacaccaccagtggaagtctaagacagtgtcctctgtgactggtaatgcacacaattcagacttttagttgtctggtgagaagagataaaagagagaaatggccaggtatggtggctcacgcctgtaattccagcactctgggaggttgaggcaggcagatctgagctcaggagttcgagatcagcctgggcaacatggcgaaaccccatctctacaaaaaaatttaaaaattagccgggcttggtggtagacacctgtggttccagctactccaaaggcttaggtgggaggatcccttgagcccaggagatggaggttgcaatgagccgagatcatgccactgcactccggcctaggtgacagagcaagaccctgtcttaaaaaaaaaaaaaaagagttagggggacacggagtggggggggggaataggtcagcaaaggcttcatgggtgggtgaggaaggggatctgagtcttgcccttgaaagacggacaaggttcatacaggcaaaggggcgcagcaggtatcttagagaaacgtagaatacctttttcgtgtgtacctgctctagataaaggtagaatacctcataccatgtgtgaagctacagagacgatttaccctggaggatgttcaggaagcgggtgggcagaggacctccagaataatcctgcccacaagggaaaaaaggtgataccttggcagctagctgagggattagaaccttggcaagggggagctgtttacattttttaaattttattattattatttttgagaccaagtcttgctgtgtcacccaggctggagtacagtggcttgatttcggttcactgcaacctccgccccctgggttcaagcaattctcccaccttagtctccctagtagctggaattacaggcgtgcgctaccacgcctggctaatttgtatacttttagtggagacggggtttcgccatgttggccaggctggtctcaaactcctggcctcaagtgatctgcccttctcggcctcccaaagtgctgggattacaggctcatgccattttttcttttttaaaatttatggtaaaataaacatagtacaggtattaccattttagccattttttcgcagacaattcagtggtagagtagtccccgcttatccacaggggattcattccaaaaaccccagtggatgcctgaaatctcagatagtactgaaccccatctatactgtgttttttcctgtacatacatacttatgataaagcttaacttgtaaattaggcacagtaagagattaacaataataataaaatagaacaactataacaatatactgtaataagagttatgtgaaaatggtctctctcacttaaaatgtcttatttactatagatcttagaaacctcagtacacagttctttttttttttttcttaagtcaagaactttcaccttttcacttaaaggaagcacttcttgttggcatgtccaaattgcatcactattcttgtgctttggggccactgtcatgtaaaataagggttacttgaacacaagcgctgtggtactctactaagcgtttatagcatggacacaaaaggatgattcactttccaggcaggatggagcagggtgtgagatttcatcacgctactcagaacggtacataatttaaaatgtatgaattgttcctttctggaattttctttttctgttaaatttctatttaatgttttcggactgcagttgaccacgggtaactgaaacctaggaaagcaaaaccgcagataagaggggactactgttgttttttttttttgagacggagtctcgctctgtcacccaggctggagtgcagtagcgccatctcagctcactgcaagctccgcctcatgggttcacgccattctcctgtcttagcttcccgagtagctgggactacaggcgcccaccaccacgcccggctaattttttgtatttttagtagagacggggtttcaccgtgttagccaggatggtcttgatctcctgacctcgtgatccgcccacctcggcctcccaaagtgctgggattacaggccagtgcctggcctggggggactactgtattaagtaattcatgttcctcaccaccatccatctccagaactttaccttcccaaaccgaaacttgacacccattaaacactgattccccatttccctgcaaacaccgttctattttctgtctatgtaaatttgactgctctaggtacttcatgtaagtagaatcatacaatagaccttttgtgtctggctaacttcacttagcataatattctcaaagttcatccatattgtagcatgtcacaatttcctactttttcaaggctgaataatattgttgtatgtgtatattacattttgtttatccattcatctatgatggacagttgagttgcttccaccttttggctattgtgactgatgctgccataaacatgggtgtacaaatatcttcttgagaccctgctttcagttgtttgggatgtatgctcagaagtggaattgctatatcatgtggtaattctgtgtttgatttttttgaggatccaccatataggtttgcacagcagctgcaccattttatattcctaccagcaatgcataaaggtttcagtttctctacaaccttgccaacacttgttactttctgtttaatggtagtcatcatattgtgtgtgaagtggtatctcattgtggttttgatttgcatttccctagtgatagtgatgtggagcatcttttcatgtacttattgaccatttgtatatctttggagaaatgtctattcaagtcttgtcccattttttagttgatttgttttgttcttgttcagttgtatatttatatcctttaaaaattttttttaaaaaattgatcgttgaatcagtcctctctctctctctctttttttttttttttttctggcgatggagtcttgctctgtcacccaggctggattgcagtggcaccatctcggctcactgcaacctccacctcccgggttcaagcaattctcctgcctcaacctcctgagtagctgggattacaggcacacgctgccacacccggctaattttttgtattttagtagagacggggtttcaccatgttgcccaggctggtctcaaactcctgagctcaggcaatccgcctgccttggcctcccaaagtactaggattacaggcatgagccactgtgcctgaccttttttttttttttttttttttaagagatgggatcttactctgttgcccaggctggagtgcagtggcacaatcctggctcactacagacccaaacatctgggcttgagggatcctcccacctcagactcctgagcagctgggactgcaggcgtgcaccatcacgcccagctaattttaaaattttttgtagagatagggttttgctatgttgctcaggcaactctcccggcctgaagccatgctccttcctctgcccctgagttgttgagattataggcgcaagccacctcacctggctgcattcttgatccagcgagtgacatgagtgaagtagtgatttaggacagtctcctatccactgggtccaagcaagtgtaagttcagagacagcaatagacaaaagaatagaaatcacagataggaagaaagcttatactttaaatgatgggatcactaaaggccagctcttctcttctacccctgtcttgcatttctcttcccccaccttcccacctattcctccctcacagtctataaagacttcctagagaagatatcctccaggaaccttgaaaggaagggccacattatgactcctgagccctgggcacttctgtctttgtgggctcctccttcacttaaaaaaataataaaaatcatattttacaactgcatcagtgtaaggaagaatataatataatataattaatatttataattagtaattgaatggcataacaaccttaatatttctttgacctaaaattttgtttcttttccttcttctaattataaaagaaatgaaaattatttaaaacattttcatgggcctttcgaagcattgtgggcccagggcactgtgcctgttgtgcctagtgcataagtcagccctattcgaagtagggcagagtggaactgtgccttgtgggctttgcccaccgtgccaggtaaagctcatctcttgccaccaaatgatcacaccagctaccgcctaggttgtcctcaccctgtattagacacttagcatttttctttattttattttaaaaataattttttgtagaaataaggtcttactgtgttgcccagtctggtctcaaactcctggcctcaggtgatcctcccatctcagcctcccaaagcagcatttttcattgcacttattcctcaccacaacccaatgaaacaagttttagtctcattttacggaaggaaaaactgaagttcaggggagttaaggaattttcttttctttttttttttttgagatggaatttcccacttgtcacccaggctggagtgtagtggtgcaatctcggctaactgcaacctctgcctcccgggttcaagcaattttcctgcctcagcctcccgagtagctgggactataggcgcccaccactatgcccagctaatttttgtatttttagtagagacagggtttcaccatgttggccagactggtctcgaacttctgatctcaagtgattcactcaccccgacctcccaaagtgccgggattacaggcatgagtcaccgttaaattttcaaagattaaaaaaatttcccaaggtcacacagctagtaatggcagaggcaggattttgcgccaagtctgatttactgcaagcctgtgttctttctgtcatggtgtactgctcccaaggtctcactccacccaactggctggtgcacatgaaagagaaggcagaagaaagggggccgagtcccagggtggcttcccatggaaagaactcggggagccgccctctgctgggcaggtctagagcaaataagtaggctggcagacttaggtggcaaaagatctgatgcctcagtgataagagatttagctcaagctgggaacaaggaccacaaagaagccagccagtatctgggttaacaaaaaaaagagtaagtgaacagaatagatcttgaaggtcatttgctattggttaggacttgggtggggccttcaatcttatgaacctgagcagggaaggtttggaaagactgtagtgctatttaataattattcctttgtttggacaaaaaaatggggtagaaacgggagagaatgggggaaaagctataagccatttcctccttttatgccagctttcctgaacttagtttattttgttgttgtttgtcctttttttctttttttgagacagggcctcagtttcacccaggctgtagagcagtggctcaatcacagctcactgcagcctcaaccttcccagactcaggtgatcctcccacctcagcctcccaagtagctgggatcacaggtgcgtgccaccatgcccagttaatttttgtattttttgtagagacagggttttgccatgttgcccaggttggtcttgaactcctggactcaagtgatcctctggcctcagcctcccaaattgctgggattataggtgtaagccaccttgccaagcatgttcttttatttgaaaggtaatacatgcccctcagagaacagctttctagaccttttctatgtacaaacatatatatgcatatttatagggttttttaaagttacttaaaaaaaaatacacagagagacaggggtctcgctatgttgcccaggctggactcaaacttctggcctcaagcaatcctcccacctcagcctccaaaagtgctgggattatgggtgtaagccactgcactctgccaatttacttttttttttttttttaaacaaagatgcagtcctactacatataccacctggcagtttgcttttttcatctaaccatgtatcctgtcccagtaatattgtagatctcatattcgttttagcaactgtttccacaatggatggcctgtaatttatttcatcattcctctccagatagacattctaagtatgtctggattttttattttaaaatttgattttaatgagaattctaatagaacactttccatttataaaaattcaaaaattaaggctgagaggggttctgatgctcagctagttcaactaaccattctgtcctagaattctctctccaagatgctacgtagcttttgtccagttttgctcttccttctgttggggagacatctgtctttcccagtttctgctgttagttctcttgtacaggtcatgccttggcatattagaagacagaattcaagctctaggctcccttttttttctctgggctttctcttgcaagctttccttatctgacatggtttgcctgctcacttcaaaattgtgacacccaggccgggtgtggtggctcatgcctgtaatcccagcactttgggaggccgaggtgggcaaatcacaaggtcaagagttcgagaccagcctggccaacatggtgaaaccctgtgtttactaaaaatacaaaaaattagctgggcatagtggcgggtgcctgtaatcccagctacttgggaggctgaggcaggagaatcgcttgaacctgggaggcggaggttgcagtgagccaagattgagccactgcactccagcccaggtgacagagtgagactccgtctcagaaaaaaaaaaaaaaaaaaattaaggctgggcacggtggctcacacctgtaattctagcactttgggaggccaaggtaggtgtatcacgagatcaggagttcgagaccagcctgaccaacatggtgaaaccccctctctactaaaaatactgtaatcccagcactttgggaggctgaggcgggtggatcacgaagtcaggagatcgagaccatcctggctaacatggtgaaaccccgtctctactaaaaatacaaaaaaatcagctgggcgtggtggtgggcgcctgtagtcccagctactcgggaggctgaggcaggagaatcgcttgaacccaggaggcagaggttgcagtgagccgagatcacgccgctgcactccagcctgggccagagaatgagactccgtctcaaaaaaaaaaaaaaaaaaaaaaaattggccgggcgcggtggctcacgcctgtaatcccagcattttgggaggccaagacgggtggatcacgaggtcaggagattgagaccatcctggctaacacggtgaaaccctgtctctactaaaaaaatacaaaaaattagccgggcgtggtggcgggcacctgtagtcccaactactcaggaggctgaggcaggagaatggcgtgaacctgggaggcggagcttgcagtgagccgagattctgccactgcactccagcctgggtgacagagcgagactccgtctcaaaaaacaacaacaacaacaacaacaaaaaaaacaatcagccggctgtgctggtgcacacctgtaactcccagctacttgggaggttaaggcaggagaatcgcttgaacccgggaggcggaggttgcagcgagccaagatctgtcgtgagcagagatcctgtctcaaaaaaaaaaaaaaaaaaaaaaagaaaccatgacacccagatgaactcagcagtctaggcgtggtacaaagtagagcagtactgtggcctccattattagaccatatttatattgctggtgcctaaaataacagcaatctttaattttttatgattataaaagtaattctttatcattgtgagaaattcggaatataaaggaaagcatataaaacaacataaaattcaggcacacacctgtaatccaagcactttgggaggccaaggtggcaggataccttaaggccaggagttcaagaccagcgtgggcaacatagcaagactccctctctacaaaaaactttaaaaattagccaggcatggtggcacacacctgtaatcccagctactcaggaggctgaggtgggaggattgcctgagcccaggagttcaaggttacagtgatctatgattgcatcactgcattccagcctgggtgacagaacaagaccctgtctctaagaaaaaaagaagaaaattaaaatcattgggaattccacaacctatctgtaactcctgctgctgttttggagtatatccttccagtgtcagtggtttttttagggacccccccataagtactttatatatgatgttgctaagccatagcttccccattctttgtgagtagttggcttcctgaacctaagagcaaggaatgtgttaaattctcatcttgttcagtttggtgcatttcttcagtcatttgaaatgtgtctgtgtttatcagtttactagttgcccctctagctttgaagcctttaacaaatttgtcagggctgggcgcagtggctcacacctgtaatcccagcactttgtgttgttcaggcaggaggatcgcttgagcccaggagttcaaaactagcctaggcaacacagtaagactccatctgtacaaaaaattttaaaattgtcgaatcttccctgggtctgcaggatctgcatttaccccaagggcattcagctcagcctttgtagaaggcaccaataaagcataagaccaaaaatatgtatgtatatatcttgcaaagaatttgaagttcaatatatattttttgagacagggtcttactctgtcagccaggctggcatgcagtggcgcaaacatggctcaccgcagcctcaacttctcagactgaagtgatcctctagaatcctcctcagggttcaactatcagggttttttttttttttttttttttttttggtagagacagggtctccccatgttgcccaggctggctttgaactcctgggctcaagcagtcctcctgcctcagcctcccaaattgttgggattacaggcatgagccactgcacccagccttggactttcttatacttgctttatgatttaatatttttatttcaaattacataaaggccttattttggcccttgcatgatttgacataactatcaattcaaaaaggactaaggttaaaccacagtgaaagagtctctgtctagactggcatcacttcatcccttaacaacccattactgcctcacttaggccttatagccaggctgtatttctctgccttgtccacaaggatattataaataatcttttcttttcttccttttttttttttgagatggagtctcactcttgttgcccaggctggagtgcaatggcacgatctcagatcactgcaacctgtgcctcccaggttcaagcgattctcctgcctcagcctcccagtagtagctgggattataggtgcccaccaccatgcccagctaatttttatttttagtagagatggggtttcaccatgttggccaggctggtcttgaactcccaacctccatcaccttaggtgatccacctgccctcagcctcccaaaatgctgggattacaggcatgcaccactgtgcccggcctgtaaataatgttgttgtatgttttctgatgctatttactcttgcagcaccttcagttctccttaagcccctcctaccctcactctcaactgattatcttacatcctattttgtaattattaattaatttattttttgagagacagggtctgttacctaggctggagtgctatggcacaatcatagctcactgcagccttgaactcctgggctcaaggaatcctcccacctcagccttccaaattgctggacttacaggtgtgtgccaccatgcctggctattgcttttatttttatttttattttttttgtagagatggaggtctcactatgttgctctcagcctgatctcaaactcctgacctcaagcgatcctcccacattggactctcaaagtgctgggattataggtgcaaaccactgggcccagttaagatcttactttagaatgggtaggctgggcacagtggctcacacctgtaatcccagcactttgagaggccaagacaggcagatcacctgaggtcaggagttcgagaccagcctggccaacagggtgaaaccccatctctactaaaaatgcaaaaattagccaagtgtagtggtgggtacctgtaatcccaggtactcgggagactaaggcacaaaagaattcctttaatacccttgggaggaaggagggttacaagtgcccccaaaggtgggccccccttgccatttccaaagcctgggggtgacacagaacgcaaaagacttgttcctcaaaaaaaaaaaaaaaagatatgtgtattcccaagaaggtgttccctccatatatattgtttgggcaacacagagcgcctttgttccttttgagaaatctcctcttgggccccccgtgggccccccacaaacaccaatattttcttccccaccaatttcggggccctttttacaagaaggttgcttggggtatttaatgagggcaccaaaggcccacttggggccccagttaaaagaatccttattttttcttgaggcaaaattaaaagtttatcagaaagaaaacttgccaaaggtctcgcacccttcaccatcaaccttgccacctgcattagtgcccatatactctgcttttcctcctattccaatggcactgtctttgctgctgtctgcagcaagccccccagcccctctgtgctctagatctcatcccttcaaggaatattgtgcatcatcaattgtgcctctcatctgggtcattctcatctgtatgcaaacatgctggcatttctcccatcagaaaaacaaacaaatttgaattccctttcccctccagtcacagcctttctctactcacctttacagagaaattttgtgtaagcatttatttatattctgccttcagttcctctccttccatttcttccttgaacccaccctaaattacgggtttgtatccagcacttcaccaaaacttctcttgtaaaggtcgtttatgatctctgcatggcaaaagctgtttggctgctactccccagtctccttgggctcagtcttgggttctctttatctgcacttactcctgggtgatctcacccagtctatggtcttaaatatctaatgacttttcaacctctagtaccatatataagaatatatatatatatatctttttttgggtgggggggaggttttgtttgtttgtgttttttttttgtttgtttgtttgtttgttttgagacggagtttcgctctcattgcccaggctggagtgcaatggcatgatctcagctcgccgcaacctccgcctcctgggttcaagcgattctcctgcctcagcctcccaagtagctgggattacaggcatgcgccaccaccccggctaattttgtatttttagtagagatggggtttctccatgttggtcaggcaggtcttgaactgctgacctcaggtgatccgcctgcctctgcctcccaaattgctgggattactggcgtgagccaccgcgcccggcttgtttgtgtttttttaaatagagctgaggtcccactatgttgcccaggctgctcttgaactcctgaggtcaagtgatcctctggcctcagcctcccaaagtgctaagattacaggcgtgagccaccgcacctggcctccaaattctaatcttcatatctgaactttgatatctagtaagcaatcatgtttcttccaaatttgttccccctgcaggcttacccctctcacataactccatgccttcacccttgactccaccccacatccaatcctgtccgtctttgcttcagattatattcagaatctcaccactttctcactgagctgctgcaaaagcaatcaatgctgtcgtggaaattagaaaaaggggttgggcacggtagctcacacctgtaatgccagcactttgggaggccaaggtgggcagatcacttgaggttaggagttcaagaccagcctggccaacatggtgaaaccccgtctctactaaaaatacaaaattagccaggcatggtggtgcatgcctgtaatcccagctacttgggagtctgaggcaggaaaattgcgtgaacccgggaggcggaggctgcaataagctgagatcacaccactgtattccagcctggacaacagagcaagaccctgtctcaaaaaaaagaaagaaaaagaaaaaggcacaccttttggcagatgcaactgtgcacttgtgcagggtacaccctgcttctgcacgtgtgccaccttcccacagcctattgtccacactgtagtcagagggatcctttcaaatcaatccctgtttcaatcatgtattgctgctggaaggtctgctagactagaagggccaaaatggtctccctcacatgtctggcagtcagctgagcctggggtgcttggttttcctccatatggcctctcatcctctagcaggcaggattggggttcctctcaacatggtggtctcagggtttcacaagtgtggtctttggaaatcaggccccacctcagatctcctgaatcagaatctgcattttaacgagatctgtaggagattgttatgcacaagaaagtttgagaagcattgctttaaaacacaaacctaggccaggcacagtggcacatgcctgtaatcccaacactttgggaggccaaggagggagaaccatttgagcccaggagttttgagacgagcctgggcaacatagcaagaccccgtctctccaaaaaataacaaaattagccaggcgtgttggtgcacgcttgtattcccagctactccagaggctgaggcaggaggatcgcttgagcctgggaggtggaggctgcagtgagccatgatcataccatggcactccagcctggaggacagactgaggccctgtctcaaaaataagtaagtgaataaataataaaaaaaatctgatcagtctctgcccaaaaacctgtaaaagcttcccacctcactccctgaaaaagcccttaccttggcctacaaggcctgtgttgtacaggcctccttgactttctctgctcctcctctccccgttactcccactcaggggcctccatactgtgcatttaacaggccaagcatgcctggccccggggtgtttttcagtgctgtggacagccctcccatgaacttgctgtcccctctgcctggaatgttcctcaatcagctctttgcatgactgcctcccttaccttctttaggtcttcactcaagtcacctcatcagtaaagcttcccctgacaaccttctctaaaaccacaactccaaccacatcccagctttccatcctcttttctgcttatttttctacatagcgctaattaacgtctaatatagcatatcttttacttatttaattatttatttttacttttttttttagatggagtctctctctgtcacccaggttggagtgcagtggtgcaatctcggctcactgcagcctccgcctcctgggttcaagtgattctcctgcctcagcctcctgagtagctgggactacaggcatacgccaccacacccagctaatttttgtatttttagtagagacggggttttgccatgttggtcaggctggtgccaaactcctgacctcatgatccacccgcctcggcctcccaaagtgctgggattacaggcatgagccaccgcgcccggccttattttatttattgtctgtcttccccctctaaaaatgtaaattatataaacagagggttttttaattgtggtaaaattatacataacataaaattgaccattttaaccattttcaagtgtacagtccagcagtattaagtacattcatgttgttataccttcaccaacaccactatgcatctccagaactttttcatcctcccaaactaaaactctatactcattaaacattaactccccattttccccttctccagccccttacaatctcctgtagtactttctgtcttatgaatttgattgctctaagcacatcatataagtggaatcatacaatgtttgtcctctttttttttgtttgagacagagtctcgctctttcgcctgggctggagtgcagtggcatgatcttggctcactgcaacctctacctcccgggttcaagtgattctcctgccttggcctcccaagtagctgggattacaggcacctgccaccacgtccggctaatttttgtatttttagtagagacggggttttaccacgttggccaggctggaatgtttgtccttttgtgcctggcttatttcacttagtgtcatgtcctcaaggttcatccatgttgtagtatatgtctgaattccttccttttttgttttttgtttttttttagaatttccttcctctttaagggtatgtatataccacattttgtttatccatttatctactgttggacatttgggttatttcaccttttatttagctattgcataatgctcctatgaacatgatatacaagtatcagttgaagtccattcatttcttttgggtatatacctagaagtgggattgcgggatcatacccacccagcaatgagattgctgggtaattctgtttaatcctggcaggaactttaaaggtaagggtttttgcctgtgttgttcactgatagaagcccagagcctggcacagagtacacactcagtaaattcttgttgaactaactgtttaatttccctgtctaggaacctggaatctcagtctaagaaggctgtgcagcttatctgacccagcttgctctcagtagtcccattctgacttctaatgcttgctgtttcgagttcaaagccccccaaacaggccgtaatagtgtgttctagaactttgctggggagtcacatcaagctcaccattgctttatggactccaccttccttccatggccccttcaggttcccgacccctttctctttctcagaagctcctatgtcaccaacagaaatcccatttacaagttcttgcagtgcctttggctgtcatatctggtcccttttagattagtctggtgcttgctgggtttctttgcttctcttgagctcacttcccccatgtccccaaaggctccactgctccttagtgcaaaaaaatgattctctttgataggaaacagaggtgaaaaggcctgagggaattctgctttctctgttacctccaacctgacccctcaggcccaaagaagcctagctttttctttgttcttgttgcaaatataatgctttttaaattgtccttcggggggcgatgtggctcacgcctgtaatcccaacactttgggaggctgaggagggcggatcacctgaggtcaggagtctgagaccagcctggccaacatggcaaaactgtctctactaaaaaatacaaaaattagccgggtgtggtggcacatgcctgtaattccagctacttgggaggctgaggcaggagaattgcttgaacccagggggcggaggttgcagtgagccgagatgaagccactgcactccagcctgggtgacacagtgagacttggcctcaaaaataataataataggccgggcacagtggctcatacctgtaatcccagcactttgggaggccgaggcgggcagatcacgaggtcaggagatcaagaccatcctggctaatatggtgaaaccccgtctctactaaaaaatacaaaaaattagccgggcgtggtgacatgcgcctgtagtcccagctactcgggaggctgaggcaggagaatcgctagaacctgggagacagaggttgcagtgagccaacatcgcgccactgcactccagcctgggtgacagagcgagactctgtctggaaaaaaaaaaaaaaatctgatgtagagtctgccttcttgtcatcgtttaaatattgaggtaaatttctttgcacctttcttcatctgcactttctgcttcaccagatggcttcatataagtggaaactgaccaatagctgcatcgcagcaaggcattctgtagaatttttttcttaaggtcttcctgtatggctaaaatattctctagttgtgagaaagcttgcttctgatcatgttaaacattaaagctaaagagggtggggagtcctctgaacctcttttggttctaggggctgctcaatttaaaaaaattaaagaatagataactgaaaataaactaaaaataaagaagtcacatataaaccaacatgacttctgcattacactgacatcgttcccttaagttacctatcaccagtgagccagttcatgttaaagaagcactttgtagcacaactgtctgtatttaattgtgatcatctggtttcctcccacctttattctttttttttttttttctgaaacagggtctcactctgtcacccaaactagagtacagtggcacaatcacagctcactgcagcctggacctcctgggctccagtgatcctctcacctcaagtttaccgagtagctgggactacaggtgtgtgccaccatgtctggctaacttttttttttttttttttttgtagagatgggagtctggctatgttgcccaggctggtctccaactcctgggctcaagcgatccacctgccttggcctcccaaggtgctggaattacaggcgtgagccactgcacccagcctcctccatatattatttttaaaaaacaaatagagatggtgtcttgctatattgtccagattagtctcaaactcctggcctcaagcaatcctcctgcctccgcctcccaaagtgttgggattacaggcgtgagctaccacactaaacctaatgtacaaagtaagttactgttgatgattgaacacaaattactcatcttcaagcttctgatatacattaatcttctcaatgctttgtacatcctaaattctcaaaatgtttaaagaaagcaaaactaggaacaactgtatagaactctagatccatggtaggaagatggattgcagccctgggcgatttggggaggaaagtgcatggtgaaatgtgtgaagtcatgaccaggtagataaacttcagggcttccctttgatgggagtcacagtgttgtataacctaatctcagaagttacatgccatcatttttgccatcatctgttaaaagcaagtcaccaggttcaacccatataccagaggagaggcatgctcaaagatgtcaataccaggaggcagaaatcattgtgagccatcttagaagctgtacaccacactcccatttcacaaatcaagaaactgaggtactgccaggtgtggtggcacacgcttataatcccagcattttgggaggccaaggcaggaagattgcttgaggtcaggaggttgaggccgcagtgagccaagattgcaccattgcactccagcctgagcaacatagtgagatccttgtctcaacaacaacaacaaaaaaaaaacaaaaaaaaaacacaacaacaacaacaaccaggttcagagaggtttagtaacttcctcaaggtcacctagtaatatgcttaggcaggattcaaacccagagcaactctccctttaattaatttatttttttgagacagggtctcattactctgttgcccaacaattcagtaatgcagtgctggctcattgcaggcttaaccccctgggctcaagcaatcttcccacttcagcctcatgagtatctgggactacaggcgcatattaccacacctggctaatttttacatttttttttttttttttttttgtagacagagtcttactgtgttgcccaggctggtctcaaactcctggcctcaagcgatcttcccaccttggtctcccaaagggctgggattacaggcatgagccaccatgcctggcccttttaatcactaagcatattaacaaagtcaccttaaataatatttaagtagtagctactatatgatgtttacatgttctctcatttaatcttcataataaaactgcaatgttggttaatatagttcctgtgggtaacagatgagaatggatgaatgaatccatatgtataggcgaggcacagtggctcacacctgtaatcccagcactttgggaggccgaggcaggtggatcactcgaggccaggagttcgagaccagcctggccaacatggtgaaaccctgtctctactgaaaatacaaaaattaactgggcatggtggcacacacctgtaatcccagctactcaggaggctgaggcagaagaatcgcttgagccaggaggtggaagttgcagtgagccgagattgcgccactgcactccagcctgggcaatggagcaagactccatcttaaaaaaaaaaaatgtataactgttctagacaaactctaaaaccatttttcctcagctctcacaacagttgacacagaagacttctgtgaccccaaaatatttgagaatttctctgcaccagcaagcaagcaagcagttccacagcagacaccaagagggtgtcttccaattcaattccgacactatctacctagagatagtgtcagataccacaggccaaggtctgggcccccaaggctgcagctcccttcagacactagtcacaagtccaggctccaaaacttgtgaccaaccagcttcaagttggagttcccacccctgccaacccctgctttggagttcaattaatttgctggagtagctcacagaactcagggaaacaatgtgtttactggtttattataaaggacattgcaaaggatacaaatgaggacatgtgtagggtgaggtgtggggaagggataaaaacccaattcgcatgtagcccccactgcacgagcggccggcggacggagaggaggcatggccacccgccggcgtcccgcgcgcccccgccgcgcgcccccgcgccgccccgggtcgcaacgcgcgccccgcgaggcgttcaaacacccacacgagccgcgctgcacggccgcccgtgtcgcgcactcctccccctctgcagcgagcgagatgctccaactcacacacacaacaagacgcccacaccccccgcccgcgtcaacccacgccgaatgaccgcatgacaactacgtacgcgacgtcacgcgtcgaccgaaccactatgccaacagcacctccgcagatcccagcgtcgacagcgagtcgacagaagtctaagtgcgacataagttccgcgacgcgacctgatatctcttcgactacctacctcagccgctcacacgagtcgcacacgcaccggcacgcccccaccatagacgcggaccctaactggcccgcgaagaacgctagcnnnnnnnnnnnnnnnnnnnnnnnnnnnnnnnnnnnnnnnnnnnnnnnnnnnnnnnnnnnnnnnnnnnnnnnnnnnnnnnnnnnagagagtgtgtgtgtgtgtgtgtgtgtgtgtgtgtgtgtgtaaaacaccacagtaaccattcgcccaaggccagagtggttgagggtactaccattcctagacaaagaggggaccagagagaaaggtttggcctggccttgggagaggaagcgctctggacagcctgcctctgctttctgtattgcaagatgaggatggttcatcaggctcccctgggcccgcgtggaaagacccttcaacactcttggcccctcttagcataggcccaccagaccaccactgataccctcatttcacttgctgtggatggaaacctgaacgtgtcaggcactggacgggagtcatgctcacaccgcgctcgggccacgctggcctttgagtcccctggtctcagagctttgacccaggctcttctctctgcctagaatgtgccccatccctgttacccggtaaactcttacccctgcttcagctcccaggtcagatattcctcccttggggggtcgcttctggctggaagactagatcaggcccctcggctgcacactttcctaagtgcacttacagcagctcctcaccgtgcaagctgtggggtgcagtggagggtgagcctcgggaagctggccgtgtctgttttgctcgacctttcatctagcacagggcctagcaaagaggaggcagtgggtgagtgttgctgtttatgggatgccagtcaggtcggggtgcctcctgtgggtgttgccaggatcagccagctggttttccccaggagacctctatcctgcagtaacctctacattaaaatgctaataggaaagaatggaagggcttcctgacttcctgtgtaaacacttaaaagggacttctggagaccactcattttgtcatgttctgtccctgggtaatgactttagggtgggactttcacgctctgaaggataaataaacccgtagcaggagggggtgcaggatctattttagggtagaggagaggcctgtttcagaacctttcaaattgcagggcctatcctggaagtgtagaaaagggtttttaataggagaggagcactatttcattatgttaaaataatgtttacaaagaattagtaagaatgctgcaagaaaatgcacatgctatataatataatgtaaatatatacacatacaactcatttgatctcacttatgtaaaaatatgcattcctaataatggcttatcctactgagtgacttattaaatgtcacaacaacgttttaaagtaggtactcttacctccattttgcagatagaggttaggtaattttcccaaggtcacacagctagtaaaggacagagttcatatttgaaacccagtctgtcaggctctatagcccctactcttaatcactatattatgcagggagaaatccatcaacatattgtctttgggtggtggtttattttcttctttattctctaggattttctatttggatatactctaggagttaaatgataaacttttgaatagggaagaaggtggggtggtgaaatttgaaggccaaacatatgctttcaaacaaaagaattcactccatttccttttccacttttctacattttccagaagaactgatgaccaccccaattttacagcccactgaggccctgtccccagaagatggagccagcacagcactcattgcaggtaatagactctgagccaactccaagggaccttctggatcaagggcatctctctccagagggagcctgaccaaatccattaatgggctcactctggcttgtaagttatattacacacacacacacacacacacacacacacacacacacagccataaaagactcggaggcttctgtcagaggcactaccagtaaatgacaggttgggaggtggccgcaaatagatatgcatacggacgttacacttgagtacgtgggtagggacgaggatatatgtggttggttgagtgggtgaggaagagggggaggatcagataaaccacttcctgttaggataagccatttcctgttccctccttcccgtttctttaagaatcaggaactggtttgggaggcagttcagttttgtcagaaatcaaaagcatgtgtccttagcttaagcaccaggagactccagctattatgtgccatggaaattggggttggtgggggaacatgggtttggatggaagtggacactagttaatgaaaacaagaggatctttacgaaaacagtgactaaatcagatgactccaggaactactgagacatcctcaatcctgaaacatctctacattttccctctcctttccaagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaatcagattctcatgtgcaagaagtaactacattttgacttatttttgcttaaacatttttgacattttcttttccctatttaacgcctttacatatgttctcttccaagcaataagaaccctaggaaagttctagaagtttgcagaactatctcagggatttgagacaaagatggtgcaggaaagcttgttccaggggaacatcattagaaacataccctgggagggccgggttcggtggctcacgcctgtgatcccagcactttgggaggccgaggcaggcggatcacaaggttaggagatcgagaccatcctggctaacacggtgaaaccccgtctctactaaaaatataaaaaaaaaatagctgggcgtggtggcgggcgcccatagtcccagctgcttgggaggctgaggcaggagaatggcttgaacccaggaggcggagcttgcagtgagctgagattgcaccactatactccagcctgggcaacagagtgagactccgtctcaaaaaaaaaaaaaaaaaaaaaagtaccctgggagatgagttggttcaagcctccatcctggcaagggccagaatttcccagaatcccttctacatatatacagaaggaaccagaaaaaatcaacctaccacctttcccagtgtatcctcagaatcaagccaagaagcttcttggattttagtctcaagataagttgtgtttaaaaggcacattttggtataaattattagctcatcagatattgttcactttggaattaaagctagatctcctttgaagtcttaatgtattgcctctgttgtccaagctcaaacccaaccaagttaagatcaagagctgaggaatctggctgggtgcagtgactcactgcctgttatcccaatactttgggaggctgaggcagacagatcacttgaggtcaggagtttgagaccagcgtggccaacgcagtgaagccgtctctactaaaagtacagaaatgaaccaggtgttgtagcaggtgcctgtaatcccagctactcaggaggctgagacaggagaatcacttgaacccgggaggtggaggttgcagtgagcagacactgccactgcactccagcccgggtgacagagggagaccctgtctcaaaaaataaataaaagagctgaggaatctatcttggcaacctagattctatgagttttcagtatttctccacatagaacattggagaaactaaaggtcatcctcaacgtatacaaattgctataccagaaccttttcttcaagccaaactttagagcaagttaggagaatcaatagttccctcatttctaagtttaggtccgaaattccaaaatttgtaagaggttggagtaaaatgatgaaaagttgaacatctggaatggaattcatgaaatgatcaagtcttaggcttgtactcctgcctttatttcaaagcgtcatcaaaggaaacagagcagcagcagcacctagctgaattctagatgggatataaataaaatatatatagaagaaatctaaaaacaagctaagtaaagaatccttgcagtgaggtgtaatgcaacttcatcactttattcaaatcttcaaaatagtctttattctacatttttagtataaaaattccacaagttaagtgcaccacagtgtagagagagacatacaacgctgaacttccataacagtcaatggtacagtcaaacatcacatgtacagaacacacaatttagatgaactgaaattataagataaaataaaataaaatccaatttcagaaaacaaaaatcaaaacattaaggatccctgaaatattcttaaaccctaatgagatttcactggactcaagtcattttgtagtgagacattcacaatatgaccctattaacccagtctaggaattctggggagccgaatgagtggccgcatcagacactctgacaaaaaatggtaaccagtttttgatctgaaaactcctcttaatttagctctgaacacatcaatcaagcttttgaaatgcatcctcctccttgcccctcatattttaaaccaactgttgttcacagtacagtttgcacgacatctttgttcaaacatagctcagtttttctggcaccaaagcaaatttgggttaggttcgtgtatgcagagacaacctatgaggagggcccataaggcaccctccacttttgcctgaggagatacgaaagcagaagtaatgggatctgtacttggggcacagagagggtttcagaggatccttgtgaaacactagttaaaagatgacgagtggggagaagtgcgaggaaagaaggaaattagtctgactggctttctgtcctgcaccattgattcaatggagactggcgggaggaaatggaagactagggttggagatgggatgggtggggcaagggatggaaaggaaaaggcagacaactaatgcgttccatttataacaagtaatatatatcaaagacttaaaggagattaaagaccaatcagaataatttggcaactttaattcttaggaagatcaaagttccctccaaacctaatttgatgttttattactaaaagcaaagaccagtatggtacagtattactccagagaaattaaaggaaaatccttagggcggcttcacccacattcattttatgaatggatacctcccctacctcaaaatgctttagggaggtactgctaccattacatggttccttattaaatttgaaaagtgcctgaaagtttgggcaccagaaagacaccccaacaacatgtgtctaaactgcaacttcaggttaatatgactaaagcagttacattgtgagaagtgctgaaggtatgtgatgtctttcccggcacagaggtggccttggttcctcaccagatggtgtagccaccatctgaaccacccatgaagaagttccccttccgctgagttacgaggacgttggctccctgcatgactgcaagctgagcagcattgggagggcatccaggaggtggaggctgaaaggaaatgacatgatagaatgggcacagggcagctaatataagcgaaggggacataggggaagcagaggcctgttaggatgaggcaatgtgctaaccagctgcgttttaaggagctagttccgccaccaatttgagttctaaagtaggtctatactttatgtgaacccaaagatacaaacaggaaagggagcctaccactcattcaaagggttccagctctaagatgaagcctatggctaccttctgaacatgaacagaccagaccaacagtcattttgagggtagagaaccactgtcctactcacattcccaaaacagggacagggtgccagtccatgtatgaatcccacatggtccctacatagtttttaatttttaattttttttttttttaatttttttgagatagagtcttgctcttgtcgcccaggctggagtgcagtggtgggatctcagctcactgcaacctccacctcccaggttcaagtgattctcctgtcttagcctcccaagtagctgggattacagacgcctgccaccatgcccggctaatttttgtatttatagtagagtcggggtttcaccatgttggccagcctggtctcaaactcctgacctcaggtgagccaccgtgcttcgcccttacacagtttttgaatgaactactggaaaactgaaggctcgctaatgacacattcacttcatctctagcatgtagttactgagcagtcatttgagctctaaatcccacgcactggggaattaagtaggaaaaaatgataactaaaattgttaatatctttctaaaagctacttactagggattatacattctacttttttaattatcagggttcctagtgcaacaccatgctgatggcaaatattaagtaaatggtaaatgcttatggaatgaataaggagcattactagaccagttcagtgtaccacaatgaactggaaaagcagcaagcaggactcgacagacatgaaaacaaaagaatctggttaactcagcccccagtgagatgctactcacttgccacagttctgccccctcaaacactttctgcctgagtattggatgtcagtagttgtaccaacactggcaactatcatccagaaatggtaagagaatgaatatgaagtcatttcagaaagttaaaatacacaagggctgagtttcttctgatgaggtcatactcacaggaatgttgccagcagtagccccagctccaaatctggcacctgcatcataccctccttccaccagcactgtggagccaggtggatagatgggaccgactggataataagccatggggattgtggaacctaaaggcccaacagccacagactgggccatgggaagatacagagaggctccaggaaatgcggctgacatggtggggactgtggcagcccctgggtgcacaaagctcggacgatagagctagaagaggcagaagagaaggcaaaatgttactttatgacattcctatttgagatctctttaatgagctaattcttaattctccttatgcaggttatactttttgtaagattatacaagttgcctttccactggccttcaatattctcctggatcactttctgctatagctaatgttgggctcacagaacgcaaattcatcttctgcaccttagcctgtgccaaataacacaaaatcatcaaataatgcactttcaactccgacaaaaattgccaaattatatagtgttttagattattcatgttagcatttgtgaagagtaaatatgtgaagtcagatttagctaaggactaaaggaccaccctaagagtattcccagctagttcaaatctggcaaactggaagcacctctgagtaggcaggtggagcatcggtatagggtggagcctgaggaagatgcaaggtctgagggtatactggattcccaggaggctgcacagggtaggttggctgtgttggatattgacctgaaagacaagaaaaaaatgaaggttgcctactacacagagctaccaaaatgaggcaggtcatatcgggtagctaacttagtgggagcaagcagaaggggatttgcaaatagtctgccccagagggcctgattcctggaactaagaaaatatgcattgtctttgcacccttaaaatggaaggtgctggattctaacgagacaagaaaggcactgctcactgctcctactaacataccgaagtaaggggttaagtctacctgggcccaagttccctccggaatgcaggacaggtctggggttctggcctgctgctgttctggcttatcaagggtgcctctgctctaggtagtctccacagcctgtctacaaccagcccagacttcgtgggtaacagcagttctgattttccttacagattactattcaaggtcgacttccaaacaaagggtgtgaatgatggaagtgaaccgtgagactgggaaaagggtgcagggctgaggggtgaggaggaatatcctcactggaaaagcgggggatcaggtttggttttttgtttgttctgagacggagtctcgctcttttgcccaggctggagtgcagtggcgcgatctcggctcactgcaacctccgtctcctgggttcaagcaattctcctaccccagcctcccgagtagctgggattacaggcgcccgccaccacgcccagctgatttttgtattttttaatagagacggggtttcaccacgttggccaggctggtctcgaactcttgacctcaggtgatccgcccgcctcgacctcccaaactgctgggattacaggcgtgagcaacctcgctcggcttttttttttttttttttttctattccttttttaccccctcaacctattcctgcgttatgggaatcatgttccgacagacacactggtacaaccacagaaaaggggagaagttctgatcccgtcagcgaagggcgagggggtgcgaagggaaggaaaagagacctcacaggccccggcccacgaaccaactccagcaattcagtagttaagttcggccccgctgggggttccggagcgcggcgccccgcctccgccggctctccattggcctacgcgaatgcctgcgctagcgctctatttgctcctgcggatgcccatcatgtcaagcccccccaccacccgagcccgcagctccaaactgcgccacagagtttacggaggaaagggcctggaggcagcaagctgccgtaatttgggtatgacgaaggcgtcaggcgcagcgccctggactgcagccggccaaggagcatggcgcagcccaccccaaacctggcgtttggtgaccctgggctccgaatccgctcgctctgggccagcagtactccccccgacggcctctgccaccctcggtccttgcctttgctgttcatggtggttgcgggtccggtttgtctcggcgtcgcggacggttatttttttcgtcctcttcctgttcggagctacttccgtgtcacatgatggtccgtccgcctagcgtcacccgacgcccgagtggcgctgccgccggaaactccgcccctgctccgggcctccagtcggccgcgggagggtccgcgcggtcccgcccactcgccttggccccaccccctgctcgtttctgtcctccacccccctaccggtgtccctcagctggagaaaaaccaaatgcaggtattgtctggaaacaggatcttttctctgttggacgctcggatgcagaacgatgcaagcattccccggaacctttttccacctacacgcattcactcaaggtcacctcaccttggcaaccttccacgaggggcttagatttctgcagatttgtcgcattgcctgaaatcggctccccacaccttagtttatcatgcgtccctccccaccaagcccaacttaagcttcagctctgttaaaatttattttgccactccagctcacatgtatcctttcctgaatgagacctgcactggaatcttcgctgccctgtcttccccaggacagtcgttgcctttctcacgtacaggaaggggttatgttttccgtgctgtacgcaacacctggcactgaaactgacataactgcactacccatggagtgtttgtggccctttcctttttttagcacctgttgcaggtgacctgtatggtacctctatttttctctatgtatggcttctctttctaacctaattatccttaagggcaaagatggcatcctttagggcagcgattaagtgttttcttttctttttctttttcttttttttttgagacggagtcttgctcgcttgcccaggctagagtgcagtggcgcgatctcaccacagcctccacctcccgggttcaggcaattctcctgcctcagcttcctgagtagctgggcctacaggcgtgcgccaccattcctggctaatttttgtatttttagtagagacggggtttcactatgttggccaggctggttttctttctttctaaaaaaagttttaattttttcttttcttttttttttttttttttttttgagatggagtcttgctctgtcccccaggctggagtgcagtggcatgatctcggttcactgcaacctccgcctcctgggttcaagcaattctcctgcctcagcctcccgaatagctgggattacaggtgcccgccaccacgaccggcaaattttgtattttttagtagagacggggtttcaccatgttggccaggctggtctcgaactcctgacctcaggtgatccacctgcctcggcctcccaaggttctgggattacaggcataagccactgcgccgagccttatttttatttatttatttatttatttatttatttatttatttatttttgagacagaggcttggtctgtcgccaggctggagtgcagtggcgcaatctcagctcactgcaacctccgcctccagggttctaagcgattctcctgcctcagcctcccgactagctgggattacaggcacgtgctattcattttttaatacagagatggggtctccctgtgttggccaggctggtcttgaatttccagcctcaagcgatctttccacctccattgtccaatgattaaagggttaactcttaggacccaggaactctcctgggcctacctcctgctcatgtaaactgccctcagattggtcaggcctactttacaggttgttgggtattttgcttgtcacagtgggacctgggcattgggaaaaccagggcagagccaaatgagattactaacaaaaatgaaagagttgcaggccagtgctttctctggcaggtggaattaagaagtaaatggtggctgggtgcaacagctcacacctgtaatcccaacactttgggcagcctaggcaggaggatcgcttgagccaggagttcagaaccagcctaggcagcatagtgagacttcatctctacaaaaaaaagtagtagtaattagctactttcttggacaggatcaaactttggcattttcttcattctcgtagattccccaatgagatgaagatgtttatttggtcatttatcaaacattctttcttacattaatttaacaaatattttttgagcacctattatgtgccaggccctgtgacaggcactagggaaataataatgaagagacaggcatagtccatactctcatggaatttatggtctacctaatgggagagacagaaaagtgaacacataatatgattagtgctgacataaagacagcatggagtgtgaggagaacacataggtgaggcacctactctattctgatgtaatcagggaaggtttcctgatgcaagtgatgtctgagatgaaatctgaagggtgagagcaggttaagcaagtgaagagggttcctggaagagggaactgcttatgcaaaggcctagaggtgagaaggcttatagagggggagggcatgaaagagttcagtgtagccagagcatactggtaaggggactgataaaagatgaccctgaagatccgggtgcggtggctcatgcctgtaatcccagcactttgggaggccaaggcgggcaaatgacttgaggtcaggagttcgagaccagcctggccaacatggggaaacctcgtctctactaaaaacacaaaaattagctgggcatggtggtgcgtgcctgtaatcccagctacttgggaggctgaggcaggagaattgcatgaacctgggaggcggaggttgcagtgagccgcgatcgtgccattgcactccagcctgggtgacagagcaagattctgtctcaaaaaaaaaaaaaaaaaaattgacgctgaagaactgtgagccagaccttgcagggacgccttagagcccatgtaagatcccacatgaagatactggattctatgttaagggcactagttagccactgaagaatgttaagcaggaaagtgatatgatcttgtttttgtttgattgattgattgattgggacagggtcttgctctgtcacccaagctggagtgcagtggtgcagtcacagctcacggcaacgttgaactcctggtctcagttcatcctctcacctcagcctcccgagtagctgggacagtgggtgcttgccaccatgcctggctaattttaaattttttatagagacagagtctcactttgttgcctagagtagtctagaactcctggcctcaagcaatcctcctgcctcggcctcccaaacttgggattacaggcgtgatccactgctcctggcttgtgtttttcttttagaaaaatgcttctgggccaggcacagtggctcatgcctgcattcccaacaatttgggagtccaaggcaggaggattctttgagcccaagagttcaagaccagcctgtgcaacgtggtgaaaccccatctcggcaagaaatttctaaaaaagtatccaggcatagaggcacgcacctgtgatcccagctactcgaggggttgagataggaggactgcttgagcccgggaggtcgaggctgcagtgagtcgtggtcacaccactgtactctgccagcctcggtgatagaggctatctcaaaaaaataaagaaaagaaaaggaaaaatccctctggttgctaaagaatatagaataggttaaagaaagggcaagagtggacgtatgtctgagataccatttagaatcaaatttagtcatttaggtgtgatgatggcagactggcctagggaagaggcagtacagtagagagaaatggggggattccagaaatatccaggaagcagaaacaactggactagttccaggactaatgtcaggacaaaatttctacaaagtcaaaactccatatagtcaaatgacaaattggaaaaatatatttgtaatttacatcacaaagagctaatcttcctgcatgtaaagaactcttagacatcagtaagaatatgatcaaccattagaaaaaaatggcaaatgacatttacagacagacagttcacagaaaaggaaaaacaaatgactccctaacacatgaaatgatgttcagcctgggtcgtaatcagaaggcagattaaaccccaccgatatcattatcagattggcgaaaatccaaacatttgctaacattatttgcagggctgtggataagcaggcattctaatttgttggtgatgggggtgaaaattggtacaaatcctataaggttaatttggcaatatccatcaaacttgcaaacataccattcccactaatgggagtgattctacagatatatttgcactcacgagaaacgtatgtataaggctattcattgcagcttttctgtaacagcaaaagattagaaataacccatatttctatcaataggaaacagaaaaaataaatcttgatacatccatacaataaaatactatgtggctgcaacaggagaatgagaaagtactccaaggtgttctttaaataaaaaagggaaagattcaaaaccatatacttagtgtgatacattttatttattttattttttattttattttgagacagagttgcactcttgtcacgcaggctggaatgcagtggcgtgatctcggttcactgcaacctctgcctcccaggttcaagtaattcttgtgcctgagcctcccaagtagctgggattacaggtgtgcaccaccatgcttggctagtttttgtatttccagtacaggcggggttttgccatgttggccaggctggtctcgaactcctggcctcgagagatccacccgcctcgccctcccaaagtgctgggattacaggcgtgagccaccgcacctggccaatatgatactttttatgtcaaagagcagggaaaccaagaatattcatcagaatttgagtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12770 - DNA, 77661 bp, Human
  misc_feature (1)...(77661): n = A,T,C or G
cctccctggctgcctctagtttctccaggagattaaccttttcaaaagatagatgcacattggattgcaccatgcccatgcttaaaactggttatccagtaagcatttcgtaatactcaagtcagtaacttggctaaggcttacagggtctggccttggcccatgcctacagattcactcccctgactcctccccatggtctctacccagccacatcagctttcattcattgttcaacaaatattgatttgcttgtcttgtgttagagagtcattgaggatacattagcgaccaaacaaaacacagttattctactcacagaacttagattttacagggtgggggaacaacaacaattgctagttgtaaaaagtataaaaatgaaattgaacctgcaaataaaaaaagagtgctcacttgagatacagtagccaggaaagtcttctttaagaaggtactattttagacgtaacctaaatgatgaagggaagtgccacgtgttgaatggagaagagagaatttaggtacagggaacaacccatgcaaaggttcatacatgctggaaagaagttggtgtttgaggtatccagagcagatcaacttactgtacagttagtggggagtgaggtcggctgacacttgattgtgcaggacctgggaggccatggtaaagatcagaattctattccttttcccccctcctctttttattttataaaatctgttattttagaaagttgcaagactggtacgatgtacaccattatacccttcaactagattcaccaattactaatattttgccacatttgctttctctatttttttgccatatcttttgaaggtaagccgcaaacactgtgacactttgctgctaattactttagcaagcgccttccaaaaacaaaggcattcttccacttaatcacaaattaattctcacatgcaatcaatttaaaactgattcaatatcatctaatatgtagttcatatttaaatttccccagttgtccacaaatgtctttcgaagtttttttttttttttaaaaactatgaaccagccaagattcacaaatttcatttggtttcttttgactctcgactaaagtaattttccacttcgtttttttctttttcctgtcatgacactgacatttttgaagagcctaggcctgttgtcttgtagaatattctacattgtttttttctgattgtttcctcatgattaatgtcaaacatttctagcacaaatactatcgggtgatattagcgatgctaagtatcttcacttggttaaggtatgtctaataaatctcttcagtgtaaaattctattttccctttataataagaaatgatctgtagggtgattctttgagatactaacatcctcttccctacaacctttcagttaattgtttgttttagcatcttgcattcattagttttagcattcataagcttacctatatcaatttttagactggcagttgcacaatggggatgcagcgagggaagtgaccctccggatcccgggatgccgagcctttttctgccccgtagggacaggactgggaagtggctagcccgccattcctcggcccgtccttaggggagtcgcaggactaagtgcagtggcagtggcctcacctcgggccttcgccacatctttattgcctcaaggacagaattggagatcggtgtcccagtcaacagcgtggtacttatgacagccgcgagaaagcgcactactaaagcccggctagcagagctgggaggcaaaccagaccgtcagcaccagggcggcccacgcctgcttccgcccattggctgcccgcgtttcaagacccgcccccatattggagagcttcttccggtagccactggaaagcccgcagcgcgagccggctacgctccctggcggagctctggacgccccacctactcccagcgttcagtgcggtgccctggccgccattgtttgaatttgaaaacggtaacatcgcagtgctgctcgcgggtctggctagtcaggcgaagtttgcaggtgaggaggtgacccgcgggaatgtgtggggaaggaggtgggtgactgcgcatgtatggggcctaaggtggggaaacggctttggcaatgtggacatgttccgacagggctcataccccagtggaggttactgtcaggaactgggttgcggagcgatgcgaacacggggtacgcagcgaggaatgagtcatactaattcggttacggtttaaatctcgcctccactgctaattagctgagtgacgcaagacaattcatttaatctctctctgtaccttagttttcttatcagttaaaaggctgcaatgaagtgtctatttctttcggcttttgtgaagattaaatggtaatgtgtaaagttattagtgctggcacacagtaggtactaaatgtttgcagttattaatattattattgttgttgcttctgttgttgttgaggaacaggcctgttttgccacacctagttttctgaagctctgaggtgagcagtttgctcggctggtaggtaacacggcctttttgcggggggagccctgtggtagcctctgtgcacttatttccagactactcctactggtccttggggcttgcccttctagggttttgcagtgccaggctgaagagtttgtggcacagtgactgctgtcattccccagtttagaaggctttctccatctcgattcgctcgctggttcagtgatgcatgtctggcacagttctcttatatttcttgctaaactactagtttacagaagttcacgccttatgggttaggtagtgtaacagtgtatttatcttacatgtccaagactccagattttaaattgtaaaaataacataaaatactcatcgattagttgtgaagactttttttgaggctttgtgttgtagaccacattcagaaacctcattcagtaacagattctgctatttttcaccaaagtctccaattgtggattcttattggagagagggtaaatatgcagttttccagtcagagcagccttttgaaatgaaaaatgaggtcttggagcctgctgtcacgaaagataatattacagactaggaccgacttttttttttttttttggaatagtattttctttataaccattattttaagtcattaggtagtctttatccctgcataagtcgctgaatttgttataggggatacagagtggtataaggcaaggttcttgccatcaagaagtttccagtttagttgggaaggccacgtataagtagaagtcatctaaaatcgcaagaagttacagtaagtctgaacacttttagaaatgctaggaagtagtttgttcattgaaaaatgagcatatgaacaaatactttattataactgcttttagtacataggaatattctttttaattcagcaatttaaaagatttatcaacacttttctttaaaccaaaaattattatttgaagccacaggtgttttttagttttctgggcatttccatgaactctgtgttatgaaatgtcaagccggtactttaacgttttgcagatgctcccccctctgcacccccttacccatgatctagatcagtgctttccttagtctttttgcaatttaggggaaaaaagtcaactatgttcttgtgatacgtttaggaatttcagcctgatcaaggaaaaagattgacaacaagatggcaggaataaacaaggattttgacaggattgtaggcaaaggaaatccgtctcagtttgggaccttttctagaccagggtgaggggccaccatctagaggggaaagagggcaaggggaatggggagtcggggaggaaagaatcatagaggggcttacatgcctaaatgatgttgcacagtggagagtctccggatcatagaaactctcaagggcagcagtggcttgggggtcttgataatcccgggttttatgtgtctggcaaatgttgggtgcagtttcatggggcattcaaacctggcaggctctaaatggctaaaaatatgcttattttgggccattttgaaagtaaatggatgcttcagaatttgactttggcgccccagcaggcttttcccttttttttttttttttgacgcagtcttgctctgtgttcaggctggagcgcagtggcgcagtctcggctcactgcagcctctgcctcctgggttcaagcgattctcctacctcagcctccttagtagctgggactacaggcgcatgccaccacacccggctaatttttgtatttttagtagagtcggggtttcaccatgttggccaggagggtcttgatctcctgacctcgtgatccacccacctcggcctcccaaagtgctgggattacaggtgtgagccactgcgcccggccgtaggctttttaatttttattttaaacattcatggtccttgatccagtgggcttttgagctaagatccctaccagctgtgaagaagtttacactgtagagctattatgcaagggccatctttggttcattttatataatacctgtgggtgatggtcgttactactttcttgagctaggaaccttagtttgggagtcactgatctgtatattttttaatcttgtcaaaaaacagcacagagtcctcctcctctctctggtattgtacatctagtagattctcagtaaatattagaatgttagtattttttagttaaggttatccttaagtttaccttttagtttagtgatttgatgtttaattcaatggtaatagtttactgatgcattattcctatttaacttaaaacctgtgatgtgtcaggtactgttttgaatgtgtttacatatattattttactttttacttgaatttgaaattgaaaacaatttttcagataactgagttttgttttgttttttttttttgacggaatctcactctgtcacccaggcttgagtgcagtggcgcgatcgcgattcactgcaacctctgcctcccgggttcaagcaattttctgcttcagcctcccgagtagctgggattacaggtgcctggcaccacgcctggctaattttttttgtatttttagtagagacggggtttcaccatcttggccaggctggtcttgaactcctggcctcgtgatcgacccgccttggcctcccaaagtgctgggattacaggcgtgagccaccgcaccagacccagataactgagttttaacttttaaatgctaaaacaaagtctgtaagtaacattctacaggagtcactaagtagatgacacaaggttataatttaccctgtgatctccttactatttgagttttgagaggatttcacggagagagtaaatattttataccatctttacagattacctgtactcacgaaacctctttgaatggatattatatgaaaatagtaggctgtgttcagtattattagaatcagagtctgtaaatataatttgatctttagtctttcctgtagggcattgtgttataaatgaagcaatgtaatgcgtttcttttctaaaatctagttatttggagggaagtagtgggctagacttttgaaagtgtgggtggcttacatgctgacttattaaggttgttaaagaagttgctgttattcttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggtaagtacaagaaaagtattgtgttgattatcatgcctccttctaatgcaagggttggcaaacaatggcctgtttttgtattacctgtttttgtacttagatacaagctaagaattgtttttatatttttaaatagtggaagaaaaatcaaaataggaataatgtcacataacataaaaattatatgaatttcaaacatcactgtccataaagttttattgcatcacaatcgtgcttattggtttatttatttactacatccgttgtggcactataatggcagagttgagtagttgtgaggagactatagggtctctagaacctaaaatattagctgtctagctctttacagagaaaatttattgactcctggattggcatgatgtttttgagatttgtcgtgtgtcatacatcagtagtttttccctttttattgctaaatagttgtctgttgtgcagatatgccacatttccatttgtcgtttgatggacatttaggtagtttacagtttgaggtcattataaataatgctgctttgaacattcatgtgcaagcctttttgtgaacttgtgttttcatttttctttggtaaatacctaggaatacaaactgtataagtttaactttataagtaactactaaactgtttttcaaagtggctatcccagcagtggcaatgtatgtaggttccagtgcttctacctctttgctaacacttgataatggaactttttatttctagtggatgtgtaatggtatcctgttgtggttttagtttgccctttctaatgagcactctttcaagtattcttggccatttttctactttctttgtaaagtgtctcttcagatctttttcccatttaaattaggttgtttcattagtgttttgtgagaaatctttatgtatacaaatcctttatcagattaatagtgtcttgatgatcagacattttaaaatttaaagacattcaatttaacattttcttttcttttttggtgaatttttttgtgtgtgtgttctctttaagaaactttcgccttccccaaagtttttgtcttactttttctagaaattttagttttcatttgagtagttatatctgtggtccattttgaacagtttttgtgtgcagttgatatagggacccaggttaacttttttctttttctttttagcttccatacatttttttttttttaactacataagtagttatttcagcattatctattgaaaagactttcctttccctgttgttttggtgctttacaaacggctgtgtatatgtggatctatttctggattttattctcttcctttgacctatttgtccttattccaacacaatactctctatttctgtagctttataatgattcttgaaattaggtagtgtgaattctccagttttgcttttctaggaaaattttggcttttctaggtcctttgcatattcataaattttagaatcagcttgccagtttctacaagacagcatcttgggattttgactgggattgcattaaatctgtggatcagtttggagagaattgacatcttgacaatattgagtcttaatccatgaacacagtattcttcattttatttaggtctttaatgtcttagcagtattttatacttgtcaatgtagaggcctttcgtgtcttttgtcaaatatatttataaacattttatgttatttgatgctattgtaaatatttttagttgctttatttaggcataatgaaacactgcatatattttagatacgcagtttgataagttttgacatgtgcatacacttatgtaactgtcactacagtcaagatagtgagtataaccattaccctcaaaagtttccttgaggctccttgtaagtgctccctcccatcacacctccaagtaacctctgattagcattttgttagtatacattaattttttgtagatttgttggattttgtatgcgtatgttcatgttgtttctaaataaagaaaattttatttcttccttcccaatttggatgacttttgtcttttcatttcctttttttctttccattttttttttccttttctttcccctcctctcccctccacttctttctttcccttcttcccttcccttttacctttctttttcctttccttttctcttccctttttctttcccttacccctccttttttcttcccccatcccctttcccccttcacacccaattacaccagctagaacctttaatacaatgttactagaagtggggaagcagaaatcctcttcttattactcattttgctgctcatcttagattgagtctttcctgttaagtttgttgttagcgatagattttttgtaagtgccctttatcaggatgaggaagtttgcattcattacactttgctgagaatttttattacagatggacgttggattttgtcaaatgctgttttcccatctgtagagataaaagtttctcttcatttattcttttaatatggttaattgcctggattgatttttgaatgctaaacagactttatattcctagaataaaccattcttggtcagatgtattatcctgttttatatattggctagtattttgtgtgggaaattttgcgtatatcttaatgtggtattttgttttctaattttttcgtgaggatatctttgtcaattgtgttattcagcttatgtcaaactcaaaattagttaaggtattttctcttcctatattttcttaaagagtttatgtacaatttgtattttttttttttttgagacggagttctgctcttgttgcccaggctggagtgcaatggcgccatcttggctcaccgcaatctctgcctcccaggttcaagcgattctcctgccttagcctcccaagtagctgggattacaggcatgcaccaccatgcctggctaattttgtatttttagttgagatggggtttctccatgttggtcaggctggtctcgaactcccgacctcaggtgatccacccgcctcggcctcccaaagtgttgggattacaggcatgagccaccgctcctggcctgatcattttcttaaatgtttgatagaatttactgttaaactactagggcctgaatttttttttttgtggcattattttgtttgaaaatggattcagtttgcttcatagaaattgggttattcagattttctagttatgtctgttttgattaagttgcatttatcaagttgtttcctttttacttttttaaaaaaacattaaaacatttctttaaaattacattttctatgcacatttcttcctcagaaaaagtaacaaggagaatggtacatagtaaaaaaattctgaatacctcatggaattgagcatttgaataatagaatattctagttacttttgatttattctagagttatattttccaatgacttagggcctcattaattatattaggcttttgtggaataaagcctttttataaacttcacgtataaatacaggagatggaggaaattggatcttttttggtgtattttgtttttatttaaatagatttattgagtttttctaacattattaaaagcaggatagtgactgcttagaaattctttatcatctcagattattatgtaaaaagtagccatgttaaggaaaaatggtctctgaaaagccgtatctttcaaaaacacaatgtttttctcctttattttttaaggcaaacagtttcgaatctaaagattatctccaggtttgtcttcgaataagaccatttacacagtcagaaaaagaacttgagtctgaggtttgtgttgaatttaatagaattttaatattttactttcatttaaaatggcaaaatactagtttttatttattgggggtatgttttctagggctgtgtgcatattctggattcacagactgttgtgctgaaagagcctcaatgcatccttggtcggttaagtgaaaaaagctcagggcagatggcacagaaattcagtttttccaaggtaaaactgaagtgtttttgttttttgttttaaagataaagagacttggcttaggctaaattgctatataattgtatataatgaactatacattttatgcttatgcaacttagattttaaggataagactcaaatctcaggtctggaaatatataattggatgtaaagagatcactgtagtgttattaaagttattattactatatttttattaaagttattattaatatatttttaagaaatattcttttcaaaacttaggtgaatacttgattccctggtacagatttctatcttgaaaactttctggtagtaaaactatcaaatgtatttgtgggagtggggatgtggcacctattttaagaatgaatcttttaaatttttaaacagtagtgttgggatggaacacactattaatattaacttgaattttctaaaaagagtttttaaaaaatgtttgcttaggtttttggcccagcaactacacagaaggaattctttcagggttgcattatgcaaccagtaaaagacctcttgaaaggacagagtcgtctgatttttacttacgggctaaccaattcaggaaaaacatatacatttcaaggtaaatattgttttattttggttggaaaggataaggaagcaataataatcactcagtgtttttataatacatacatgtagttatgttgctattacctagtatgcgtttgctctatttttaatagtactagcatattattacgtattgctgtttttttttttttttggcgggggagggacagagtctcactctgttgcccaggctggagtgcagtggtgtgatctcagctcactacaacctctgcctcctgggttcagatgactctcctgcctgagctgctcagcttcccaagtagctgggactacaggcgtgcgccaccatgccaagctagtttttatatttttgtagaaatgggggttcaccattttggccaggctagtctcgaactcctgacctcaggtgatatgcccaccttggccttccaaagtgcttggattacaggcaagagccaccatgcctggccttgctattggcttttaattcaaatttatttaattcatttgtaaaaatactttacccattgatagagatttagatgatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggtatggaaatattttagtatgtaaaatatgtataattcctgacttcttataaaccctttagattgtttcaccatatattggaatctggtttgtggtggtagtgttttttgttattatttatgttttcgagaaaaataaagcttaaagtgtgaagacatcttttgtatttatattataccaacagcaagaatgtttaaacaatacaaatgtaaatggttctgaaatcttttttgattgttgtagagccagcattgtgctttttatgtaatgattttttaaaattctgttttttaattgtgaaagtaatatgtacccaaaatttaaaatagggaatgtgagaagtaaaaagtaaaagtttcctttaatttcattcctaaagaaaaaattattaatagattgggaagtattgtttttggaccttttctctctctatataaaatccatatacagagctttctatctgtatatacacaaacatggtcatatatatgatgtgtatatcttcatacctttgtttttatatgtatgatataatttttttttttaaacaaaaaagagatcttactatgcttaccattctatgacttggtatttcatttagcgtatcttaaatctcttcctaccttaaatcatgtgcgttttatctgttatgtctttaacttgtttttttaaattttaaatcagcttttaaaactaagtctccattgatggacatttgtattgtttctgtgttttactattttgaacagtgtttcagtaaagaaacattccattgcaaatatatttggtgctaattttcccaaactcaggccaagattggatatttaataatgtctggtttgataggtgaaaaatggctcacttgagcctactttatatttttttaattgtaaattagttgattagtacatcttagaattttttcctgtgaattgtcacatgttctttgtccatttatctagtattgtatgacttttcttgtttactgatttattaaaatgtatttaaaaaaatgaatacattattaatgtattagtgtatgggttgcaaattttctggcttattgtttgcttctcccctgcccccattgtgtttttcttttttttcttcctttttttagtttttagagacaggatcttgctttgtcatccaggctggagtatagcggtatgatcatagctcactgctgtcttgaactcctgggcacaagtgattctcctgcctcgacctcctctgaatagctggaactacaggggcatgccaccactcctggctgttttgattttttttgtagaaatggggtcttggtatgttgcctaggctggacttgaactcttggcctcaagagatcctcttcccttggccttccaaagtgttgagattacatgtttgagctgccaagcctggcccattgtgtttttcagtattcatctattcagcaaattttattaagtcatctgttttttttccaggcaatattttcagttttgaggacaaatggtactgccctcatggagactgacaataaataaatatgtaatatactgtgaggaggtattgttttatataaggtggtaccatataaacttttaaaaatgaagttatacttgtctgtttattcctcttgtgccttctggattttgtagtatattttcagacattattctattcaaggctgttaaaaactactaattgtttttgtaaatatttttaccctattattattaatgcaaatttttcttttttaaaacatttagaaaccagggttttaaggcagtaaaaagtgtgttaccagtggagttcaaagttgagtctgtgactatggtctctgaaagtagaatagtgttttaacaaaatttatggggattggtggataactccatagccaattcatagaggaaattaaaatcattaataatgaaaaaaatttttcactgggcatggtggttcatgcctgtaatctcagaactttgggagactgaagcaggctgatcacttgaggccaggagttggagactagcctggccaacatggcgaaaccccgtctctattaaaaatacaaaaaattagctgggcatggtgactcacacctgtagtcccagctgcttgggaggctgaggcacaagaattgcttgaacccgggaggtggaggttacagtgagccgagattgcgccactacattccagcctgggtgacagagcaagactctctcaaaaaaaaaaaaaaaaaaattctaacaagttatccagttaaaacatgatactgttttgcctatgaaatgattaaaatgttaaaaaaaaatgagataatgtgctttcatatattgtaaatggttctagaaagcaaattggcaatagtgtgttaagagtgagaacattaaaatattttatatcttttcatccaccaattcacttttaggtgtatactccaaggaaatgggtttatttctatttctaaggaaataataagaatgcagaagaaaatatgtaaagatgtttggcaaaacttggtgaataaattaaatgtttaataataagggaataattaagtcatttcacatgttttatatagccatcaaatgttgtaaacaatttttaattatggggagaaaaagcttacaacataagtgtggggaaaagaatagaagggaaatattttaaaatattaatagtaaccaaccagagtggcaggattatacatgataatattctttttcatagttctctgtatttttccatgaaactatattatttaactaggaaaaattaaagaattcattgaattgagtagatgaaaggttgtgatttggtagtgacttatttggataggtaattaatatcttgattatttaaccttaatgaaaatgtttttttaattttttaaaacaatcttttttttaggttactgtgcataatgatagtgatgatactctttatggtaaggtttcgttgctcacttatctttgatgtatcgattatatgaagtacacttgaaaagcttttaatttttaaatcacttctaatgttttatttttattattaaaaaatttttaggctgggcgcggtggctcacgcctgtaatcccagcactttgggaggctgaggtgggtggatcatgaggtcaagagattgagaccatcctggccaacatgatgaaaccccgtctctactaaaaataaaaaaattacctgggcgtggtggcgcgggcctgtagtcctagctacctgggaggctgaagcaggagaatccttgaactcaggaggtggaggttgcagtgagccgagatcgcgccactgcactccagcctgacaacagagtgaaactgtctcaaaaaaaaaaattttcaccttgtatttatttattttttttctatagacctcttctttggttactaaggatttaatttctataatgacatagtcggtgatacctggaaaatgatacatatttatatgaaatgtcagtcattgtgatgtttcgtttgtattaaatattacagatatcccttttactggttacaattttaatattgaatttgaaagacacttgtttttctttgtcctttacatttaatttctattggttcattaacatattttcaaaaagaaaggaattataagaagttgtctaactttggttaatccacatattatttacatcttcctttgttccaaaaagtttttaacatagatggtcaaaagattaagcatacttggtttttcaagtgtgagaatcgatttgtacttttgtcacgtttttagtcagttgcttactttcgtgattgttttttctttttcttttttttgtaggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaaggtatactaatgaatatttttatcttattgctctgaagttctcttcctgggctttgtgatagctgtaagactaaaacaaatagaaaattgaaaattgtaatgctaattattaacattaagagaagaagataattttgtgctttggaagtatgttttggtatatttattaaacttgaatataaaagggtctattttggtattgtatttgcttgagtatcattaattggatttgtggtgatgggaaaagctgtgtatggttatgttcacgttattctcctgctttgtaacagtgtccaaattttggagctatgaaatgttactattcttccggagtggtttttctaaccttttaaaacaattattcacagtaggaaacacatattaataacatcatgattcagtacctacatgcatgtatatatattcatatgtaatatttacaactcaaaagtttcgttaattatacttttactacaaggaatgcactgtaatattttctatattctttgtcatttctacaaaatgctggccagatgcagtggctcacacctgtaatcccagcactttgggaggctgaggcaggtggatcacttgagctcaggaattcgagacgagcttggtcaacatggcaaaacgccatctctacaaaaaatacaaaaattagcctggcatgatcgtatgcatctgtagtcccagctactcaggaggctgaggcaggaggatcacttgagcctaggaggtcaaggctgtagagagccatgatcacgcctttgcactccaggctgggcaacagagtgaaaccttgtctccaaaataaataaataaataaataaataaataaataaataaataaataaaaattaaaatactggtcatgattcaataaatctgattttatgattcactaataaattacaatcttcagtgtttcatagctaggtaattttacaggtttaatctgtactgtactttgccactctttttttccctgagtgtctaattctaaggaattgttactgtattcaattttccgtttggcagactctgttgacaaacatttattttgtgtgtttgtgtaatttacattctagaacattgttacaatcttctctggtgtaacctgaaatagctgagttgactccagctaggatgtgttgttagaagaaagatttcattatatgtcactaggaaaagactttcaaagagattacattgtagaacacattctttgtctcaataaattaatatatatcctctttattttttaaagatctacaatggattcaagtatctgattccaaagaagcctatagacttttaaaactaggaataaagcaccagagtgttgccttcacaaaattgaataatgcttccagtagaaggtaaagaataaactctgtaagagtaaactcgaatcaccgatagtattctgtgttaatttaaacacagctaattttacattaaagtgggcagtaggttctctcgtgttaaattcataaggcataaaaaacatttggtatacagaataacactaaacacgttcatcaatactgtttcctgtcctgacagtagatttattaatttataggaaatctctgaggtatttttactctttctttatgtcagtatctaagctcagtatttttggagttggtaataatggtggccttttctctgggtctttctcacttatcccctgaatactatataaatatactcagtgagggtataatctcaaggggttaaggaaggaagttttgatgggattgggggatgagaggcaaaggaaataagtttaagcagtgagataattaaagcaggctttttcttagagaaggagccctgttcccgtagtcagttgggcatgggacaatacaagatccggatctataggtcaaatgtatgctttgctttaggtatgtattcagagtattggctagctgtacataatatcattttaactaatattatcttttcaaacaaaatgtcgctttattataaatgatactattaatagaagttgaactgtcaggatataatttgagggatttagagctaggcaaaaggtgattttaggcatttgggtatgtaagtgacagtagaacactggcttgaaatatttaacagctaattggaaaatgcagtggtggactgtagttatactagggtataaataagattgatttgaatacttgtctctcctatttagaatgcagaaattaaaaatgataagataacatttgatctttgtatttcagtcacagcatattcactgttaaaatattacagattgaagattctgaaatgtctcgtgtaattcgagtcagtgagtaagttgaatattctttaaatttaattatttgtaattgttttgaagaacttttaaagtactttttttttcttaattcagattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtaagtgtttctgaaagtgttattagcatattaaatattacaatatttaaactttcaacttttttgtttttagaaagttcttttttgatttttaaactgcttcttatgtaatgactgtgtatagattgtgattcaagtacttaagagatcttggattaaagacaatgatagaaatgtcagttgatgccagtaactcatcaggtaaagtcagtattttccatggcaaatctataccaatagacactgtaaatgagaagcttctaatgctggtttaggatctaaaaccactttattcttattaatgcattgtgtgtggttctagatgcaatagatttttacattaattagcattttaggctgagtaaatataaatcagccttcaccatttctatttagggtgtttcatgacatctcttatatacttgctctatactagggaacataacccagttaaatgtggttttctttataatttacatagtgggttattgttagtaagtagcagcagttaaaacaaacagccaggcatggtggcttatgcctgtaatcccagcacttttggaggccgaggcaggaggattgcttgagcccaggagttcaagaccagcctcatctctactaaaaataaaaataaaaaaattaaccaggtgtggtggcaggcacctgtaatccctgctaccctggaggcagaggcgagaggatcgcttgagcctaagatgttgaggctacagtgagctctgattgtgccactgtactccagtctgggcaaccgagctagaccctgtctcaaaacagaaacaaaaacaaaaacaaacaagaaaagataaaaagaaaactgagaaggactattacatctgaaactaatcactaccctaaagtttaatttcatgataggtggcttaattatttctttgtaaaatgtctcagcaccctgatttcatgagatgttttttaacttacaatgttttctgaaaattttttctgtaggtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtaaatatttattttattaagcctcttattattagaatattaacagtttttcttgaaataaatattttttacttaatactgtaagcctaggaaataattgaaaattaaaaaggtaaatatttaaccaagtaggaagacatgagaaaggattgaaagttgcccatgctaggattaaaatgacctttagtaataagaattagtaataaacatcagttataaattaatgagtatttttggaatgaattgtctgctctgccattcatcttgttcatttggtacttctgggtgattggaaaaccctctgctaagattaatactgaacacttagcccaggaagatagatttttcctctagtttacatgtgtaagtagcttttttcctatcagaatgttcttttagggatggtgattcctgtttgtatgtttgtttgaatagtttttccttaacacttgagtgttcatttgacttaaatttataaaataatcattttctagtggacagttcttgtcttttctgttttaaaagtcacattgaatattttaacaggtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagagtatgtattaagaactcatacttctatgcttgtcttcttattctgaagttaaggttaaatcttaaggctctctctcttcagtttttttcaacagtacactgaagtttttgtgttcaactttatattttgaaaaatttcaaacctatagaaagactagtacaatgaatactcatttatccttcacctggattctccacttaccattttatgagtatgtgaatacacatcttttggtctgtacaatttgaaaataagatccagacataatgacaccttacatctaaatatttgaacatatttttctaagaacatgggcattttcatcatgatcacaagaccatgaaattttcatacccaaaaaatttaatattgatacactaatataacctcgtatactgtttgtattgagagttccccagtgttcccaatatgttctttatagccactttgtttttgtctacagccagagttaacacattgcttttgattattgtgtttctttaatcatttctaatctagcactgacatttttgaaaagtgggtcctagttttctcatagaatacctgcaatttagatttgtttgattatttcttcatgatttaggtttaatacattagggaagctttttatgtaggttaagttgtaaattttccattgcatcacaccaagagccacatgatgtctgatttttccattcttagagatgctaagttttgctcacttggttaagataacagtatttcagatctgtattgcaaaaccatattatctgtggggtgttacttatagaccatgtgagtatcctttcactaagtgattttatgtattccatcagacctttattttgcagtctcaagtacaagtgttaaaaatatctaccaagtacctatgatcccatatcttcaaaaacactaattgtttgtcgtcttgttattatgataaataaataagatttaacggttgtttttttagcttctgtccaattatagtatttatttatttatttatttatttttgagagagggtcttgccctgttgcccaggctagagtgcaatggcacgatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattataggcatgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgatagcttcagatgtagtacaagtcccactttatctggtcactatgtgattagaccgtgttacttgggcttctgtaatgtattaaatagtacctcctcagtgacgaaaggagcctttaatagtctagtttggctggtgcagtggctcacacctgtaattcgagcactttgggaagctgaggtaggaggattgcttgagctcaggagttcaaaactagcctgggcaacatagtgagaccccatctctacaaaaaagtaaaattagttaggcatgatgatgcacaggtgtagtcccagctacttgggaggctgcagtgggaagattgcttgagcccaggatttctaggcagcagtgagccatcactgcactactgcactctggcctgggtgacagagtgagaccttgtcttaaaaacaaagaaacaaaccaaaaaacccagtttttttttttcatttcaaagttgaaatttttgtataatgttggttagtaaaatttctgaaattactagagaaaaatatttaatgctatagtttatgatggattatatagtataaatgcttatcatataagattgactaaatattttaaggaaattcatcaaaatgtctaatatttgacatttaaaaatcaatatgattaggtgttggcatgctttatttttttcttctagagacaaagtcttgctctgttacctaggctggagtgcaatagtgtagttatggctcactgcagcttcgaaatcctgggctcaagtgatcctcttgcctcagtctcctgagtagctgggaccacagatgcatgccaccacccctaactaatttttaaaaatgttttgtagacatgaggccttgctctattgcccaggctgatcttgaacccttgggctcaggcaatcctcctgccttgcaaagcgctgggattacagatgtgagtcaatgtgcccagccctttcttgacattttaattaaaggattgggacttttaaaaaccattataaaataccttggtattagcatacatatacttaaattcgtttagctataatagccagcctaaattttttcagcaaaaactttatcagatgctaacaatgataaaacctaattattgaaaactattaaacttcccgccaggcgcggtggctcatgcctgtaatcccagcactttgggaggccaaggtgggtggatcatgaggttgagagattaagaccatcctggctaacacggtgaaaccctgtctctactaaaaatacaaaaaattagccaggcgtggtttctggcgcctgtagtcccagctactcgggaggttgaggcaggagaatggcgtgaacctggggggcggaggttgcagtgagccgagatcgagccactgcactccagcctgggcgacagagtgagactccgtctcaaaaaaaataaataaataaaataaacaaacttcccaaggtttttccacattcattctgatgtctccttcaatagttattatttattgttttactcagaaagtatgtagtttaaaattattaaaatagtattatgtatttatagtagagtgaaaaagaaaatctaaatataaagatctctcaaatctaccatgaatgttaatggatttttattatatattactgttttgtaacctggtattctttatataaaaataaattgtgaaaagtatgaattattaatataggttatcattgattacggtagtttatggtagtaccataattaaaccaatcctttaacgttggttgagttgggttcactttttcattatttaaacacaactaccatcacaaaacaacaacactgtgatcagcattcatacaaccagaacatggggttatattataattattttcagtataaattcttggaggcagagtttcaaagtctggatagctgtagaactattttcaaatataaagttgagacattggaagatctgtagcttagagtttattgtttaatttgttgttgagtaactttaaatagaaacattaaaaagaatatgtagctgtttccttaatgctacaatttatgttatgaatgtataatggtcatgttaagtgttttatttattgctttatttatatattgcacatttttcatgattatgtatgtgtttcaaaggctatagaattgctgttgacatctggatagttataaaagcctaatataagtttatgtaacatctttatttgacagattagtaagtgggtgttcttagcaacttctctggtgtatgcaatccttgggctttagacttttacaggccacttttaaactcaacctttagcatttaccagagatctgatccttatgcttcccacctgtgaaatatggatgataccaagctcacagaaagttgtggattaaatgaagcaaatatggaactccccagagtagttcttgatagataataaatgcactaattaactttacttattttcttagtatagctaaacagtgagacgagttaccaaaggtctatttctaaaatgtggaaaggccaacctgatttttcagttaacaaatctttgcaaacatataattttcagtgagaacattatcactattaaaaaggacacagaattacaattgactaaatgtaaagttttattttttgaacagttggacggtatttctcttgggatatatttattcttttataagaattttatcatttacatgtaatagaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaagtaagttatttatttcatgtccaggtaaaaattgagaattttatttagttttttagtttttttttttacttagtttactttttatattaggtggcttctgaattctgatctctttatacaagcttgaaaatagctgttactggtctggtgcggtggctcacgcctgtaatcccagcattttgggaggcctaggcaggcggatcactgaaggtcaggaggtcgagatcagcctggccaacatggtgaaacctcgtctgtactaaaaatagaaaaattagctgggcgtactggcatgttcctgaagtcccagctgctttcaggaggctgaggcacgagaatctcttgaacctgggaggtgtaggttgcagtgagctgagattgtgtcactgcactccagcctgggcgacagagtgagactcttgtctcagagaagaaaaaaaagaatatagctgtaactaatcccatgcatggttatttaaattttctctcttttttaaatttaaattttaattttttgagatggagttcttgtgctgtcacccaggctggtattgagtggtgcgatcttggctcacggcaacctgcacctcctgggttcaagcaattcttctgccttagcctctcctgccttagcctcctgagtagctgggattacaggcacacaccaccacgcccagctaatttttgtgtttttagtagagacggtgttgctgtgttggccaggctggtttcaaactcctggcctgaagtgatccacccgcctccgcctcccaaattgctgggattacaggcgtgaaccactgtacctggactaaattttcttttaatctagaatatacttaaacttagatgtttaaaacaaaaacacaaagtagttcgttttctgtttcttaatgggattaatttgtattttgaagggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagtatgttaattgaagtatttaaaaatatccagtgaggttttggtaccagggtttagtgtaccacatcaatgatgagaaacaccaagatagtttagaattaaaacaatgctttgtgtgtagctttattataattaggcatgtttttttagaagtgtaaggcaccaagaatttaaatataatgattggttttgaaaaatttatacctctgttatatatatatatatcttattttggtattgcttgaatcattgtgttgtaggcagatagattcttttttgagatttgtcttacttaacatttttaaataaaaagaattttaaaggtgtaagagacctaagacgtcatttacttgctgttctgattaaaacaaaaatgtttatgtataaaaagggttgcccttgccgggcaactaccgtttcttactcttttaaaattttatttgtttatttatttattatagttttagagttagggtcttgccgtgttacccaggctgatcttgaattcctggcttcaagcagtcctcctgcccagcctcccaggtggctgagattacaggtgcacgccactgtgctcagcttattctctacttgtaatataagaaaaattatccttttctgctgcttccactgaagctgaaattgatcagttttttgggggagttggtttttttttgtttttgtttagttttttaatcactcagttcaagtgcctgtgacagtgatgtccagacgtctgctgtcaagcaaaccttatgtatccttgacgtggtttgggattgactgagttgtgaaaatgtaggtttgtttcatgcactatcccaacaaaaccttttaagtctcattatataattgaaagtatacctgaactaggtaatcataattgttctataatgacttgtcacagtttgtaacattgtttttatgcgaaaatatgcctcatggtccatacagcagaaaataaataatggaacacaggtttttcataattggagttgcttctatataatttattttaaagaatttcaagtgatgaattttttgcttttttaaaaactgtctaaattagatggtaccacatgtaaagggtgaaccctactgttaatattaggcatgtggtttttgctatttttaggaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatggtaagtggatacattttacttttatttagatattgtaaacacataaaaagtactcttggtaagtataagagatttatgtagctcatttaccgtagtgaccagaaaattctttcatctaggtaacatattttaatattttaccatttgtatgactttgtagtaatttactactaaaaatattttttgacttccatttattttagaccaatattattagaaaatgagcttctcaacaaaaaaagtcaaaacaagtgttaactttatgagtaaagctgtaaattttgttatatatatatattttttatgacagcgtctcgctctgtcaccaaggctggagtcagtagtggcatcacagctcactgcagccttctactcctgggctcaattactcctcttgcctcagcttcctgaatacttgggaccacaagtgtgcactaccacagcggctgcattttttttttttcttttttgtagagatgggatcttgctatgctgcccagattggtcttgaactcctaggctcaagtgatactgcctgcctcggcctcccaaagtgctgggattacaggcatgagccgtgctgtgcctggccttgttctatattctttataaattcttgcagtatagaagattcactgttgggatagagtgactactgtggagtggtttaaagtaatttgttagtttgatgcttcattctaactaggagggcattttctttttctgtcttcccccccctttttttttttaaagacagggtctcactctgtcacccaggctggagcgcagaggcatgatcatggctcactgcagttttccacctcctgggctcaagtgatccttccaccttagtctcctgagtagcttggactacagacatgtgccaccatgctgagggcattttatatacataaatagaattgtttgtaatatctgcattttaagaattagttgcaataactgctctgcccttttttgtgtgaaacaaatgggtagaaaataacacgtaagtggtgcctttgcattatgaaatgtacttaaaaagcactagctccttttcttctctgatgctatgccagttctttactatttagcatatgccacctatttttatcctgagttttagaagtggctttttctgaaacattaccctgttgtggttgaattagcagatttttttttaatgagtagggtgtgcttctagtgctatcaaaatcctttttattgaatgtaacagtaaagtgtcactagagcagcatatgtttcatagttattcagtgatacatatttttagatgcttagatatttattttcaatgttctttattttttcagaatcagattcattgattcaagagcttgagacatctaataaggtaatgctttaagttttattttgtcttgataaggtatttaattaacaaaggggtatgaatgatgactagatttgtttattttaaaaaataattaaacagtaatatagtctcttggtatgcatgggggattggttttattctgttattttttctgttcttctttggcttgagtcttcttatttcaacttgtatttatcctttcaaaaagctgaatattttaaaatatgatcagatataaataattcaagatcttggtatctaatatccagtatttaaagaacaaaaatgtacttagaagacattacacctactgtttatacaattcctatcttttcttgtattttttctacttatgaaaatagtagacactagttgtaccaattaccttaagctatataaatagaaaataaaaaatttcccataatgttcttcctaaatttaaaacaaaaccaaaccaacttgtttggaagctctttagactgttactttatgtatgtatttatagaacacttaccatttaccagatactccttcaagtgctttttattaactcatttaaatgttagagcaactttatgatgtaacttgcccagggtgacatagtttttttagttttatttatttattgtttttgaaatggagtctcactctgttgcccaggctggagtgcagtggcatggctcactgcagcctacgtttcctgggttcaagtgattctcctgcctcagcctcccaagtagttagggttacaggtggccaccacccccggctgatttttgtatttttcagtggagacgggctttcacgatgttggccaggctggtctcaaactcctgacttcaggtaatctccccaccaggtaatttggcctcccaaagtgctgggattacaggcatgagccactgtgcctggcccagggtgacatattaaaagggatagcagctaggatttgagcccaggcagtctggctccaaattcctcttatatgctatatagcttcttttttctttgtgtgtgtgtgtgtgtgtgtgtgtgtgtgtatgtaatttttttaaaggcaaaaataagatcatgctgtgcatagtgtgttgccactgattagctttatttaactttaaaatttgaaggaattataaaactgtttgcattattaatcatatttgcattctagttatcctaaagtatattcatgaaacattgctttttcttctttccaaagaaaataattacacagaatcaaagaattaaagaattgataaatataattgatcaaaaagaagatactatcaacgaatttcagaacctaaagtctcatatggaaaacacatttaaatgcaatgtaagaatttaaccttgtgttatattaataaattagataagcatatgttttggttgaaaggaaataatttaaaatagcttatgcaactaagactaatttattgagaatgttgaattgcttatgcaacattgaactcaatttactgttttccaaatctgaatttttgagaacttagacgagggtgtttgacttctttgaacatacttttccacaagatacgctggcagtgctttgcatgtaaaaaggaggagaatatgtagcctttggacgtttaagcctcagctagttggaaggggagctttgaggagaaaggaatttaggtgtacttagaaaaccagattataatgtttcagggaactataacatgaaattcagtaaaattaggtttttccttagaagcttgtttttattatatgtattgttgctattgtttatatgcttaatagcaaggatattttttctaaaaagttatacactgtgacatgtaaagacttaaagggttgtctttcatacaaatttagataatttcatattcagttcagcttagaatgatcagcttgtcttttaatccatgtcttttaaaatggcttttggttttctttttttggggtaagctccttcaaattattcttttatttagaaatggtaaaatatatggtaataatgtagtaagctgagtaaacttagagccaaacatcttgctttgttgaaaggtgcttttttatgtcttttctatgaccaaaagaagcaggcgtggtatcttataaaaagtgactgttgagtttcctttgtatcttgatagtcaaactctaatacccaccaacattccctgattcatctgaactttaaatgggcatttgataccacaggggtaaatgaggagcattctagaagagcactctgtctaatctcctatagtaggcctttcttttggtatttattagatacatgattcattctctggtttttctgtacctgaactgggagaaatatcctaatatttaatatgttaataataaactatttagtaataattagtatttaataaggtggaggagcaagaaacacttgtggagtgtccaacgtgtgccaggtactatgctagattattggaattatacagattaataaaatctactaccctaacaatcccccaataagaaaaaaacaacataaatatagttataatacaatgtgcagtcgtagtcaatgtgtgaagctgtgagtgggtggggagttaggaatactttgtggagatgaaaatgattaagttgagccttaaagggtgagtaaaatttagccttttgaaggtagaggaaggggacagtggtagtcaggagagacaagaaggtacattggccttccatgtaccagaatcagagtgcacaaagtcatggaaatgagaaatctttcagtgagtgcaggaaaatacaaacaatttgttgtttaggaagaaagtttgaagcaaggagaggtgagaaatgaggctaggagtagtagaataggataagatgaaagaccttgaatactgcattaaagagtttggggagtcagtgggggagtcattttcaccagaggaatagcaaagaggagtttttcatttgagtagatatttttggaaacttggaagataggattgagatggaattagactacaggcagagagaccagatagctacctcttggaagagttcagctaatagttgatgaggacttcgatttacggtagtagtagtagagattaaggaagaggaaattgatttgtgaagtaaggggatgttaaaattttgagacttggggcagtaaattaattgctgggcctcctggctctcgaaacttttatttggttagtcatcacatgctttttgctctcatctcttgatctggattttaagtctgttctttgatttggtaaataaaaacaaaaaggaaagtcagagacaggtcatttctggcgactacaacttcaaagaaaatagttggaaatttcacatgggattatatttattgctgtagtgtgtttgcataccataatatattagcaatatttaaggaagtgatagtaaaaaaatcaatatttgtaaattagttagtccttgcttgtaaataaactttatagattctagatcttgttttatcaactaacttaatacagtgtgctaaatttaaattgttcacttaaatacatacaaatatacaaagtagtttggaacttacctaattgtcctgattaacagttgatctagggtcactgttccacatcttgtcttgagcgcaaactctttccaataatgaaaaaatttagtttgaattctttgctttttctacccaagcataccctgggagcagaaaaccctcctttcaataactataacttctgaaggatagatttttggtgaggattgtatattttgaagcggggaaaaatgacgggatcattctgataggtaccaaggatcggggaaggaacaacttggacttgttatggagctgtgtcagaggtgtgatctgcctgtcccatgattttgtcatttatcagtgacactaagggactaattgtgagaaagcgtggagattgttctttatgacatcctttgtttagagatactagaaaaactttgccttttttcttaaataacccattactttatgactttaaaaggttatttttatctgtatttcctgctaatacaatgtttgctgattaagcggcactctatcatacactttgttttttcaaattgattgctacaagtttctgccttcaccatacatttgattactctatagacttgcgcttaaatgctgagttttacccttcttctaaatccatattataccctttttttggaagttccccccctctctcagctcccccactttctttctttttagaggtagggtctcatcactctgttgcccaggctgaagtgcagtgatgtgaccatggctcactgcagccttgaactgctgggctcaagagatcccattgccttagccttccgagtagctgggactgcaggcatggaccacaacacctggaattttaattttttgtagagacgggttctcactgtgtggcccaggctggtctcaaactcctgggcttgagtaatcctccggcctcagcctcccaaagtgctgggattacaggcaggagcccctgtgcttggttgctactagccttttcaagggaggcagtctgccttaaaaaaaaaaaaagtctaaatgacgtatctagaagctcagtttcaaagctgtctgtaggctgtatatctttgaatatatatcgacttaaagctaagggcaaaactatttttctaggagttgttaatgtttaagacaatactaatctttaagaggctttggctacaaaacaaaataaatagttgagttcatatttttcttttcaaagcacatttctgatgtgacttcagagatttatcttcttaagattctccagttatccccaaatgttacttatttgctagagccatcagttattttaggacgaaacttaagaaataacttagaaaatgtctcaacaaatttgaaaataaaatttttatggtacaccattgaaagtaatttatgtgatttgtacattttttgtagctttctatatgtgaattatttttaacttattttgctttaggacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaaggtactacttcagctgccagcagcaggcgtttaagaaagctaatttctaaaccagtaaatagaacaaggcaaacagaggggcattcacttgtctaaggaaaaatcttgagaaaatctaaacgtcttgaatttttattctggaaagttatacattttctagggatgggcatagttaaagcttttatcttaataaatatgcttttagaaattgtgcttttattatttctttcgcagtctatgtaataatttctgtgcttataatagttaaaactcattactttgattttataaatatagtattttctgcctaaatcccagcacattattttgttttctttgtttgcattctttattcatttggagaaaaggatattttacagtaagactttgagctaaatattattaataataaatgtattcaagctgtatttgtgataccaggagacagtctgatgaaagataatacatgttgaagattattttttaaaaaatctttaatagtaactgggcaagtttgttgtaaatataaagaagggcaaacctttgaattttagaggaggtagactctttagaataaactgaaaatcttgaggaaataaataggaaaatgtaaattgcaaacataagaaacgcttcaaaaagaaactcagcagcttttaagaaaatacagcaggcataatgccttattttaccccttcctctttgaggctggacagtgtaaattatacataataaaaccttgtccactgagcttttaaaattagtctgtattgaagaaaagagatcttggaatcctgtaatgaaattgcacaattacagcttcccaagaacatttagacaattgagtgaaacaaaaaagaacatgcattgcatttgagaaatgaagacttaacaaatacaggttgttttttgtatatacagtatcgaaggcaaaactagataaattctagatgggacagggaggtaagattcccatattatatagtgattcttgggtgggggcatattctcactgggggaaatcagtatcttgagagagctaggggattttaatttatcaaaaggggtcataggccgggcgtggtggctcatgcctgtaatcctagcactttgggaggccgaggtgggtggattccctgaggtcaggagtttgagaccagcctgaccaacgtgatgaaaccccatctctactaaaattacaaaaaattagcctggtgtggtggtgcatgcctgtaatcccagctacttgggaagctgaggcaggagaattacttgaatctgggaggcaaagactgcagtgagccaagattgcgccattgcactccagccagggcaacaagagtgaaactgtgtctaaaaaaatgaaagtggtggtggggggtcatagtattaaaaaaccttgagaacaaacaatcacataagttttttcttctccacattatggtagtacctgagggacctttcataaatgctttggcttttcctttattttgctcataacttcaactgtgattagtatatatggaaatgagtatagaaactcatttgtatatggcatggcagatttcaatttaatgagctttgtaatgatctcaaaagtgctgccttcttcatcgaacagattcattacatgtgcatcccatgggctatcatctcacaactaggatgcacaagagcctgtgagaggcaggctaaaacttaatgggtttgaatttcataactacaagaggtttgacgtttggctcttaaggaacaattacatgcagcagtgctgtcagttaagggctttgtaatgtaacaaactgatatgttaagatcccaaaggtattacagaagtcactgtcaacttctagaaattttcaaaaataataccccagaacactaattctcaaaacgttgcatgtaaaatacatcccagacttaccaaatcactatctttggtatttggtgccaggaatctgcattttaataaggtccctggataattcctcccaataaaactagaaaatcactcttgtgtaaataaatgtttttcagtgttaaagagagaacattaaaattttaaacataaagttaccataaagtaacaaaattaatgtaactggaatatgtcagattcatgaatttacatatatctagaagcagaataaattactattgcaaaaatcacaaagattatttgttttctataccatgatatgtcttagagatagaaaagaagaacatatgtggtatagttaagtttcaaaaatattacatttaggattattattctatttaggtttattgttcgtgatgagtgagatatagggagtctgccatcaaggagcttaaaatctagtagatgagagagacaaacatatttcaataaaatataaagagctgagatgcataggataatattcgggactcattaaaaagaaaaatgtaccatatactttttagagtcaattagataccaatggaaagtagtaagtgtctttttttttttttttttttttgagacagaatcttcctctgtcaccaggctggagtgcagtggcatgatcttggctcactgtaacctccgtctcctgggttcaagccattctcctggctcagcctcccgactagctgggattacaggcgcccaccaccacacccatctaatttttttgtgtttttagtagagacagggtttcaccatgttggccaggatggtctcgatctcctgacctcgtgatccacccgcctctgcctcccaaagtgctgggattacaggcgtgagccaccgtgcccggccagaaagtagtaggtttcttaactagaaggatttcaagccaaacctacattataattgtcttctgctcttatagattagtaacccttgtacttcatattatatctgggatcattaaacaagaagaatttgattcttacatagtgaggatatcacataaaaatacaggttaattaaacagaaatggtcagtgagggagtgaatggcggtcagaagaacatatggaattgattgtattagagcaaagtcgtgtagaaaattcacataaaaattgtaccagaacaatgttgtaaagtctacttgcaaacatcatataaacatcaaaccatgaagtataacaaaacaggaaaaaatttctaaaaacgaagagtcagattctggcctgttttgaagtaaggtttcgaggatctgagacactcatctgacccttaatggaaattgtatgaaatataaaaagatatgtagatataaatttatatatctagaagattgttaattatatttcaagatttaatcatggaatctatgaggaaagtttaaaagaatataatttatactgggcacttacgtggggtgagtttatttgtcagagtgaacttatgaattaaattgtagctaatagtgtatctgttctgggtataatttgatctgtactgattataatggctaaagttcttacatgtatacaacatttacgtagtcatttaacttacattacgtattaactcattttagtctcttagcattattctgtagagtaagttgggcaggtaagggtatctttattctagcaatatacatattaagcctgaaaaaggcaaacttttatgcattttcaattagttgaatccttctgtacagattttcaggttctattaatagttaaatctatccaatgcacagtgtcgtcaacccatttgtcatcttgatcttcacaactttgagataggtggtattattcctatatcacatttgaggaaacagtcgtagtatgaagcagtttattaatggttacagctagtaaggctatattatatgaattcccaaagttttaacatgtcccttctaattttagctatgaaaatttaagatactccatttgcctattgctaatatagtaaaagccacaatataattgtagcttaaaactgttcgttaggatatggaatgtctgcctagggtttctcgtcatctcctcctctctgtcccatattgaaatgacaataaagatttgtggtacaaaatttaaataatactgaaagttagaaatagctggtaatgctactcagaggtaggtagctgccatcattttggtgtacttcctttgctaactttgtattaccttgtgaaataataatttttacataaatgggctcataccacatgttttaaaacctgttttttctttttttctcaacagcttatttcattttttttttttaattagaagtttacttttacatgttttgtatgtttgaatattggcttatatggtgactttttggttttattaaggtttgccagattaataacaattttcttatttttaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagtgaagaacttgaactttgtccatataaacctttggaccataggttatgtgaaaagatcagcttataaaaatcatatgaaatattttctgaagaactcattcatagtttggatattccaaatttgtgaaaagatataattttgtaaagattgttaccatttcacatgtatggtcctaagcagttaatgatgcattaccatagaaaagtggtttatgttttttagattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtaggttatttgaaaagttatgtggccagtttatgataaagattgttttccttatatatcaaacttagacattaatcttaggattgaatagaacatttatccactttataatttttcttaaaattacaagaacagttacttcacgagagaaaatttagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctctaaacagtattttcttctcaaacttttatttttcacatcatatttctgagattgattttgtacagtcgtaattaatcattttcacctctgtatagtattctgttgtgtgacttagcgcaatttatttagtctcttgttgatgaccatttagattgtttattattttttgcccatagccataatgcaaatatcttctatatgctcttggtacacatatgcaaaagtttatataccaagtggggaattactgtgttagaggatatgaagtgttatctcatggtagttttaatttgcattcttttgattgctaatgaagtacagcttctattcatatttttatttctatttgtctatcccagtttctgctctgttgaagtcatttgttcattttaattgtgctgtcttttttttttttttttaaagtatgtagtttttatttttacttatttaaaaaaaatttactggtttattataaaggatacaactcaagaacagacaaatagaagggatacacaggacagattaagggggacagagggtggtgcagagcttctgtgccctctctgggtgtaccaccctcctaagacctcagtgtgctcaccaagtgggacactctctgaacctcactgtacaatagttctcatgactcaatctccaaccctcctctcttccacagagtttggtgggtgggactgaaatttccaactctaatcatttttggtcttttggtgagtagccctacccttaagctatttcaaaggagcctccactcaaagctatttcattagcataaattcaggtgtgattaaaagggggctcttttttctaagtttatttattttgttttgggacagggtcttactctgtcacccaatctggagtgcagtggcgtgatcatagctcactgtaactttgaactcctgggctcaagtgatcctcccatctcagcctccctagtagctgagactacaggtgtgccaccatgccctagctccttttaaatttattgtattgttaaagtcttttttattgctacttatagaggtatctcttttcaagtatagatagcagtccccagcctttttggtaccagtgattggttttgtggaagacaatttttccatggaccagggtaggggctggctgctttaaggatgattcaaacacattacagttattgtgcactttatattattattacattgtaatatataatgaagcaattatacaattcaccataatgtagaatcagtgggagccctgagcttgttttcctacaactagacggtcccatctgggggtgatgggagacagtggcagatcagcaggcattagattctcataaggaatgcacaacctaggttcattgcatgcagagttcacaatagggtttgcactcctatgagaatctaatgcctctgttgatctgacagtaggcggagctcaggcggtaatgtgagtgatggggagtggctgtaaatacagatgaagcttcactcccttgtctgccgctcacctcctgctgtgtggcccagttcctaacaagctatggatcagtatttgtctgtggccaggtggttgaggctccctcctcatatagatgactatttaacattactctaatgatgggtattaaaagtattttctatttctcaaatgtgtagttttaaagcaaataataataattatagcaatttaatctaggccagctgctatgctgagttgacatattatcttaatcctcacacaatatcgggtatagacactgtttttaacttccattttgttgataagaaaacagacattgagggatacagtagtctccctttactggcagttttgctttctgtggtttcagttacctgtggccaaccatgagctgaaaatactaaatagaaattccaggaataaacagttcaattgcaggtcattctgagtagtgggtcaaaagcttgtgccatcctgtcctgcctggagttagaattatccctttgcctagcatatccacattgttagtgctacctattaatcacttagtcatctcaattatcagatcacgtgtcatggtatcagggacagtgtttgtgttcaagtaacttttattttacttaataatggtctcaacatgcaaaagtagtgatgctggcaattcagataagccaaaatgttgttgtaaagggcttcctttaaatgaaaaggtaaaagttcttaacttaataaataaagaaaaaaaattgtaatctgaggttgctaagatctatggtaagaacaaatcttccatctgtgaaattgcgaagaagaaaaaagaaatttatgttagttttgctggtgcacctcactgcaaaagttatggccacaattcatgataattgcttagctaagatggaaaaagcattaaatttgtgggtggaggatgcaaacagaagtgtgtttcgattgatggtgtctgggttcaatactgtccactggggatcttgaaatactatccaatgtttcaggtatccactggcgatcttgaaacatatcccctgtggataagggggaacttgtccttgtctaagttcacttgtcttagtcttaataagacttgtctaagttcactcagtagtaagtgctagagccagaatggaaaccgaggcagtccttacatgcatctttgtgcagcacatagcctctattattgttagttatatagttgatgaagatggtgtttattacttgaagcctcatttttttaaacaaaattagcaaatattatgaatatgtgattatcatgtatgtattattggaacataaagcttaaaacaatgtaagaatcctctgaaaccataccactctgagctactataataagggcatcttcaagcctttttttttttttttttttgggcggagtctcactctgttgcccaggctggagtgcagtggcgtgatctcggctcactgcaacctccacctcccgggttcaagcaattcttctgcctcagtctcccgagtagctgggactacaggcacgtgccaccatgcccggctaatgttttttgtatttttagtagagatggggtttcactgtgttagccaggatggtctcgatctcctgacctcgtgatccacttgcctccgcctcccagagtgctggtattacaggcatgagccaccatgcccggccttctctatgctttttatggggcatcttttcatttaatttccttccatttttgagctctctagcgagtgtgaaaatggagttttggcagtaaagctccacaagggaatagaagagaaggctctgctgccagttagataacttccctctggaaatcctggcaagatgtactgaaaggtttcagagggggttggtatgatggaaactagtataaggatgtacctatattagcttttttgggtgagaaattaatatatatattagtccatagtacctcgatttccctacgtttatggcattagattaccggcaacagcagaaatcaattgaccttcacttgcgtgggtaccttttgattttgtgattgttccattttcttccctgcatgtcattattagcttttaaagtttttcttgtattcctggattatattactcaataaactttggaaatttgaatcagtatttttctctcagaatatctttattgatttttccttggtaattatttccctattatgtatagatgttatgataattcttttttgagagaacttaaaaagtttgagattcttaaataatggaacaagaaattgagtttttcatatgcattcttcattagagtattaaaacattttctaataatttgaagctatagtgtgtttgatttgtagtatattaaaatctgtcatttttcttttaggctgtaaaggatgtgaatctttgaacatagttgccatgaatcttaaataacaaaaagcagttagtatttttaaaatattccatttgttttataaacattattttgtaggtatctgtaatgcgtgatgaggataaattactgaggattaaaattaatgaactggagaaaaagaaaaaccagtgttctcaggaattagatatgaaacagcgaaccattcagcaactcaaggtaaacagttttgtttttaaagatgatttaaatgcattctcttggtatattttagtgtacaaaaaggtacaaatttgtttttaataacatcctgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgtttaagaataacattaccattagtcatactgatgctgtgtgcttcctggtttgatgtgaccagaaaggcacataccctctttggtattctttccctaaatttataacctcagactcttcacgaaaaaacattagacaaacccaaatggaggatgttatacttactgcttcaccagtatgaagtataaagtgtcagggtcattaaagacaagtaaagactggtgaatgatggtgaagtctggagtgtaattaatagtagtataccaatgttaatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaaattccttttaaaaatgatatttaaaaggcaaaatccctttattgtatatggttattttttgcttgatatcaaccaaatggatgaggcaacaataaaaaaaatacatttgttatattattttcatgtttgcttttaaatgaagcaaactaatgaatagtcaggtataaatacatgattttaattcttaaggtaatcataataaagcattctataacaataggattcgagatctccatattccataatgattcactcttaagacttacaaagtgatgagatagtggtgacattagatgagattgggggtgaagtttggattacatgataagttacaattagaactgtaggatatctggtccccataatttaatcttgcctcttaaggcttatttttttccaatcttgcagctactttctaggtaaaaggggtggagagctcttttttccttcattttgagtttaagtttaccagtgaggaagcttttaatggtttttcttgttccttctatgttaaatacacagtagaacttcattttcccttgtttctgctttttgtggtttgtaagaaaacatttatctaaaatgttgagtaagtaaaataaccgggtcataacgtagattaaaagtataggctgggcacagtcgctcacgcatgtaatcccagcactttgggaagccgaggcagacggatcacaaggtcaggagatcgagactagcctgaccaacacggtgaaaccccgtctctactaaaaatacaaaaattagccaggcgtggtggcacacgcctataatcccagttactcaggaggctgaggcaggagaatcgcttgaacccannnnnnnnnnnnnnnnnnnnatatatctgttgatatctttgttagcctttaggtttctcatccttcaaggctccattttgaagaaacaaccctgtatttcctatttccattataaatactgcatatattatatattcctcactaggttcaatactcctggagagctgaggatctcagtttatttatttagagacagtcttgctctgttgcccaggctggagtgcagtggtgcgatctcggctcactgcaacgtctacctcccaggtttaagtgattctcatgcctcagtttcctgagtagccaggattataggcttgtgccactactctcagctaattttttatatttttagtagagtcggggttttgccatgttggccaggctggttttgaacccctggcctcaagtgatctgtccaacttggcctcccaaagtgctaggattacaggcatgagctacagtgcctagccttattttattcttttttttttaaattttttaattttaattttaatttttattttttgagatggagtttcgctttgtcgccaggctggagtacagtggtgcgatcttggctcactgcaatcttggctcactgcaatctctacttcttctttcccctgctctcaccctacccttttctccaagatgaaagacagttggaagcttgagactggtaccagctggtataccagctatataggagactgatttcaaacttaatattgagccctgttttcaagatccactgttaaatattgtgtttttaagttaatttgcaattaatttatattctttcaatttgtaggagcagttaaataatcagaaagtggaagaagctatacaacagtatgagagagcatgcaaaggtcaggaacaagtttgtacttctggaaccagaaaagttctcttattcccctcgcagggcatgcgatgggggtatgacttgcttcattggtgccctgcagctcaaacccctagggggagcatgcagacgggcaggtcttgagtgtgggctctgaccctgtggcagcatctggggttgagtgtttacagctcctgaaggccccagtgggcgtgttctacagggtgttttttcagcctagccgtccacaggcggcttgtgttaatcagctcaattagaccctctgccttattgcaaggacagagggctttctgtatcccgggattcttgctctagtgtactggaaaaatcggatcacacatgggcgtgtagaaggttttattgagtggagttagctctctgcagatgtatggggagccagaaggggatggagcgggaaggtggtcttgccctgggcggccggactctcctctgactgcccgcaaccaaattccgtgtcatctcacagtagatggcctgccagcatctgctggtatctgctggtgtgttcttccagtgtgttcctctagatgttcagctgcttgtgtgtgtgcctgccagggtctcagggtttttgtaggcacaggatgggggcgtggcaggccagggtggtcttgaaaaatgcaacatttgggtgtgaaaacaggagtgcctgtcctcactctgtgggcacaggcccgagggtggagccttcaccagggaccctgcctttctgtacccagcacttccctgcctgcctcccatatcacttccagtactaaaattacaaaacaggtagttgcaataacaactggttaacatttcctttgaaaattctgaagggaagtgagggcaacataagatgcagctttatcaaaagtgaaaagtagtgattctaatgaataatttgttaacttaaagcttattcttagaaaaataaaataagtagtcaaagcaacattgatttcttgtaacggccagtattttgtgaaaaataaagccagtcaaacttttatgtaggtcacaatgaatggcatagatttctggacgaaattgtgtaaagaataaacttcaaataaaatatctttaaaattaaaatgtgtattctgaacggacacttctcaaaagaagacatttatgcagccaaaaaacacatgaaaaaatgctcatcatcactggccatcagagaaatgcaaagcaaaaccacaatgagatatcatctcacaccagttagaatggcaatcattaaaaagtcaggaaacaacaggtgctggagaggatgtggagaaatgggaacacttttacactgttggtgggactgtaaactagttcaaccattgtggaagtcagtgtggcgattcctcagggatctagaactagaaataccatttgacccagccattccattactgggtgtatacccaaaggactataaatcatgctgctataaagacacatgcacatgtatgtttatagcagcactattcacaatagcaaagacttggaaccaatccaaatgtccaacaatgatagactggatgaagaaaatgtggcacatatacaccatggaatactacacagccataaaaaatgatgagttcatgtcctttgtagggacatggatgaagttggaaatcatcattctcagtaaactatcgcaagaacaaaaaaccaaacaccacatgttctcactcgtaggtgggaattgaacaatgagagcacatggacacaggaaggggaacatcacactgtggggactgttatggggtggggggagtggggagggatagcattgggatatatacctaatgctagatgacgagttagtgggtgcagcgcaccagcatgtcacatgtatacatatgtaactaacctgcacattgtgcacatgtaccctaaaacttaaagtataataataataataataaaatttttaaaaagctgcttaataatttagattcaaatcctaggtgctgaattatgaattatgcttttcttactcagattgtattgatttgttgtttgaaatattacaaaattacttttttctttttgagacggagattcgctcttgtcatccaggctggagtgcagtggcacaatctcagctcactgcaacctccgccttcctggttcaagtgattctcctgcctcagcctcctgagtagctgggattacaagcaccagccaccatgcctggctaatttttgtatttttagtagagacggggttttgccatgttggccaggctagtcttgaactcctgacctcaggtgatccacccgccttggcctcccaaagtggtgggattacaggcttgagccaccgtgcctggccacaaaatttcttttatagatgatacatatttctgtttttaaaatgatacagactcctctcctcctcattaccccttaacttctttgttctgtgagtggcagaactaggatttgaacccaggtgtgcttcactcttaagtctcagactctctttactaatccatgttatttgtacttggccaacaaaagaaagggtaacacaaccagattattacttatttagctgacttatacattggtggggttaacttggatgggtaacttggatgtgaaaatatatctctgcacacagtactgttttcttctgcctttcttaggccttgtcaccctaacatctcctatttcataggaaatagttcatagctatcttttaggattcccctttactttggctcctttgtccctcttggtgaatgtggacacatcttagatactctggaaaagtctacccttggaccaggttgccctatagtttttatcatattttaatttttgttttctttgccaaatatggagaagtatggcataggcccaccgtgactattttaatctgacttccaccttttctatgcttctaagtcacttgtaacctacatatgttaaaatctgtcagcattttgcaatccctgctttttatttttcattattttggtgttattgtacactcttcttttcctcagttatatttataaagtagtatttattgtatgtgtattttttctaaatataaaggtaatctatagctcctcccaccttttgaaactctcttgtctcagcttttatgatctattctgtactagttaccacttttctctcagaatgagtctcagccactttggtaacttgcctgattaagatgtcgttatctttttttaaaattattttttcctttagagagaaaatgctcttgtgatttaagttgtgtatgagacatttccctacaaatagacaacaaacaaaactatatctttaactcttaaggctttccctgcctcctaaatttctatttattcacggaatgcctttcacttacctatctttaatattgaattattaaacaatggagatctaatatatgtaacataaaatttaccttttaaaagtgtacagtttagtgggctttagtactttctattcacaaaattgtacaaccatcaccactatctaattactgtgtgtttatagtaacgtaaagtgacaagtgaacatttttgtcacttcaaaaagaaaccctgtacccatcagcaatcataccccattcaccccatccctccagctcctatcagccactaatctactttctgtctgtatgaatttgcctattatggacaattcatgttaagtcagttcatacaatatacggccttttgtgtttgactcttcttagaataatgtttccaagtttcatccatattgtgtatgtatccgtactttattccttgctatggctgaataatattccgcattttatgtatcagttgatagacatttgggttgtttccacttttggcttttatgaacatttatatgcaagtttttgggtaaacttatagttttaattttcttggggatggtaagcaagtgttgaatatgcagcacttgattgcttgttcatttaatagtcatttatttcactatgattgctcataactatccttagataatatctttagatagctatgatgagatatctgtctcagacttctttactttgctttattttccattttatcattttggtgtgtattttggggttctttcctgaaataaaatgtaaattactggagtcaatgactgattaaataattatctttttgcctttactgctctagtttgctagctttcaaataataggtgagtagccattagtgaggttaccattggtgttctggaaattttttaattgataattagatttgtaaattctttttctagtcctcagtttagagtcagaaatgcaaagtgtaagagggagggaattctttgaataaaattataattaattgtgtaatatgaatatatttgaaaatcatgctttttgaaagagatttatatgataatatgaaggtgactttaatcctaggaggaattctgttttactagcacacctgaaagcctgcatcaatggaaaaatactaaaaactgctcatacagttttctcttactgtttagtttgttttacctttgttttatgtgcactttgagggagccatctttgggtatttgtgttactaaaagcagcctgagattgagctatgcatttatagctttatcacctctgacatcagtaatagttggtaagagttctctgaaatgagccctgctactaggtgccatcaccagaggcaacaaactgatcttccctctttatccgtttcctgcagacagggttaatatatagttgcttacaagtaattgctgtagtcattcttcaagggccagaaacaattttaggaaggctgttattactagcttttcaaaagccatttctgaggagctggttttaaataaaaatttaaaatagaaacaaatatttgactctgaatatttttctagaaaaagtaactacttgatgttaaaaaaaatagttcaaattgggattgagcttttttagttttaggaggtaaaggttttagtttgattggagaatattaacactgaaaataagtattttgccaaataatggtttttccccctaaatcctaagatttatgttcatagtaatagttagttgtatcggaatagtttaattgtattagaaattgttaattttacctgaaaaaacttttttccattcatccactcttgcaatcatccaagcatccatctttacaccaaatatatatttagtatgtcatatataccagtactgttgtagacattgaggatattgcgatgaataagacaaagtttctgcctatatggaactaatattctattacagttaataaaaatgtattttaattttagaagaacttaagaaaaattggatatctagaggctattaatttctaaaatgttctcccccgatttttagatctaaatgttaaagagaaaataattgaagacatgcgaatgacactagaagaacaggaacaaactcaggtagaacaggatcaagtgcttgaggctaaattagaggaagttgaaaggctggccacaggtaaaacaagattgcttacatttctctaaatatactttttcatttaaaaaaaaatttcctagatttcttcccttgttaaagtagtacgtattttcagtgattgataatggaaaagtatttggtgttttttgaatgtcctattacttgtcattttccactgtgatgaaaattgtttcactaaaattatatgcagtaaaggagtaaggacactgcatgataacttacgaattatatattgcaagttatggatgataacttgcagtgttccctagatgttaagagtaagttttcaactgagtttcacctttgtcaggcttttagcattatcttgtatgttgatctcaataaatactttgatttcattgctttcagaataccatcagagtttttctagagtatatggaaaaatataacatttactaataaaaatgttatgtgtgattcttgtagaaagggcaagaaatttagaattaagaaattgtctagccattttatatataaccttggcagggtacttgtgcttactcagcctaattttcctcatttgtaaaatgtggctgatgatgataatgccatatgtactattgcacattattctttttttaaaatcatctgacttgaagattcatattgtacattattcttatcaagatcagatgagatgaaaaaatgtaatagtactttgtaaaccctaaaactctattataactgtattttggtggatgaaattgtgatgaggatgaggacagtgagtctgtgtgacttcatacttttctagccactttcatgggcatagaaaacttttttcttgaggactgcatgaagttttctatataataaggttgacaatgaatttattatactatactgtgaatactattcattggattcctgagaagtccctgtagttcctcttcactaagaatttagtaagaactcctaaaagttaaactatagaatagcctcagttccatcttggtctgtgttctttatctgggctctactgatttgtgtctgtagcccatgtcaagtgtatctctacatggtataacttttgcatatgctttaaaacataattttatgtcttcaaatcagaattggaaaaatggaaggaaaaatgcaatgatttggaaaccaaaaacaatcaaaggtcaaataaagaacatgagaacaacacagatgtgcttggaaagctcactaatcttcaagatgagttacaggtatgactttatgtatgtttttatgtatgaatgtatctgtcttcattatatttctaataagaggagaattcagtattttatatttagtaattcacttagatatgggtgaaataatacctggcaaatgttaatatgtaaatataacttttcagtgcacattgaaatgacatggggaagaaattccaagatatagcctattaagtgccagtgaaatatagtgattgggtccttagttttatgtttcacatatttaattcataaaccactgcttctaatgtccttgtgcccatttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtattctattttgtgtgtgtgtgtttttttcttgttcagctttaacatacaacatatgggggaaactttttttttcataggatttaccaaatactatttcattttgtacattttattagaagtggcattcataacagaagctgtaggattgaaggaaacataatagttttgggagattgtctgcctctaaattttttaaaattctggctgtgtattaaacatatgctgaaaacaaatacaaaaactactttttttgttacatattatatattctagaatttacccttttcattgtgaaattccaaaagcagttagaacaaaataaatattatgaaaaaagtgtatcaaccgtattgagaatgtttgcattaaaaagtatttgtgtattttgcattgttctaagatgatgtaatcacattagtgtagattataaactttgtaatcctggaatggactgccatactttgtaatatagtgattttagaagttttcttttcgtttttttgagacggaatcttgctctgttgccaggctggagtgcagtgacgtgatctcggctcactgcagcctccaccccctgggttcaagcgattctcctgcctcagcctcccgagtagctgggactacaggtacacgccagctcgcccagctaatttttttgtattagtagagatggggtttcaccatgttggccagggtggtcttgatctcctgacctcgtgatccgcccaccttggcctcccaaactgctggaattacgggcgtgagccaccgcacccagcctagaagttttttaagtggtattattatttttatttcaaatgaagttctacttgggttttttatatatattattaaatgcctctgaacccaaagaatctgtggtaccagtttgaaaattactgatcagcagtattctctgtccagctcttctggatgttcttttaataaatatcctgttgcacaagttattttttatttggcatctcgtaggcccaggaatattttatttttagaaccatccagttagaaatgaccaccacaaacaaagtcttttttattctcttggcatttaggaagatttgagtcagtttaactgtttcagaaatttgaattatttattttttcttaaggtcactgataaaagtatttaaatggacttcatagcaaaattaacttataaatgaaatgcgtttaggaaagcaaaccagttattttattattttttaaataatctgaagctttgatcttgtcattgtttaaagtgaaacattaaagtttttatagaggtgaaaagtaatggattgtatgaaaatgttatagaaacatgtattgactactttgtaggcatgcgataataacttataccatttatatatacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggttagtaacaattgtatctttgatgtatttcacctactttccttggtgtgttaaatgtattgctggaattaacagtttctacatggttttctgtttttggttttttaaaggcaggttgtcatctttataagataacttctgagccaatttatcttgacattcactaatgttcttgttttaacttgtttcagttgatttagcatgttgggagaataccttattgcttcttactgtctagatactgaagtaaaaaatctcttccttttgaccgttacagagtattccctattatattttaaaactttctgcattttgaactgtagattctaatactgtgtacattttatcacataaagtcacctaaatagtttgtaaaagactatatatatagtagaaatgaccttcagttttacatttactagctgtaggtcttgtaatgattgtcttagcctgttctttttttctaattggcacttagtctgacatgccatgttggcaatcagaaaaaagaagctaaacgttatcgttaatccgaggaaagctattgagcaacaaatattttaaaatgaaaaaccagtgtctataaaaatagtaacttcgcagtatcatattgtcatctgttggcatttcctttttttatgactgcatttgactaaaaacagttaaactttcctataaaaactgaaagatttccttccttctttccttccttccttccttgctccctccctccctcctttccttccctcccctcccccctttccttccctcccccctttccttccctcccctcccctccctcccctttcctttttcctttccttcttccttttcttcatcctgtcctccttcttcctttccttcctttctcctttcccttccccgtgcccatccccttccccttccctttccctttcccttttctttcctcttttaaagagacaaggtcttgttctgtcacccaggctggaatgcagtggtgcagtcatggctcactgccgcctcagacttcagggcaaaagcaatctttccagctcagcctcccaagtaactgggactacaggcacatgccaccacacctaggtaaatcttttattttttgtagggacagagacttgctgtgttgcccaggctggtctcaaactcctggtctcaagcagtcctcctgcctcagcttcccccaagtgttgggattatgggtgtgagccactgtgcattgtacccggcctgaaatgttaattttcaataaggtaaggacagtttttccactttttttcttccctagctttaaagctgcttttaacattgaatattgaacagagttggccagtttttattaaaatgaggctgttgtgagctaaactttccagcatgcttgctaaactccagaccatacatgtattctactccagaaatcaagcccttggttgaagtgtgtgtcctttctgaagctagagagtctaccattgaatgctctgtcctcatgtcacatggtgtaaatttgctcccataaaaaagtttactttttcatgaaatcattttatttacagaataaattttttgaaatcattttatttacagaaaagttacagaactagcacatagaattcctgtatacctatcacccaaccttcctgacccagtagtaagaggcaataagtaaaatcaaaacagaaggctgtcacagttgctccaattccaaaccagtggtttctctggtagcaatgccagcaagtaatcccactttgaatttttaatcctagggaaagctagtttactcttttctctcatatgtttctttataatcatacttaggttgtgtatgtgtctgccatacttaagaaacacatttttgatgtaatgttaatttttgatgtaaaattgtaacatataacatggaaaggaaatagaacatagttcagtgagttattgtgaagccagtacccacttaactaatacctatttcaagaagagaacactgttccaccccagaagctccttcttctgcctcttttccagtggtaataactaatctgtccttcagtgttacacttcagttttgtctgtttttgggttttatgtaaattgaaatatatgaatacatttgattgtacctgacttcttttcattcactattttatgtttgtgagaatcatccatgtttccatgcatgtatctggagttagtccactttcatttcagaatatttaagtgtatgaataaaccactgctaattcattttaatgttgaagatatttggattgttttctggttttggctgttatgaataaattttcctataaacatttttatacatttattttggtgcacatttgcatatatctctgttgtgtgtgtgtgtgtgtgtatatatatatatatatatatatatatatacacacatgacaattgctagatgatagggtatatatatgtgaaattctagtagaatgctgcactgattttcgaagcagttgtacccatttataccccaactagtgttgcagtagctgtatagtcccaccaaggtatggtattgtcagtcagtttttaaaatggttttaatgtgcttttccctaattactgatgaagttgaagattgtttcatttgtttattggctgtgcctatacaagttcccttacctgtttctctgttggattatctagcttcttatttgtaggaattctttatacttttcgggatagaagccctttttgtaatgtgttgcaagtaccttctttctatctctagtttgctttttctttcttactgcctttttatgagtaggagttctcataaattattattgtagatatggtagatattacaattattgtagataattttattagtattattgtagataattgtcccaatatttttctttatgaagcccaaggacttgaagatggtgtgttatattatttcctgaaagctttgaagttttttatctttcatatttagatactagaattgatttttgtgttggtgtgagatagtggtcaaagctcttgatgtttgttttaatgtgaattaccaattgatgtggaaatatttattgaaaagactgtttctttctcactgctgtgccacttttgtcgtaaatcatttgcccacgggttaattttgtatgtgttgtaagattagggttggggttctttttttttttcatttggttattctgttgttccagccccatttattgggaagattgtccttccttttatttaatttttttgccacttttttaagtcagttgaccatgcatttgtagatcgtctcttctgtcccattgatttctctgtctttacatgctgtcttgattattgtgctaacttgaaattatagataattgctgtcattttgttcttcattttcaaaataattttgagtattctagatgatttgcatctccatataatttttagagtcaccttttccatttccacacacattcacacatacctgaattttgataaaaactgcttttactctctagatctatttggaggagacatcttaacaatattgagtattttgatccttcaacacagaccaatctctctatttatttaggtgttctttaatctctttcagcagtattttatggttttatacattttctttatcagtatttcatgatttttgaacctgttgtaaatggtcttgttttctgttttcatttttctgttgtttgttgctattactgtaattttacccactaattttccaaacgttggcagaaatgttgatactagtttgaaagctatagctgtaattgtgtattgaaagaagttaccagtaagccgatttttggaatgagatgggatatggataaaaataacatggacatttaatttataaaatgatatgtgttgttttatagttaaatattttatctagactacttaatttgtcttgtaatcttgtttgcagctatatttatggtgttacatgtaataatttctaaacattcttagattcataatatatcaaggttgattttaatattttctttatttcctgattaggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagtcagtagtcttttttgctatgcctttttaattgaacatagtaattacttaattgactaactcttaaagaataaaaaagtgtaagtctcaatagaccaaaaaggaatcagagtatttaaaatgtggaaatttttcatgatttagagtcttgaaatttatcattaagattgatttgtcaatcaatgactgagatgtagcattttctccaatattttggttatatctctcagtaattagaaaatattagtatttctaattactttggtagagtaattagaaaatcaacaatttatggtttagtccccagtctgcgtttaaaatatggaaatgtgattcaacatgaactcttggtgattttgaatacttgggcccatccttaactttattttataaagatacaaattattttgaaagtaagcctaatggtagagagacattatgagtcattcagctgttacttttatattaccttgagactggaaatcctgaaagaggagagaattgccttttacagatagctgcttcccagtaaatagaatctgggtacatctgaagctagtctttctggaataatctgtacttaaaaatcttctgctttaaagccttcagacaataggaaaaatatgtatgtgtgtgtcacatcaaaagactattattgtaagagagattacttgctttaaaaagaggtagtattgtgttgtttaataatatatcctagaaagtcagaaaaactaggtatcaactgctgtcgctgtggttttgggacctttgagaagaattacttaacatttctgatctttatctaaaacaggtaatagtgttttcctaacagagttgtgaaattaatgaagattgtaaaacaagtagcacagttcttactccagtggaaatcaatatatgctagttactttcccttttatgaattcagtagagtctttcttatttggcagtaatggggaggtgacataagaggtttacttgacttttgattttgatggctgtgatgaggaggtctgtgttacagtttattaagtttaaaaatgtaatctatttctttataaatcgcctaagtagagtttagaaatagaactttatgactgagaaaataggaggaagaatgtgctgcaagaaaagatttagttttccttatggtcttttgtactgtaatgctatagttgcattcctgagaagcctccagtttttcaaaattgtgttatcaaaagcaactgttgggatactgagcaattctaactcagtacagaccttgaccatgccatttaacgtgtgtcgttctctatttcctcatctggaaagtaggaataatgatttttgccagacctacctgcagagttgcgatgaaagtaaagcaagagaatgtgggcagaacacttggaagttgcaagcaatctttcaaatttctccttagatcagagtcaataaactggaaagtgacccagcctttcctgagtatctgaggttgaaagagaaataggagggctaggtggtaattaaaggtgtctttacttagtaatttccattgtttagtttcatacaaatcttgattttatattctttatgtgaagttttcttcaatatattttcaggttacaatgccctgttgctttaatatttccttactttaggaaacacaaatcatggatatcaagcccaaacgtattagttcagcagatcctgacaaacttcaaactgaacctctatcgacaagttttgaaatttccagaaataaaatagaggtgggtatttggcagcacagtccacttatttattctctttatccactattactaaataacacgtacaagtaagttgctgaagataccttactgcacaattagctgtgtgtgctctgggctgtgtgaaagaaactagaggcttttgaggagaggtgaaattcttttgggagattatatgcccaaatgatgttaatctcatcttaaaagcagtagatttgttaatagaaacaaacttgatggtcagaaataggaaatcctactaatgagaaaatagggataatttgctctcataaaaggttgctttaataaacattgtgttaaatagtattttttggaattgtatccatttagtagctttgtcaccagtcttcaataacaactcgtgagtttccttaatttgtattgggcttagggttctgtgaataactttggataatatagagattcttaggttggatatgaaatagataaaaattctatgttacttaaaatttttgaagataaaattactttttaaatttctttttaaaacacatttattgggagcattcagagttgggaacctttttaagcactgaggatacgaacatcaataagacatgattgtcatcctcaaggagtgaagaatctagtaagatagatacataagtgaatgacttgtttgattttacttcatgggctaagtgttatagtagaaatataaagtgagtactccaaggaacactgaggaagatgaaatgaattttgcctgagtgtttgtggaaatggattaaagaaggtgataccatattgtatcttatgaatggaagcttattaagcagacaatgagaaggaaaagtcttaaaaaaaaaaaaaagaaatggggtttcactatgtttctctggcagctgaacttgaactcccaggctcaagcagtcctcctgcctcagcctcctgagtagctgggactacaggcatgtgccaccatggccaactgagaaggacattttaatctgggaaaataacatgagccattcattttctcttggtttttccttgacagttcttagtagtttcaaataattagcactaaccttggggactaatacaaatcataaatttcacagaaaagtttgaagtttatccataaacaaggcttaattcttgattgcatggacaaacacatataatggaacatttctttctccataaatttatgtatgttgtcctaaaacctcctggttccaattttctaattccagcagttattttatattccacaatttggggaatcatattgttaggctattttgtatgttcttgccttcatgtaatcgatatacttaactgggctgaaagtccaaaatgattaattcagttaactggtagttgattctgggaattccactggacttaatttgtggtctctccctgtggattggacctctcatggcatggtagctggtctgagatggggcattttgagggtgagtgtcctgaaagtgttctaagaggacaggacagaagttgtaatgcttcttatgattgagccttagaggaccataatgttatttctaccacatcctattggctataaggcccaaattcaaatagaggggaatgagagactccatctctcaatgggaagagtagcaaagtatttgcagcctacttctttaatataaccaggctgtttgtcaaagatctcagcctcctcccttggagatttctgatttactgggtttgtggtagagtccaggagtcttttaaacaaattctgtaagtaattcttatgatcatacaagtttgggaaatagcgatgttacccctaattttaacataccatgtgtgagcctgaagaaagtagatgattgctcaatctttctgttcttgctgtgatctagcacgctttttgtctttcccaatgcattgtcttggataggcatttgagagaattaattctttgtggtttataaatgtatactctacaaataatatttttccttttacattctgttgtaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggtaaatacttaactgatgagtaaatttaatgaacaaatcttattataaagctgttatagtatagagttaaactgctatattgccctcctgttcataggcactgctgttagagaccaaaatcacaatttatgctatattttataccctttaaggatatcactgtgggccaggcgtggtgactcatgcctgtaatcccagcactttgggaggctggggctggcggatcacttgaggtcacgaattcaagaccaacctggtcaacatggtaaaacccgtctctactaaaaatacaaaaattagccaggagtggtggtgcacacctctaatctcagctactcaggaggctgaggcaggagaacaacttgaacccaggaagtggaggttgcaatgagatgagatggcaccactgcactccagcctgggtgatagagcgagactgtctcagaaaaataaagaatattactgtggtttaatggtcttcagataaaaagctatgtatattaaaagatatagcgtccttgcttcagttaaactataatacatcaaatgatggtggattttactggagagccatttcagtataccagtcctgttcatacttagtcactttccctgtattggaagagaaaagagggttatgtagaaatcagagaaactgaaatagctaacttgcttgtgtataatctttgtcatttaactaaaatcttgtctgtatggtcctagcaagttttaaaagagaaattcttttttcatcagccagtgttaaaatttgggcctctatgtagtggtaggctaaaagctattaacctcttcttactgcagtttcttgattgaagggttgccaaacctaccatgtcctagatgtggagatttggcaagtcagatgaggtttctgatcctgttttctcctttttggaacaatggattaatgtgttgaaaatgcttcgcttttgctctgcaagtggcagttacatttattaatataactattattactatttattaatagttactattaatatttattaatagtattatttatttatatatttttatttatttatttatttattattatactttaagttttagggtacatgtgcacaatgtgcagtttagttacatatgtatatatgtgccatgctggtgtgctgcacccatcaacttgtcatttagcattaggtatatctcctaatgccatccctcccccctccccccaccccacaacagtccccagagtgtgatgttccccttcctgtgtccatgtgttcccattgttcaattcccacctatgagtgagaacatgcggtgtttggttttttgtccttgtgatagtttactgagaatgatgatttccaatttcatccatgtccctacaaaggacatgaactcatcattttttatggctgcatggtattccatggtgtatatgtgccacattttcttaatccagtctatcattgttggacatttggattggttccaagtctttgctattgtgaatagtgccacaataaacatatgtgtgcatgtgtctttatagcagcatgatttacagtcctttgggtatatacccagtaatgggatagctgagtcaaatggtatttctagttctagatccctgggaatcgccacactgacttccacgatggttgaactagtttacagtcccaccaacagtgtaaaagtgttcctatttctccacatcctctccagcacctgttgttccctgactttttaatgatggccattctaactggtgtgagatggtatctcactgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtcacctattcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcccaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagatatgcggcgttatttcacaagcattcttatacaccaataacagacaaacagccaaatcatgagtgaactcccattcgcaattgcttcaaagagaataaaatacctaggaatccaacttacaagggacttgaaggacctcttcaagaagaactacaaaccactgctcaatgaaataaaagtggatacaaacaaatggaagaacattccatgctcatgtgtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttaactatactacaaggctacagtaaccaaaacagcatggtactggtaccaaaacagagatatagatcaatggaacagaacacagccctcagaaataacgtctgttaagtattttatttctccttcacttatgaagcttagtttggctggatatgaaattttgggttgaaaattcttttctttaagaatgttgaatattggcccccactctcttctggcttgtagagtttctgccgagagatccgctgttagtctgatgggcttccctttgtgggtaacccgacctttctctttggctccccttaacattttttccttcattttgactttgctgaatctgacaattatgtgtcttggagttgctcttctcgaggagtatctttgtggcgttctctgtatttcctgaatctgaatgttggcctgccttgctagattgaggaagttctcctggataatatcctgcagaatgttttccaacttggttccattctccccgtcactttcaggtacaccaatcagacatagatttggtcttttcacatagtcccatatttctcagaggctttgtttgtttctttttattcttttttctctaaacttcccttctcgcttcatttcattcatttcatctaaaaagcagagcgcctctcctcctccaaaggaatgcagttcctcaccagcaatggaacaaagctggaaggagaatgactttgacaaattgagagaagaaggcttcagacgatcaaactactccgagctacaggaggaaattcaaaccaaaggcaaagaagttgaaaactttgaaaaaaatttagactaatgtataactagaaaaaccaatacagagaagtgcttaaaggatctgatggagctgaaagccaaggctcaagaactacgtgaagaatgcagaagcctcaggagccgatgcagtcaactgggagaaagggtatcagtaatacttatttttaaagtaacttgttttaagcttaaaactaattacaaactctctagcaaaataatttttcttcaactttcttttacttctttgaagagtagtatattttcaagctgatgtaagagcagaaatagtattaactatactcctgaggctctctgtcaggtaataattttgctgagtgaatattattcagcatagtttttctgctacacatgtaacacctttagagattgttttatggagtcttactagttaacttttgttttatatttatttaattttttaaaataacattaaaacactgagtttcatcatctagttggctttttcttgatccattttttttcaacgaagaaggaaacaccgagtgtagttctcaagaaggttaaaatataaatattttattaattttactattggcatatatccctcatgtatatttcagaaaagatttacagattgttgtagatacatcatgtagaaactttaaattttctaactgattttactcaatcttcactgctataataaactaagtacatgggcccccatgaaaatcatttatgcaatcctattttctttttttcttccacatactcttttttttttttttaattactaagttctgtggtatgtgtgcagaatgtgcagttttgttacataggtatacacatgctatggtggtttgctgcacccatcagtctgtcacctacattaggtatttctcctaatgctatccctcccctagccccccaccccccgacaggctatattctaatccagtgaagactccaaagagctccttactgaccactatgtgtggaggtagcctcatggtctcttttcacttgcatcctatgattaccatctgtcttttccctgtcatggtgtctgcttcttatgacccttataacttctgctttgtaatttggattctgaggttcagtcatgatcttttctctgcttctcttcttgccccctttttcctgaacttttatctttggtacaactaggatttgcagcagttcaagtcagtgagtatatctgtaaagggctttgtcctatgtgaggttatttggggaaaagaagagtaagatgccatacccatgttgtagagaagaaagataatattttaaaagttttaacattttacctttggttatttgaagtttcgtttttattttatttttgatattgtcaaatgtcaatgagagaacttagacatagatgcttgtattatttgggagttaggcaataggtaggtatattgtatgctgtattttaaagctcagtttcaaataaaagatattccttccatgtttttcatttagcttatgtaatttcattacttgtgatatgtttgaaaaattcacaccttcagtcagggtttctcaactccagcacagttgacattgtgggctgtatacctctttgttttaagggctatctatcctgtgcattgtagggatgtttaacagcattcctgacctctacccactcgtggccaataatatccccttctccctggcaaagacaaccaaaaatatcttcaaacattgccattgtcctctgagttcaaaattgccctcggttaagagtcactgttttaagtgataatgtagctttttacaaattttcttttttgagtctagagaaataaaatattgtcaagaaattaactggtgctaaaattcattatttttaggacttggtgaaatgtgaaaataagaagaatgctacacccagaactaatttgaaatttcctatttcagatgatagaaattcttctgtcaaaaaggaacaaaaggtgtgtcttttaatttgtccaaaattgtagcaattatccagaaatccagttgtgttcaattataactcatttatcttctctttcctatacatctgattcagttgaaatgtaacctttagcatttggccagtagcatctactttatgtgtttacttctgactttaacactctgcctgtcaaactctttttgccattgtctgacccttttatccctgtccttatatacttaaagtttcctacctgagaattcataacctgtctctggcctctttaattcagctgtggccataactatttccttctaacacttctcatcaacaataacaaaaaatgttttgtttattaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaaggtttgcagaaaattaattaaatgacctttttttgttagatgttgggtatattttaatacctaattgatatataaactcaacagctgttcagggaatattatacttcaaataggcattgtcctatactaggtactgtgggaagaaacatgtaaaaggatgatagatctaggtgttcgctatgtagtagaagagaaaggcttgtatttaagtaactgatccagagcaggctacttaatatagtaataggggtataagcaaaggtatgatagtattggagggaaaagagctactctgattagggggctttgggaaggtttttatgggagagatgggatttatcctgtgtattgaaatgtgggcaggagtacactctctagggtgtccaagggtgagaatacagtcatgggttcttagtttctgtttttggttggggcaggaaatccccttcctcatccctgttttctgcttatcactagagacagaaactaaaaaccatggcttcaggccgctaaaagcctaaaacaaaacaaaacaaaacaaaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcagaaacagtatgcttagtgctttttttcttgataatataatgtggacatattgatacctgtgtatatgttaagatatatacacatgtgtgcacatatgcggaaggaatggttttaacacaggtggagtatcagaaaaatgtaggaaatgttcatgcaattacaggcagcaatacacatctggcatgtagaatgtggaaggactatcttaggggtgagatggagtagtgggtttttgtgaggttacctgaatgacagcaataggatgaattagagaccagagtgaggggtatagggaaggaaaggaactagaagcagggggcagttaaattgaatcaaatatgttgtgtgaaaatactttttgtcgaaggcttaccacagacgtttccaaactttgttggttcacagtgcccttaatgtctcagtaattaatttccattttgcctctgcacccaaagaaccactagtagtctcatgcattagaacttaagaccaaacaaccactgaaaattcagcttctgaaaatccagattgcaaagataatgtcataatgaaaagaaatgtaattcagtatcgttttgaaattgaactaccttgggctattgagcatcactattttccctgaagattgaaaatatcctgaggtgcttctgtaagtttgctgcagcatgccttagtacacagtttgggaacttctgacctatcagacccatttgtatatttacatacatttaaaaaaatatgtacatttaaaaaatgtgtttgtataaacagaaaatatctggagggacaaacagcaaactgttaaatatctaaatttggagaggagggacatctttctttagagtcctttaggcttactaccacttttatattaaaaagaaatatattttcaaggagaggtaggtacctataataagtatgtaatcagataagggtaatgattctcttacttcattgacttggttccttaacagcttccctaccaatgcacttgacatacattttttttttccttttttctttttgtttttacttatttctagaaatataagatatccctattttgaactgtaactgtaatacatatttgttgttttgggtcacttggaaatatagagagaaaagaaaaaatggagattaatttttaaaattctgctgctctgataaccactgttaatccatcacttagtatcactggtctcccagcttgcccctcttgtcatctcccatccattcatacatgacagaatgttcttttcaaagtgcagattgaattatgttactcctctgatcctttaatgatttctcattcttctgaatgacctgatttctgactctctccaatctatctcttattattctacggtttgataactagccagcttcaatcctgctaacttctgacagttcctagaatttgccagcttctttcttaccttcatatcattgatttcttttgctttttcctgtgctttcttttatctggaacacaccctggcttttgtcttagctggccccttacccttgagccctcatagctgatggaacgttattagggagacaccttccttcatcaccctgtcactacccctcatccccagcatcacttaatctttattattcaatcctattttttgtcttagcactttttaaactgtaattctttgctttcttattatcttttacactagaatataatctgcacggacaaaatgtctgtctagttcatactgtcagctcttagtatagtggctagcacatagtagtgatgagtttggctctaggccaacatatgtatgatttttaaacatttctattttttttaggctgtaccataggcaattacaaagacttacctgacaagcttcccttcctacaccagacttgatgcatagccaatgcattataatctcttaagggagttatagtcaaggatccagcatcccccaagctagtcatgctcttactcatatttgcatatttagcctgagtgcctccattcagagcctctttattgaggcctttggtggaggccttcttatggaggggaacaggagggggaaccttgaagacgcttttctccactgtaactcggtacttttccacgtatagctccctccaacctccagccctgaggtctataaaactgcgagagccttttgtttggggctgcctgggtggtaaaatgaccaccacttctatgctgatctgtattattctgtggtggactatagaagagggtgggtaggagctggtgctttctcaggtttagtctctcgcatatactgttgaaataagtggttaaaaagctgggttgttactttcattttggcttgttgtcttaactggcttctccgatacctggactctcagctctctcaagcccagctcagcccttaacaagtagtcttctcaatttagtctaatgccttaaatgttttttctatttaaaaaaaaaatttgatatcacatgtgtgtgaatttctatccaggaattttcccacatggaaatatgttttctattaaaaaaaagtactatgtactatgtacatagtaaggaatttaaaaattcctattctacttccctaaaagcaatcagctgttaacagtttggtttctctccatttgtgtgtggacttgaagtaaagggtttacaaagtattttcatgcagcattcattgtgcataactttatgcatgagcattgaactagatcatctaccaccttatttttaatgctgcatgatccactatgtatatatcctgctcttttgcttaacatagcataaacattttccaagtcattaaagatgcctgagattttttactacattgaacattaatcaaatgatactttatttgctttttttttgctgtcaatcattatttcatgttctcttgacatttactttttttctttgtgatttgtctattcatgccctttcaccatatatatattgcagtgtttttagtttgtgtatgttcattctttattaaggatttcaaaccatctttattaaggatttcaaatcacctttgcaattagaaaattatttcaggaactaattaacaattttattttatagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtggtaagctagtatttctgttttcatcaatgtagaactgttcgtgttctttttaattttttacagtggtttgaatttcaattctttagatctctgaaaacacatgctataaaggtcatgcttttagtctcacatgtgttaagtttatactaattaaatataaatactgtattaaatgtatataagcgtcatgcatttgcatttgaaaatgcatcagaggaatttatttccaataatagaattgtcaccatttagtaacttatttgcctccacaatctttttttctttttctttctcttttttaaatcacgggagttgtacaaatctgggcccaagtgttcctggtaaaaatataaaactgacattcagccatttcctcccacctttcccctaagcctttgaggatctattaggaagagactgtagttatcaccctgagtctatgattcattctcctgattcagaacagtatgtgctgtcacagggaaagctcaaattttctgtcatgcttgcatttgcttagtggatgaaagtgaaggtaaaaaaataattaaaagaaattaaaaaaattaaaaagaagtggccaagaaaaatcaggagaaaccttttttgccacaagagctttcagatatgagattgacacttgaatgcaagatgtaaagagttagggtaaattagggcatggtgttgtaagtaccattctgtcagtcatttttgagcatctgtttgattagtacctgatttcttcccttggctgaaaattgttttcttagttactatataatgtgctttctactttctaagttatacatttgttgccacgaaagatcatttcttaaaaattatttgaggcacttgtctccaaatattttagtaattattttaagttatatctgccttgaattcaatatggagtctaggttattttacttctagaatttgatagtgttgaatcttttacaaagtctgttttttaaataaatttttatagaagatggcatatctgtagtctaagtaaaaaaaattctccaatgtatcatttcagttactaagcacatgaacatgtcttactcattataaacaagcttttatttttattttcacttacaagctttgaaaaactatgaaatttttaatttcagattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtctttgtctttctgtgcctggcttattaacatagtaatatccagttccatccatgttgttgcaaatgacaggatttcattctttttttacagctgaatgtttatgtcccacatttttttatctagtcatctgttgatggacacttaacttgcttccaaatcttagctatggtaaacagtgctgtaacaaacataggtgtgcagatatctcttctatttcctttcttttgggtacatacccagcagtgggattgctggaccatatggtagttttttgaggaagctccaaactgtttttcatagtgtttgtactaatttacattcctaccaacagtgtacaagtgttcccttttctctatatcctcatcagcatttgttattgcctatcttttggatataagccattttaactggggtgagatgatatctcattgtagttttgatttgtgttcctctgatgatctgtgatgttgatcaccttttcacatgcctatttgccatttttatgtcttcttttgagaaatgtctatttaaatcttttgcccatgttttttttttagtcagtttattagatgttttcctatagagctgtttgaacgctttacatattctggttattaatcccttgttagaaggatagtttgcaaatgttttctctcattctgtgagttgtttcttcactttgttgtttgtgttctttgctgtgcaaaagctttaaacttgaggtgatcccatttgtccatttttgctttggttgcctgtgcttgtggggtattgctctagtagaagtctttgcctaggccaatgttctggagattttcctcaatgatttcttatagtagtttcatagcctgaggtcttagatctacatcttaatccattttgatttgtttttttgtatatgtgaagagataggggtctagtttcattcttttacgtggggatattcagttttctcagcaccatttattaaagagactgtcttttccccattgttagtttttggcacctttgtgaaaaatgagttcactgtagttgtgtggatttgtttctgggttattctgtcccattggtctatgtgtctgcttttatgtcagtaccaggctgttttggttactatagctctatggtataatctgaagtcaggtaatgtgattcctccaagtttgtccttttagcttaggatagttttggctgttctgggtctttagtgggtccatataaattgtaggattattttttctatttctgtgaagaatgtaattggtattttgatagggattgccttgtaactgtagattgctttgggcagtatggacattttaacaatactgatttgtccaatccatgaacatggaatatttgttcatgttttggggtcctcttcaatttccttcatcagtgttttatagttttcattatagatatctttcacttctttggttaatttctaggtatttaattttatgtgtggctgttgtaaatgagattactttttaaatttctttttcaaattgtttgctgttggcatatagaaatgctactgatttttgtacattgattttgtatcctgcaactttactaaatttatcagttctaataattttcttgtggtctctaggtttttccgaatataagattatatcatcagcaaacaaggataatttgacttcttccttttcaaggatgccctttgtatctttttcttcttggattgttctagctaggacttccagtactatgttgaatagcagtggtgaaagtgggcatccttttgttccaaatcttagaggaaaggctttcagtttttccccattcagtatgatactagctgttggtctgtcatatatggcttttattatgttgaagtatgttccatctatatctagctttttgagggcttttatcatgaagggatgttgaattttttttgagggcttttatcatgaagggatgttgaaatgccctttcaacatgaattgaaatgatcatatggttt

SEQ ID NO: 12771 - DNA, 7765 bp, Human
aacctagagtttcttttaattccttttctgggaaaacttgacctgaatggacatttgtgtctttatttgtttcactgcagaaatattcatgtgtgtcattataaggtgttgtctctgacccctttgggaatgttattgcatatacacaatacaaaatcccccaaatctgaaactgtcggagtctcaacacaatcctggccacaatggtttcagatataggattgtggagttggatgtgtctcaaaatgctaaccatgggcatcactggatgattaaattgtaggttatttattttctctttaatgttttccatttcccaagttttctatactatagactactgttataacaggggaaaaaaatgtcacatttaaaaaataacgtcaggtagcagccccttgctcctccctgagcacatccaggccactaggctatccctctgctcagcctctcgtgtgtgaaaagctcctggccagaccatgttgcaggcatctgccctgtcctcactcctcccggaccacacctcactccgcatttgcagctccatttcttgggcatggcacccatttattcatcttttctctgccccatggaattcttgcactgagctggatcaaagcccagcacacttccagtcctcttcccaagcagcatttctgaagcagcacgcttcccgtcttcccctggcccatgtcatcaaaggacagagatagcaagttctattcaggcccagccattcaggggctcctgatttcacccatccccctctgcaatctctgaccgcagcatgctgtggcccctcctgcacccccctaaacctgctcagctctctgcagcctctcccggacagcctcaccagcatagaataccttccccagagtaaaccaccaggcacagcataccccagagtgtttctaaccatgatccttctttgctttgctcaaagccacacgtgatggaaatggacagagtctaagtgtggacatactgctcttaacgcagtccctggggccctttcctgggccacagcttatcagcctccaaaggccaggggatcatcttcttggcatgtaccactctcagaacaacccacctactcccctgtctaccagattgcgtggttctccctgctgatgagtgtgggccaggtggctgccaggttggtgtgagctaagaccaccccacaacagaccagtgacacagctgggatgcagggatgtggggagctccccacaggctgcagtgtgttgtggagctccgacagagcaggctgggggaacccagggcttcctcccccagctccagctcaatcaggcctgggctggagagggggcatccagaatgcagccaccaagccagcctggggcacagcatcctcttaacccctataactatcttctgaatgggaggctccaagagctgcagtgacttgttccaggtgacatttgcagggaatcggtgagggagttgagatcccagcctgtgtctagtttgactcatcaccgcactaaattgcacgggagccatattcactcgtgatctctaatgctcagcagtgcatcccaccaacagagcagggaggcttgctggcaggttccgattctgcaaggagcaggcctcttctgagccctgatgtggtccccacactctccccatctccccagcccccacggttcactgtgatcttgtgctgtcctttctatatttggaggactacttggtcttgtttcctggattcttcactcctgtggcccaggagatggagcatatgtcaccctgcctggagattcttctgaagagccctggcaaggaaatgagaaagtatcctaattagggggcaataaccccctggagaagcacagattctttacagtaggccgtgtccttcccgcatgccctgtgtgtttgtcagatgtttatagagccttcattaacggaaggctccctcagataagacgtcggagcgcggcatcgaggaccagataagcacaagtggaggacaatccagcccggcagcgggtgagagtgggtgctggccaggacggttccttcagagcaaacagcagggagatgccggcccgctccttcccagctcctccccgtgcccgctaacacagcacggccgcctgcagtctcctctctgggtgattgcgcgggcctaagatgtgtcctggggcactgtgggtggccctgcccctgctgtccctgctggctggctccctacaggggaagccactgcagagctggggacgagggtctgctgggggaaacgcccacagcccactgggggtgcctggaggtgggctgcctgagcacaccttcaacctgaagatgtttctggagaacgtgaaggtggatttcctgcgcagccttaacctgagtggggtcccttcgcaggacaaaaccagggtggagccgccgcagtacatgattgacctgtacaacaggtacacgtccgataagtcgactacgccagcgtccaacattgtgcggagcttcagcatggaaggtagggtctccgcttgcaccatgcgcgctggggtgggactcacaggtccacagctgctttccccagggtggaggccactggccataggaggctcttcaagcttccatttaaattagttacaatgaaataaaattaaaacttatttctttagcctcaccagcttcctttcaaatgcgtggctaatggcttccctatcaggcagtgcagactgaagaacatttccatggttactgagagttctactcagcacttctgttgtgaaggattcaccttccccaagctgtgtgccacatttcacacagcaggtgcacagggatgccagctctcttttttccaccccttctctttactctcctcttctttgcatctctcccctctgattcacttctcttcctttcccccttcccttcctgtccccttcctacttcagaacagaacaggcaacctatttcacctccaactaactgggatatttttaaattttcaaagcacatctattcctttcttatgaaacggttttaaaaatcagataaaattcttggacagagaagtgttggcagagaacctaattgtttttaaatagaaatatatctgatttagaaggactagaagataacaaacacggacctaggacctatgtcctaactcagacaagctcacatgatgcaggggaaataagtttctgaagagcgaaactgttcagtcaaagcttgcagccaccaagggtacccacccatgtcacctaggaagtgttaagcctgcacacctaggaagtgttaaacctgtctgcctgcagagctggcttttcctgctgctgctgtctccctctgaatgtccaggagcacagagcctctcccttcctgggtctgagacttgcaaatggctaaggggcctggctccataccacgcccaggccagacctaactggtctgcagaggcaggactggcacttcaaaacctgccagctaggtttccctatagcacagggtctccacacatgtgggtatatagcaagtgctgaaaaaatgcaacctcttttccctgtctgtgaaccagccattgtatagcaggagcgtgctaatgacaaagtgtcagcccaggataaatgggatatcgagataactatgtggctaaaagccaagccccatttttgcttgacatgacaaagcaattgaagctaatagattttgttcctgaaacactaaaaccaattatccacttttgctttgtttggaaattacaatttcaaacgatttatacactgtttagaggctgagatttttgatattgtcttaatattggggtttcactgtccccacccaggatctctcctttaaattcatacactcaggatcttcactcaggatctgacagtgagtttttctgttttctttatgtactcaatagctgtgtgctagtaagtcccagaatacttaactagctgtatgcattttggcaattaactgccttgaatcccagtctccacatctgcaaatgtggaataataattagatcctcccagggtaagtgagaggattaaggtgaaatgtattctgcaaagctcccagtgtaatgcctggcacatagtagatgctcgataaacagtaggaactctcaatcccaattggaggcatctcctttggaagatcttaagtgtacctttcaaaatactcttatactttaagggcttgggtgaaaccaaatagagataatacagaccaaaattgttatcccagatgctcttctgtctaaaccctgagactcagcttcagtgtcacggaaacagaccctccagcagatgcccaccacgtgtgtttgcatttcagatgccatctccataactgccacagaggacttccccttccagaagcacatcttgctcttcaacatctccattcctaggcatgagcagatcaccagagctgagctccgactctatgtctcctgtcaaaatcacgtggacccctctcatgacctgaaaggaagcgtggtcatttatgatgttctggatggaacagatgcctgggatagtgctacagagaccaagaccttcctggtgtcccaggacattcaggatgagggctgggagaccttggaagtgtccagcgccgtgaagcgctgggtccggtccgactccaccaagagcaaaaataagctggaagtgactgtggagagccacaggaagggctgcgacacgctggacatcagtgtccccccaggttccagaaacctgcccttctttgttgtcttctccaatgaccacagcagtgggaccaaggagaccaggctggagctgagggagatgatcagccatgaacaagagagcgtgctcaagaagctgtccaaggacggctccacagaggcaggtgagagcagtcacgaggaggacacggatggccacgtggctgcggggtcgactttagccaggcggaaaaggagcgccggggctggcagccactgtcaaaagacctccctgcgggtaaacttcgaggacatcggctgggacagctggatcattgcacccaaggagtatgaagcctacgagtgtaagggcggctgcttcttccccttggctgacgatgtgacgccgacgaaacacgctatcgtgcagaccctggtgcatctcaagttccccacaaaggtgggcaaggcctgctgtgtgcccaccaaactgagccccatctccgtcctctacaaggatgacatgggggtgcccaccctcaagtaccattacgagggcatgagcgtggcagagtgtgggtgcaggtagtatctgcctgcggggctggggaggcaggccaaaggggctccacatgagaggtcctgcatgcccctgggcacaacaaggactgattcaatctgcatgccagcctggaggaggaaagggagcctgctctccctccccacaccccacccaaagcatacaccgctgagctcaactgccagggaaggctaaggaaatggggatttgagcacaacaggaaagcctgggagggttgttgggatgcaaggaggtgatgaaaaggagacagggggaaaaataatccatagtcagcagaaaacaacagcagtgagccagaggagcacaggcgggcaggtcactgcagagactgatggaagttagagaggtggaggaggccagctcgctccaaaacccttggggagtagagggaaggagcaggccgcgtgtcacacccatcattgtatgttatttcccacaacccagttggaggggcatggcttccaatttagagacataaaacacaggcagatcaagtagcattgatcaatggcatgattccaactcagatttgtgggacaccaaagcccaggatcttcccaagtgccctgctgcagtttagcaggtcctctccagctaaagagcagtgagacattgggagcccaggagtgttgaggccaggccaggctgaggcccatcagtcacaggtgtgactgggctgcttgtcacacacagggcgtggtctggccactgttgccagtgctcactcagcggccaaatgctttttaatatgacccctgaggcactgaaaaataaccccaggccaactgcaggatagagagagaggtcaggacagcagccctgtgggctgcatgatacactgtggctggagttattgtgaccccctggtgcagtgctcccacggccagtggtgcacacagggccattcactgtccatagactgaaaccatgtgaccatttgagagggccgggcacactttcccctgagggatggggcagcctgtggccagcacctctgcagttactctgcatagccagctcaccagcatgccatgcccagggtgccccccagtgacaacctcatgggagacgggcctggatttgaatttgttggaattaaatgtgctctggctttggtctttgaaacatatctatttttattccttggtgacatgtccttaagtgacaagactccagccttcctgggcgaggcctctccagcctcggaagagctgcagtccttatcggcgatcactggctctgcctgcatttgccggctctcttgagtcacgtgcatcccagcaccccgcctgggctcggactgtgggaccagactcagcctccccgaacacaagggaagataaggcttccatttgctctgtgtttcaccctctcctctgtctctccaggccacacatggaacggggcggtatgaggaagagtctgaaagtggtgaagagtgcacctatggccctctgacctccagccagagcagggcctaggggaggcttagagaggccagggcctctccccgtggttgaagctcccatttatttaagaaaaagtggggggtggggaaaacgttatgttaaatgtttacatggaaccaatgaacaactttaacacacaaatacaacgaaacattcttgtttaattactggcgttatagaaaatatgaattcctgctacatgccgggcagtgtagtgttacaatgctattccaagttgggtgttgagcatcttctttcagtcctggtggtgtgcttctgtgcctgcttgaaaatttcactcggaaataaagtcaaatgtctaatttgcagcccctcctgaatgtgagacccaatctggaggaccctatagactcataccctgcctaccccaccctccagaccccactgggttgggcctccccttcctaaggaggcagaggggaggggcaggcagccatctcaggactgggtggatgcaggtgggtggtgtctgcacactggggtgagtgatgtggtgtgtgcacattggggtgagtgatgtgtttgcacactggggtgagtaatgtgtgtgcacactggagtgagtgatgcagtgtgtgcacactggggtaatatgtgtgcacactgcagtgagtgatgtgtgtgcgcactggggtgagtgatgtgtgtgcacactggggtgagtgatgtgatgtgcacactggtgtgagtgatgtgtgcacacattggggtgagtgacgtgatgtgcacactggagtgatgtgtgtgcacactggagtgagtgatgtgtgtgcacactggggtgagtgatgtgtgcacacattggggtgagtaatgtgtgtgcacactggagtgagtgatgtgtgtgcacactggggtgagtggtgtgtgtgcacactggtgtgagtgatgtgtgcacacattggggtgagtgatgtgaagtgcacactggaatgagtgatgtgtgtgcacactggggtgagtgatgtgtgtgcaccctggggt

SEQ ID NO: 12772 - DNA, 12928 bp, Human
agtgagtgtgaactgagtaaataatatgccttgcatgtgtaggtattaccgcatttacagatgttgtgacagaaacttacttcaaagtattgatgaattcatagtttgcattttctccatcaggggatactaaacctattatgtggggttggaaatctctaatctcccacttgagaagggtgggaaactactgctataggacttactgtccaaatgattgatcttatatataacttgtcctgtgtttgtaccttctcttgacaaatgtcaaaatgtcatttctcatcacaaatgtctagagagggtgtgaccagatgcacactttgaatttcatctacacagtggcttgcacataacagatacttaaaactgttgcttacttgaaggtatagtgtgaagctgctctggccaaagggaaagagtttagacagagattgtccttgcaacacttacaccctggttgggctgggagctgccctgacatggaagaaccatatcttaggggagaaccagccttacttctgcctgcagcaggctgggtgggaccccaaggtctaggaagccaatggatgtcagtggaaatttcccatctcctgcctgccctgcgcccctgcgtaggccccttatcaggttccccctgagtcatcctgacccagagacgaatttagatgctggaaccttcaggtccttccctcccccactccaagtaagacgacttttgacaaagaaaagcctgcaggcaaaagttctcactcgaggctctccctctccccaggttcctctggtgctgatgagatctctcctgtcttgcgcacctttggctgtgacccttattccagcaggcttttccttgtccaggagagtgttaaactggcatccagagggaagaggggactaggagaggagccagggtgcccagcttctgtgccagtttctggggaaaaagttataaagggagtgggagaaaggaacagaagaaaagttgggtgctccaaattgggggatgtagggggagctccttagatttggggttgttgaaggctgggttttagcccgaccagttttcctactgtgggtcacctcctccctcttggcctctccttctttccagtagaccctgccaagtggggatgaaaggggcattgatgttccttggatgggaggggtattgcgggtggtgagggtggtggtgggagggtggttcccaggcaggagggggcagggaaacttgggggtcttgggggggcagtcggtgctggtgttgcagttggcagctcaagttccattggccattgttcctgactggcctggcgcccagcccccgaaatggcaactcaggaaccagtctgaagggggttggggtggatatgatcctgggattgggggagctacaaggggggcaggtggggagaaattcagtcaggtttccttttgcctaaacaacttcgaattcccttaagccacatttttaatcaactaactcattccagggagccttcctccgaggggcacaaggagagctcattccagggtgtgtgtgtgtgtgtgcgtgtgcgtgtgtgtgtaaagtctacagtggcaaacccactcgggcaccgagagggacgcggcagaccctgagaccatcccccgggcattgcgattcagcgggcctgagctggtctcctattctgggccggactgggaggggttagcggcgaagccacagggtctcttgggtcccagcccaggacactgcgtcctccccaagcccctactccacccccgcagggttaactccgcccctgcgcctgtttacccaggagtcagagcctctgggggtccccggcccctcccccgcgccccttgaggcattgaccccagagtccctgttggccatcctctccccaccccccgcctgcccgcgatcgccctctatttatagcggccccccgcattccccgcccccacctccccgccttgttgtccaacttctcccggagcagccggagagcaggcgtcgggacgcagcaaagagaggagaggtaccaggactctgggcacgagggagtcggaactcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccgggttcgtctccccactaccggttcccaccactgagtctgggggcgaaggaaggagccagagtgcaattgcagatccaggtcgtggatggggcggtgctgagggcagccgagggatccctctcagggctgagggatccccgcactccccacaccgccccaatgcggggagggggtggtggaatgttttggtgagccgagcagagcctggaagcgtccagccgcccgcccctcgccccccggccccagcacaaccctttcctgagcggcagtctgggcggggtgaaagggggggcgtgtttactgggggtctggggcgggtctgcggggagcctagcgcccgtgggcgggctggggcgggccgggggcgggtctgcgggaagcccgagccggggcgggcccgagtcaaaggcaagtgaaggtggaagcggccgcggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtgtttgtttttaaattgtggagggaaacagccatgctctgctaccctcctcttactggagagctgtcaaaaattttggggatcccctattcccccgcgtttagtccccctgcagatagaaaattgaggccaaatgtagtaactaactggggcaaggtcacactgggagtggcagagccgggattcgaatccggaggttctgacagggccaccctcttacctccacatcagcacttccttctctcctccgcgcagcctgaactgatgcccttgtagcctatattgattccggctcgagcctagagaggacgtgttctctggacttaggggtagacagacactggggagggttagtgacccgaggaggttgatgaccctgggagtctgggtcttggctgaggctttccgtccctaaaagaccccaggtctgtctcccatgtcattcacctcgttgctgtgttttctcagaccccagagtcagaaggagtgagaaccctgacccctaatcccactgcatccagccaataggagcccagtaagtgaccccaccccgcaggctgcaggctccttcctgtgcaggtctgtccaggtgctctgctcctcacccactaatgttgaacttgcggagtttattcagagttgggaggaagggtcttgggaggaagggaggcattgggttggttggacagatgtcccttttatgttgttttccccacctcccccattggtcatgttgctttggtcatttttagccccctttgagctgccgactttggggctttaattgaaggtcatggtcaattgtgaactctcacagtcccgtcttttggtaccctgtcctttagaatactcagtcactgagctacaagtttcactccctacctgagagtgtggggtggcccctaaatatagcccgagaaatctgagctacacttctgccccaccctggtattttggtccagggcagaggagggagggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggttattagagaccgtttgactcccatgcccaaattccagacctctaagcatcccccttgccttctaacttcccaagcgtactgatcttattctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcctcctggaccagggacaggtaacagtgtgggggcagtcccaaggtgggaggaggggctgtcctcttccccagtagaaggatggcctctgcttggccctctcttctctctttgctttctttccttctattctagtcctttcccttccctatctctcccctctccttccttcccctcctcttctctctctaatcttcattattctttcttatcctcaaactcatcttccggtatcatgttttcctcaattcttgctgatcctgtttttaattctttgttcccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtgggactcaactgtaaggaccttcattcatctcccactcctgtctgggaagaggctgtgggggaagggtagaaatgaaacccagagggaggggaggggtcagtgtgggaaggagaagttctctcctggtctgactgtggcatgaaaggaagggtgagttctgactgggggacacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttggggtaagagttaggtcgttactgcttcaccagactgtgaggaacaggacaggtgcgggaaaggttcgactggggaggaggaaagggagggcagtggtgattctgggagagaatgagtaggacatcctgaggtggggggtgtgagggcaggttggtatcttccttaacatgcctctcttttccagatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgccttgattattgagaaaaggtggtgggtttggaaaattggccagagtcaacagaatagccctaatgggtggagggaaggaaaagggtctatgcttggccctgcctcaggctaaggagggccttctctgatcagaaagtcagggaggaatgaaagggggtgacataatccctgaggaaccagatagacctgtctctttctctcccactcccctctccttcatgcccacacctggtggatggggagctctgcgggtgagagagagttggggaaggaagagaacaccagaccaagtgtctttggtattcagagggaggtgctggcccctgggtgctgttcttagctaagcttctcctaggcaccagggctcagcagctctggttcaccactttgccactcttttcctcattctctccattgttcactaaaattgtgtctgttttcacatttgctttaagttccattcttcccgttcctctagaggaaccaggaactaaagcagaacaagttgaactggctcttgaaaattgagaatggacaaagagctatctatatgggaaaacagtgtgttggttggctggtggatgggtgtttgtttttaagacactagctctccagcagaaagctggggatagacttcaggtatctaccctgactacccgtgccaacctttggcttcttgggcccttctttttcgcgtcctccaaagaaaggtccgtgtctgcctttctttgtgcccgtggactcaggagggagggtgaagagtttgaagagatgggctgtggcaggttttggacagcagatcccatgaggcgtatatttctttccctttcacagtttctctacaataattggagttggtgttggagctggagcctacatcctggcgagatatgctgtaagaaataaaaagcccagaggagggaaaggagggtccagactgattaggagaatactgtttattagtgctgtttgggggaggaagtgggcactaggtggggagtcaggccctgtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttcttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggtaagtgggtgtaggagatgtagaagagtcgaggggagcagcagggaacttgaatgcttgggctaacttccttagctgggacaggatttggggaaggaagaaggcttacctcttttcctccagtaattgttgttttctctttccatccctaatttttctccttgttctctccttcaggaagagctctctggaaattctgagttgatacaaaagtacagaaatatcattacacatgcacccaacctggataacattgaattgtactggaacagctacaacaagtgggtgggctgtgtgtgtatgcatgtgagagaaatgcagaagcagtaattgggcgtcatgggggaggcacagaggaggagagggaagtctgggtagtgtgcaatgtgcaaggaatgcagcatttagtgtgcaatgggggcagcttcaggacagagtcagtgggaaggattgcaaggggctgtcccccttctcttgtttacctcctttggattattggactcccagaagtaagatgatcttgtgtcctgtgtccttcctccccttttgttgccctctgaccagggatctagggcacaagtgactataggggctgtgcttggggcctgcctgcccctttctcctttggtttccacctttaataaccaagatttgaccgtaatttttagacaaagatagttccatcatgggagagatagcttatatctggttagatagcattgcccacctaaaattcctactcttttaacccctttctagccgccgagacctgaactttgagcgtggaggtgatatcaccctcaggtaagactttaagagataatgcattgcctgtctccctggatcttccctaggagcttgtgtcccttagaagaaggagaatcttttgccagggaacttccttgtcatgtcccaccccatcctatttggtaaatcacttccctctaggtcttccccctttgaatcctcttggtggcatcagcagggagacacagaagtgtctttcctctttggagccagatatttttccagctgcactcctaggcagaggccagtgagggagtgccaggggctcactgccttctccccaacactgtgtctttaggtgtcctgtgatgctggtggtaggagaccaagcacctcatgaagatgcagtggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccaggtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcaggtgagtgccgctgccgtccatgggatggggaagggacataggataccggtggcactgggctctgccctttgccacacacccggccccacagtgccgcagcctcaggctccagctcttcctctaacctcatctcaccgtctccctcgcctcttcttacttccgcagccaggcaagctgaccgaggccttcaagtacttcctgcaaggcatgggctacagtgagtatggggacaagagcttgctgcactagaggagagataggcactgacggggtggaaccgttttaggtgaatgcctggactcaccgctgtctgcccaatcgagctcgttgatcccctggcttagttataactagtccataatccaaggaccacaccctgagtcgccagccccccttccccacttcctctctgactgcttgtgcatcgtgctgtctccacagtggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttggtgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgttattattctttgtctaggtgtgcctgcatcatgctcctcttcctatcttctccctgtccacgtctcatattctcttctcaaagtgatataaaccctgggagagggcctttgtggcataggcacttcacaaaatatgaccacatagaaactggctcttttccaatacaacggtgttgccttgatattgtagtatttttaagcctgggagagaggaaccatttagatcttaggagacttccttatcaactatgggtaactgagaaaggccacaggatttcagagataccaccaacatcaccacctttaagaaagaattgaagaggctgggcaaggtggctcgcatctgtgatcccaacacacttgagaagctgaggtgggcagaccacttgagctcagaagtttgtgaccagcctggggaacatggtgaaaccccgtctctgcaaaaaatacaaaaattagctgggcttgatggtgcacacctgtagtcccagctactagggaggctgaggtgggaggatcacttgagcccaggaggtggaggttgcagtgagccacggtcacaccactgcactccagcctgggcgacagagtgagactccatctcaaaaaaaaaaaaaaaaaaaattgaagaagactgatgacagaagtgcccaaggatatcttgagacccaccttcctgtaggatcctccctagggggtcacctagattccattttggatgttttagtgcaatcagtagatcagggtgcatgaacttaactgtaaggggtgggctgctcatagttcattctgatctgaagactctttcaggaggggtgcagcaaaaaggaggatttaccttgagaattcctcttccctcatggaatccaagggatctgggagctaattaagtctatgtttgtggtttattaggaagctttttcacaactatgaacaatgaagaggaattcttattttgcagctgttgcaggctgattcttagggtcttgaggcacaagaagtaaaaatgaggaggcaccttgtagcattattgacaacactactgtgatggactattacaaggtcttttgctagattgctttacagaaactccacaggcaattataccctttcctcaatgaaactgagctgaggactaatgcacttgatgtctggtgctgacacactgattgacatggaaataggatatggaatatgcccttgattcttgagcatttcatcactgtccttcatagaactgggtctattttaaatgtggtaggccagggtcagaaggggaagcggaggtattgggtaacaaacagggttatggagctcgctattggatgctgagggtgttgggtgaccacacgcagggcaggcagcagagtgcgaagcaccacactgaagaaaagaagcggcataattggaatcagtggggaccaactagcttctcggaaaaacacaaggaaaaggcaaaaacctataaccagcatcaatctttactggcaatagctgctgttgtgtattatggatgggaaggcaagtcttttctgcatatctgcctacatagataacactgtcagcagggcaatctctacaaatgggagcacattacatgtatgtgtagataggtgagtgtgtgcatacacatctatcatgtaggtgggtgtgtcaaatgggtgatgactgtgtgtctttcccatagatgtctctgcataagaaatctgagtttggtagagagaaagatgccctctgctgggagctagtcgtggggtgggggttttgtccttgactgacctctctactctgttggagagcgacgaaaagctcaagaatcaagagcatattccatgtcccatttccatgtcaatcagctaaacattccagtttagcccatggggtcacagtgcccccttgtggttgacatggttcttaataactttccccagttcccaggtcccttggtgtttcctcggtcttacagctccattgtgctttgtggttctgtgt

SEQ ID NO: 12773 - DNA, 41639 bp, Human
  misc_feature (1)...(41639): n = A,T,C or G
cagagtctcactctgttgcccaggctggagtgcgttggtgcaatctcggctcactgcaacctccacctccagggtgcaaaaaggttctcctgcctcagactccgaagtagctgggattacaggctcccgccaccacactcagctaatttttgtatttttagtagagacgtggtttcgccatgttggccaggctgatctcgaactcctgacctcaggtgatctgcctgccttggcctcccaaagtgctgagattacaggcgtgagccactgcgccccaccagttacattttaaagagaaaaaaaagatgcttattgaaagaacattactaacaactgtcgaaattgtgaaagtgacagcaaatcagtagagtcagtcagttgagccagatagcctctgagtctgtagttctttttttcttttttttttgtcgcccaggctggagtgcagtggcacaatctcggctcactgcaacctccgcctcccgggttcaagcgattctcctgcctcagcctccccattagctcggattacaggcgcctgccaccacgtccagctaatttttatatttttagtagagacagggtttcactgtgttggccaggctggtcttgaactcctgaccttgtgatccacccgcctcggcctcccaaagtgctgggattacaagtgtgagccaccgcgcctggctgagtctatagttctaaacaatcttcaacacataatagaaaatgtgaaagagacagacccaggtccaagaacgatctgaacttctcctggaattcatgatcaaggtggacagctagaagtatgtcaatgccagcaattgtcctcctttggatttagccctctaggattttaatttccttttctcttggatattctcttatctaaggacaagccaggctcacctttcttttattaagttacatatgcatagctggcatatcactttctttgcctttcttggttggattggcattttcccatgcacatatttacatatatttctcacaatatatttatataaaatgaatttcatcacttttttattgtttgttttcctcctgtatttgtgtttgtttttttcttttgagacggagttttgctgttgttgcccaggctggagtgcaatggtgtgatctcgcctcactgcaacctctgcctcccaggttcaagcaattctcgtgcctcagcctccagagtagcagggattacaggtgtgtgccaccacgcccagcggattttgtatttttagtagagacagggtttcaccttgttggccagactggtctcaaactactgacctcaagtgatccacccgcctcccaaagtgctgggagccacagtgccctgccctctggtttcttttataatgaacactttaggaataaaagcaactactcttgctttgcttgtgactttgttttgttttctccctttatgcctctctcctctgagaccttccctttcggtctgttcccggattaacatgcacaatctgatgatgcctgtctttctacagaaagtatttctgtataaatactggtttacaaacctacagaacgcctaggagtgcgaagtaagcacagaagtctatcactgggagggaaagaataatcacaagggttccaatcctaaacgggaagccaaggtaacaagacctagcgtttattgagcacttactatgtgccaggcaaggttctaatgccttacagtacatatttactaacctatttcgtcccaacagtcactctattcagacaggtattgccccagataagagaaacggaacagaagcagcttgtccaagatcacacagcagagctgattccagtgcctgcgctatatactattacatcctcttagtcactgaattcttctgattaatttgggaacatttcctgccacaaacgagtgagtcaagaggtagctaaagcatggcactgattattcaaattgaggtgctcaccatgcttctagaaccatggatatgagatggctttacaggcatgatcactttcagacccgcattttaggaatgaggaaacagattttcgagatgttaatttgcccaaagtcacccagctagcaagcagaagagctggggctgtttgaatccaaagtccacggcactcctaaccgctgctcaacgctgccccacaagaacgtccagctggcaagacccgggtggggctcgttgctctccccgcttcacctccctgcttcacggccgggggtgtgctggctaagttcgctcatctgccaagcttcaggacacagacctatgtgagcaagcgataaacaaatgcaaataaatgtaactttccacattagctaaaaattcagagaacgtcaagcccagggaaatgggacggatcccagttagcccgcggctccaatctggtccccccccaaccccgagcctcgcggcgagaaaggaagcggctccggatggagagtaaagtgacaatcggagaagggcaggctgcctttcctcccgggggagccaaggggacctgcagagggcggtttctctccgcttttcctgtcccaccccgtcggcctgccccccaccccctccggcctctgcgccaaccccgcgcgccacccgcggcttcctccgctcggggtcctcgttcggcctctgctggcctccgcgactccgcggtgcccgcccccgttgagttcaaaaggacgcgcggagcggcgccggcccttcaccagcagcccgtccgactggaaaggtgagcacgagggaagggcgggggcgccggagagccgggtcgcccacattcgccgcagccacctcggccgtggcaggaaccgaaacccggagcggccgaagctcagcgctccgctggggcagagggtcgcggcggctgggaacgccgctccccgacgcaccggccgcccccagcgcagcgcgctccgcggggtgctggtaacgcggggggctcggggcgggggcggggacgggggcggggccgcggggcgaggaccaacccagcccgtcgcgtccaccccgcgttcgcaggggcgtcgaggatctccggggcgcggggcgcgggctggggcccagtgaggcttggcaggctgtgcgcggaccgcgccctggacggcgaaagcaggcccggagggggcggccagtccggcgtcccagcgtccgaggcgagccagaaggcggcccacggccgtcgcctcccggtcccggcccggctactgcgctgcgcccactccgctctggagcctgggcgcgggtcctgaccttcccggccctctcctgacacctggtggatggcgtcaccagaactcctagctgtggaaccctagggtacctgttaccgcgctttggcgaaactgggttcgctgctgatttgcgaacctttgcctgactttctcaggccttgagagatctaagtaaatttggtggcccattgaaaggacctggagagagcgtatgaaggtaacaccccgtcaaactgcatgcggcctcagacctgctcctgtggagagctgttggtacctggagcctgaggagatattcagggaaaccagaagaggacaagagaaaaaggggaagggacttgggagaacctggcaccagaggctttcctgggacttccaggactcaaagccataggggcccacccgctacattcctgtctttgcccctcttcctacagatctgcctcttctccaagaaactcaaccactagtgacaatgaccagcctcctgactactccttctccaagaggtaggtgaaggcctttcctaatcccagtgagaaagaattgttcaacatccccttccccagaccagtcctggaagcctcagcccaggtgggaagactcccacctctctctgcctgcctcacacaggaagggcctgggaggaagcaggaactagagtgtgccccttagtacggttttaatctgaagtcacatggacatggtgacttcacaaatctttgtaacctcggtttatcaaataattttatgtcggtaatcccaggactttgggagactgagacaggaggatctcttgaggctaggtgtttgagacctgcctggggaacatagtgagaccccattgctaattcaaaagaaagaaagaggccgggcgtggtggctcatgcttgtaatgccagcagtttgggaggtcgaggtgggcggatcatctgaggtcaggagtttgagaccagcctggccaacatggtgaaactccatctctactaaaaatacaaaaaaattagccaggcgtggtggtgcacgcctgtaatcccaactactcaggaggctgaggcatgggaatcgcttgaacctgggaagcacaggtgagccgagatcgtgccattgcactccagcctgggcaacaaagtgagaccggtctcaaaaaataggaagggagggagggagggaggagggaggaaaggaaaggaaggaaggaaggaaggaaggaagattattgtataagcctaaaggaagggctttacattcatctgtctaataatttatagctatggcaaagaatgtagcagaaacccttgtaattaaatgtggaaaaggaatcttcaaagataacagggaaatcattttttaaaaacctgctaaagatagtattgctaacctctaagctccggtttcatcattcacaaaatagggaaaatagtacctatcttatgatttatgaagattaaatgagacaacccatataaaacacctagaagagtgtgtagtatctcgtaagcactcagtcacgttggttattagcactgagtacttgttagaaacccatctttcccttgaaagtgattttgctggctttctcattccactcctctggtgatacagacccagcatcaaaaccccattgttccctgaaggtgtgcggaggccgggcactactgctcagcactctgagaatggatgcccaccttttagttcatcatcaggctgggccggacaaactatcagttatttattgactgttttcagcatgtgctagttagggagagagaggaacaaacccttggttggtctatacacctttgtcttcctatacacagtcacatttgtcattaggacaggcattctctgcttttactgatgtggaaacaggtgagtgacaccaccagtggaagtctaagacagtgtcctctgtgactggtaatgcacacaattcagacttttagttgtctggtgagaagagataaaagagagaaatggccaggtatggtggctcacgcctgtaattccagcactctgggaggttgaggcaggcagatctgagctcaggagttcgagatcagcctgggcaacatggcgaaaccccatctctacaaaaaaatttaaaaattagccgggcttggtggtagacacctgtggttccagctactccaaaggcttaggtgggaggatcccttgagcccaggagatggaggttgcaatgagccgagatcatgccactgcactccggcctaggtgacagagcaagaccctgtcttaaaaaaaaaaaaaaagagttagggggacacggagtggggggggggaataggtcagcaaaggcttcatgggtgggtgaggaaggggatctgagtcttgcccttgaaagacggacaaggttcatacaggcaaaggggcgcagcaggtatcttagagaaacgtagaatacctttttcgtgtgtacctgctctagataaaggtagaatacctcataccatgtgtgaagctacagagacgatttaccctggaggatgttcaggaagcgggtgggcagaggacctccagaataatcctgcccacaagggaaaaaaggtgataccttggcagctagctgagggattagaaccttggcaagggggagctgtttacattttttaaattttattattattatttttgagaccaagtcttgctgtgtcacccaggctggagtacagtggcttgatttcggttcactgcaacctccgccccctgggttcaagcaattctcccaccttagtctccctagtagctggaattacaggcgtgcgctaccacgcctggctaatttgtatacttttagtggagacggggtttcgccatgttggccaggctggtctcaaactcctggcctcaagtgatctgcccttctcggcctcccaaagtgctgggattacaggctcatgccattttttcttttttaaaatttatggtaaaataaacatagtacaggtattaccattttagccattttttcgcagacaattcagtggtagagtagtccccgcttatccacaggggattcattccaaaaaccccagtggatgcctgaaatctcagatagtactgaaccccatctatactgtgttttttcctgtacatacatacttatgataaagcttaacttgtaaattaggcacagtaagagattaacaataataataaaatagaacaactataacaatatactgtaataagagttatgtgaaaatggtctctctcacttaaaatgtcttatttactatagatcttagaaacctcagtacacagttctttttttttttttcttaagtcaagaactttcaccttttcacttaaaggaagcacttcttgttggcatgtccaaattgcatcactattcttgtgctttggggccactgtcatgtaaaataagggttacttgaacacaagcgctgtggtactctactaagcgtttatagcatggacacaaaaggatgattcactttccaggcaggatggagcagggtgtgagatttcatcacgctactcagaacggtacataatttaaaatgtatgaattgttcctttctggaattttctttttctgttaaatttctatttaatgttttcggactgcagttgaccacgggtaactgaaacctaggaaagcaaaaccgcagataagaggggactactgttgttttttttttttgagacggagtctcgctctgtcacccaggctggagtgcagtagcgccatctcagctcactgcaagctccgcctcatgggttcacgccattctcctgtcttagcttcccgagtagctgggactacaggcgcccaccaccacgcccggctaattttttgtatttttagtagagacggggtttcaccgtgttagccaggatggtcttgatctcctgacctcgtgatccgcccacctcggcctcccaaagtgctgggattacaggccagtgcctggcctggggggactactgtattaagtaattcatgttcctcaccaccatccatctccagaactttaccttcccaaaccgaaacttgacacccattaaacactgattccccatttccctgcaaacaccgttctattttctgtctatgtaaatttgactgctctaggtacttcatgtaagtagaatcatacaatagaccttttgtgtctggctaacttcacttagcataatattctcaaagttcatccatattgtagcatgtcacaatttcctactttttcaaggctgaataatattgttgtatgtgtatattacattttgtttatccattcatctatgatggacagttgagttgcttccaccttttggctattgtgactgatgctgccataaacatgggtgtacaaatatcttcttgagaccctgctttcagttgtttgggatgtatgctcagaagtggaattgctatatcatgtggtaattctgtgtttgatttttttgaggatccaccatataggtttgcacagcagctgcaccattttatattcctaccagcaatgcataaaggtttcagtttctctacaaccttgccaacacttgttactttctgtttaatggtagtcatcatattgtgtgtgaagtggtatctcattgtggttttgatttgcatttccctagtgatagtgatgtggagcatcttttcatgtacttattgaccatttgtatatctttggagaaatgtctattcaagtcttgtcccattttttagttgatttgttttgttcttgttcagttgtatatttatatcctttaaaaattttttttaaaaaattgatcgttgaatcagtcctctctctctctctctttttttttttttttttctggcgatggagtcttgctctgtcacccaggctggattgcagtggcaccatctcggctcactgcaacctccacctcccgggttcaagcaattctcctgcctcaacctcctgagtagctgggattacaggcacacgctgccacacccggctaattttttgtattttagtagagacggggtttcaccatgttgcccaggctggtctcaaactcctgagctcaggcaatccgcctgccttggcctcccaaagtactaggattacaggcatgagccactgtgcctgaccttttttttttttttttttttttaagagatgggatcttactctgttgcccaggctggagtgcagtggcacaatcctggctcactacagacccaaacatctgggcttgagggatcctcccacctcagactcctgagcagctgggactgcaggcgtgcaccatcacgcccagctaattttaaaattttttgtagagatagggttttgctatgttgctcaggcaactctcccggcctgaagccatgctccttcctctgcccctgagttgttgagattataggcgcaagccacctcacctggctgcattcttgatccagcgagtgacatgagtgaagtagtgatttaggacagtctcctatccactgggtccaagcaagtgtaagttcagagacagcaatagacaaaagaatagaaatcacagataggaagaaagcttatactttaaatgatgggatcactaaaggccagctcttctcttctacccctgtcttgcatttctcttcccccaccttcccacctattcctccctcacagtctataaagacttcctagagaagatatcctccaggaaccttgaaaggaagggccacattatgactcctgagccctgggcacttctgtctttgtgggctcctccttcacttaaaaaaataataaaaatcatattttacaactgcatcagtgtaaggaagaatataatataatataattaatatttataattagtaattgaatggcataacaaccttaatatttctttgacctaaaattttgtttcttttccttcttctaattataaaagaaatgaaaattatttaaaacattttcatgggcctttcgaagcattgtgggcccagggcactgtgcctgttgtgcctagtgcataagtcagccctattcgaagtagggcagagtggaactgtgccttgtgggctttgcccaccgtgccaggtaaagctcatctcttgccaccaaatgatcacaccagctaccgcctaggttgtcctcaccctgtattagacacttagcatttttctttattttattttaaaaataattttttgtagaaataaggtcttactgtgttgcccagtctggtctcaaactcctggcctcaggtgatcctcccatctcagcctcccaaagcagcatttttcattgcacttattcctcaccacaacccaatgaaacaagttttagtctcattttacggaaggaaaaactgaagttcaggggagttaaggaattttcttttctttttttttttttgagatggaatttcccacttgtcacccaggctggagtgtagtggtgcaatctcggctaactgcaacctctgcctcccgggttcaagcaattttcctgcctcagcctcccgagtagctgggactataggcgcccaccactatgcccagctaatttttgtatttttagtagagacagggtttcaccatgttggccagactggtctcgaacttctgatctcaagtgattcactcaccccgacctcccaaagtgccgggattacaggcatgagtcaccgttaaattttcaaagattaaaaaaatttcccaaggtcacacagctagtaatggcagaggcaggattttgcgccaagtctgatttactgcaagcctgtgttctttctgtcatggtgtactgctcccaaggtctcactccacccaactggctggtgcacatgaaagagaaggcagaagaaagggggccgagtcccagggtggcttcccatggaaagaactcggggagccgccctctgctgggcaggtctagagcaaataagtaggctggcagacttaggtggcaaaagatctgatgcctcagtgataagagatttagctcaagctgggaacaaggaccacaaagaagccagccagtatctgggttaacaaaaaaaagagtaagtgaacagaatagatcttgaaggtcatttgctattggttaggacttgggtggggccttcaatcttatgaacctgagcagggaaggtttggaaagactgtagtgctatttaataattattcctttgtttggacaaaaaaatggggtagaaacgggagagaatgggggaaaagctataagccatttcctccttttatgccagctttcctgaacttagtttattttgttgttgtttgtcctttttttctttttttgagacagggcctcagtttcacccaggctgtagagcagtggctcaatcacagctcactgcagcctcaaccttcccagactcaggtgatcctcccacctcagcctcccaagtagctgggatcacaggtgcgtgccaccatgcccagttaatttttgtattttttgtagagacagggttttgccatgttgcccaggttggtcttgaactcctggactcaagtgatcctctggcctcagcctcccaaattgctgggattataggtgtaagccaccttgccaagcatgttcttttatttgaaaggtaatacatgcccctcagagaacagctttctagaccttttctatgtacaaacatatatatgcatatttatagggttttttaaagttacttaaaaaaaaatacacagagagacaggggtctcgctatgttgcccaggctggactcaaacttctggcctcaagcaatcctcccacctcagcctccaaaagtgctgggattatgggtgtaagccactgcactctgccaatttacttttttttttttttttaaacaaagatgcagtcctactacatataccacctggcagtttgcttttttcatctaaccatgtatcctgtcccagtaatattgtagatctcatattcgttttagcaactgtttccacaatggatggcctgtaatttatttcatcattcctctccagatagacattctaagtatgtctggattttttattttaaaatttgattttaatgagaattctaatagaacactttccatttataaaaattcaaaaattaaggctgagaggggttctgatgctcagctagttcaactaaccattctgtcctagaattctctctccaagatgctacgtagcttttgtccagttttgctcttccttctgttggggagacatctgtctttcccagtttctgctgttagttctcttgtacaggtcatgccttggcatattagaagacagaattcaagctctaggctcccttttttttctctgggctttctcttgcaagctttccttatctgacatggtttgcctgctcacttcaaaattgtgacacccaggccgggtgtggtggctcatgcctgtaatcccagcactttgggaggccgaggtgggcaaatcacaaggtcaagagttcgagaccagcctggccaacatggtgaaaccctgtgtttactaaaaatacaaaaaattagctgggcatagtggcgggtgcctgtaatcccagctacttgggaggctgaggcaggagaatcgcttgaacctgggaggcggaggttgcagtgagccaagattgagccactgcactccagcccaggtgacagagtgagactccgtctcagaaaaaaaaaaaaaaaaaaattaaggctgggcacggtggctcacacctgtaattctagcactttgggaggccaaggtaggtgtatcacgagatcaggagttcgagaccagcctgaccaacatggtgaaaccccctctctactaaaaatactgtaatcccagcactttgggaggctgaggcgggtggatcacgaagtcaggagatcgagaccatcctggctaacatggtgaaaccccgtctctactaaaaatacaaaaaaatcagctgggcgtggtggtgggcgcctgtagtcccagctactcgggaggctgaggcaggagaatcgcttgaacccaggaggcagaggttgcagtgagccgagatcacgccgctgcactccagcctgggccagagaatgagactccgtctcaaaaaaaaaaaaaaaaaaaaaaaattggccgggcgcggtggctcacgcctgtaatcccagcattttgggaggccaagacgggtggatcacgaggtcaggagattgagaccatcctggctaacacggtgaaaccctgtctctactaaaaaaatacaaaaaattagccgggcgtggtggcgggcacctgtagtcccaactactcaggaggctgaggcaggagaatggcgtgaacctgggaggcggagcttgcagtgagccgagattctgccactgcactccagcctgggtgacagagcgagactccgtctcaaaaaacaacaacaacaacaacaacaaaaaaaacaatcagccggctgtgctggtgcacacctgtaactcccagctacttgggaggttaaggcaggagaatcgcttgaacccgggaggcggaggttgcagcgagccaagatctgtcgtgagcagagatcctgtctcaaaaaaaaaaaaaaaaaaaaaaagaaaccatgacacccagatgaactcagcagtctaggcgtggtacaaagtagagcagtactgtggcctccattattagaccatatttatattgctggtgcctaaaataacagcaatctttaattttttatgattataaaagtaattctttatcattgtgagaaattcggaatataaaggaaagcatataaaacaacataaaattcaggcacacacctgtaatccaagcactttgggaggccaaggtggcaggataccttaaggccaggagttcaagaccagcgtgggcaacatagcaagactccctctctacaaaaaactttaaaaattagccaggcatggtggcacacacctgtaatcccagctactcaggaggctgaggtgggaggattgcctgagcccaggagttcaaggttacagtgatctatgattgcatcactgcattccagcctgggtgacagaacaagaccctgtctctaagaaaaaaagaagaaaattaaaatcattgggaattccacaacctatctgtaactcctgctgctgttttggagtatatccttccagtgtcagtggtttttttagggacccccccataagtactttatatatgatgttgctaagccatagcttccccattctttgtgagtagttggcttcctgaacctaagagcaaggaatgtgttaaattctcatcttgttcagtttggtgcatttcttcagtcatttgaaatgtgtctgtgtttatcagtttactagttgcccctctagctttgaagcctttaacaaatttgtcagggctgggcgcagtggctcacacctgtaatcccagcactttgtgttgttcaggcaggaggatcgcttgagcccaggagttcaaaactagcctaggcaacacagtaagactccatctgtacaaaaaattttaaaattgtcgaatcttccctgggtctgcaggatctgcatttaccccaagggcattcagctcagcctttgtagaaggcaccaataaagcataagaccaaaaatatgtatgtatatatcttgcaaagaatttgaagttcaatatatattttttgagacagggtcttactctgtcagccaggctggcatgcagtggcgcaaacatggctcaccgcagcctcaacttctcagactgaagtgatcctctagaatcctcctcagggttcaactatcagggttttttttttttttttttttttttttggtagagacagggtctccccatgttgcccaggctggctttgaactcctgggctcaagcagtcctcctgcctcagcctcccaaattgttgggattacaggcatgagccactgcacccagccttggactttcttatacttgctttatgatttaatatttttatttcaaattacataaaggccttattttggcccttgcatgatttgacataactatcaattcaaaaaggactaaggttaaaccacagtgaaagagtctctgtctagactggcatcacttcatcccttaacaacccattactgcctcacttaggccttatagccaggctgtatttctctgccttgtccacaaggatattataaataatcttttcttttcttccttttttttttttgagatggagtctcactcttgttgcccaggctggagtgcaatggcacgatctcagatcactgcaacctgtgcctcccaggttcaagcgattctcctgcctcagcctcccagtagtagctgggattataggtgcccaccaccatgcccagctaatttttatttttagtagagatggggtttcaccatgttggccaggctggtcttgaactcccaacctccatcaccttaggtgatccacctgccctcagcctcccaaaatgctgggattacaggcatgcaccactgtgcccggcctgtaaataatgttgttgtatgttttctgatgctatttactcttgcagcaccttcagttctccttaagcccctcctaccctcactctcaactgattatcttacatcctattttgtaattattaattaatttattttttgagagacagggtctgttacctaggctggagtgctatggcacaatcatagctcactgcagccttgaactcctgggctcaaggaatcctcccacctcagccttccaaattgctggacttacaggtgtgtgccaccatgcctggctattgcttttatttttatttttattttttttgtagagatggaggtctcactatgttgctctcagcctgatctcaaactcctgacctcaagcgatcctcccacattggactctcaaagtgctgggattataggtgcaaaccactgggcccagttaagatcttactttagaatgggtaggctgggcacagtggctcacacctgtaatcccagcactttgagaggccaagacaggcagatcacctgaggtcaggagttcgagaccagcctggccaacagggtgaaaccccatctctactaaaaatgcaaaaattagccaagtgtagtggtgggtacctgtaatcccaggtactcgggagactaaggcacaaaagaattcctttaatacccttgggaggaaggagggttacaagtgcccccaaaggtgggccccccttgccatttccaaagcctgggggtgacacagaacgcaaaagacttgttcctcaaaaaaaaaaaaaaaagatatgtgtattcccaagaaggtgttccctccatatatattgtttgggcaacacagagcgcctttgttccttttgagaaatctcctcttgggccccccgtgggccccccacaaacaccaatattttcttccccaccaatttcggggccctttttacaagaaggttgcttggggtatttaatgagggcaccaaaggcccacttggggccccagttaaaagaatccttattttttcttgaggcaaaattaaaagtttatcagaaagaaaacttgccaaaggtctcgcacccttcaccatcaaccttgccacctgcattagtgcccatatactctgcttttcctcctattccaatggcactgtctttgctgctgtctgcagcaagccccccagcccctctgtgctctagatctcatcccttcaaggaatattgtgcatcatcaattgtgcctctcatctgggtcattctcatctgtatgcaaacatgctggcatttctcccatcagaaaaacaaacaaatttgaattccctttcccctccagtcacagcctttctctactcacctttacagagaaattttgtgtaagcatttatttatattctgccttcagttcctctccttccatttcttccttgaacccaccctaaattacgggtttgtatccagcacttcaccaaaacttctcttgtaaaggtcgtttatgatctctgcatggcaaaagctgtttggctgctactccccagtctccttgggctcagtcttgggttctctttatctgcacttactcctgggtgatctcacccagtctatggtcttaaatatctaatgacttttcaacctctagtaccatatataagaatatatatatatatatctttttttgggtgggggggaggttttgtttgtttgtgttttttttttgtttgtttgtttgtttgttttgagacggagtttcgctctcattgcccaggctggagtgcaatggcatgatctcagctcgccgcaacctccgcctcctgggttcaagcgattctcctgcctcagcctcccaagtagctgggattacaggcatgcgccaccaccccggctaattttgtatttttagtagagatggggtttctccatgttggtcaggcaggtcttgaactgctgacctcaggtgatccgcctgcctctgcctcccaaattgctgggattactggcgtgagccaccgcgcccggcttgtttgtgtttttttaaatagagctgaggtcccactatgttgcccaggctgctcttgaactcctgaggtcaagtgatcctctggcctcagcctcccaaagtgctaagattacaggcgtgagccaccgcacctggcctccaaattctaatcttcatatctgaactttgatatctagtaagcaatcatgtttcttccaaatttgttccccctgcaggcttacccctctcacataactccatgccttcacccttgactccaccccacatccaatcctgtccgtctttgcttcagattatattcagaatctcaccactttctcactgagctgctgcaaaagcaatcaatgctgtcgtggaaattagaaaaaggggttgggcacggtagctcacacctgtaatgccagcactttgggaggccaaggtgggcagatcacttgaggttaggagttcaagaccagcctggccaacatggtgaaaccccgtctctactaaaaatacaaaattagccaggcatggtggtgcatgcctgtaatcccagctacttgggagtctgaggcaggaaaattgcgtgaacccgggaggcggaggctgcaataagctgagatcacaccactgtattccagcctggacaacagagcaagaccctgtctcaaaaaaaagaaagaaaaagaaaaaggcacaccttttggcagatgcaactgtgcacttgtgcagggtacaccctgcttctgcacgtgtgccaccttcccacagcctattgtccacactgtagtcagagggatcctttcaaatcaatccctgtttcaatcatgtattgctgctggaaggtctgctagactagaagggccaaaatggtctccctcacatgtctggcagtcagctgagcctggggtgcttggttttcctccatatggcctctcatcctctagcaggcaggattggggttcctctcaacatggtggtctcagggtttcacaagtgtggtctttggaaatcaggccccacctcagatctcctgaatcagaatctgcattttaacgagatctgtaggagattgttatgcacaagaaagtttgagaagcattgctttaaaacacaaacctaggccaggcacagtggcacatgcctgtaatcccaacactttgggaggccaaggagggagaaccatttgagcccaggagttttgagacgagcctgggcaacatagcaagaccccgtctctccaaaaaataacaaaattagccaggcgtgttggtgcacgcttgtattcccagctactccagaggctgaggcaggaggatcgcttgagcctgggaggtggaggctgcagtgagccatgatcataccatggcactccagcctggaggacagactgaggccctgtctcaaaaataagtaagtgaataaataataaaaaaaatctgatcagtctctgcccaaaaacctgtaaaagcttcccacctcactccctgaaaaagcccttaccttggcctacaaggcctgtgttgtacaggcctccttgactttctctgctcctcctctccccgttactcccactcaggggcctccatactgtgcatttaacaggccaagcatgcctggccccggggtgtttttcagtgctgtggacagccctcccatgaacttgctgtcccctctgcctggaatgttcctcaatcagctctttgcatgactgcctcccttaccttctttaggtcttcactcaagtcacctcatcagtaaagcttcccctgacaaccttctctaaaaccacaactccaaccacatcccagctttccatcctcttttctgcttatttttctacatagcgctaattaacgtctaatatagcatatcttttacttatttaattatttatttttacttttttttttagatggagtctctctctgtcacccaggttggagtgcagtggtgcaatctcggctcactgcagcctccgcctcctgggttcaagtgattctcctgcctcagcctcctgagtagctgggactacaggcatacgccaccacacccagctaatttttgtatttttagtagagacggggttttgccatgttggtcaggctggtgccaaactcctgacctcatgatccacccgcctcggcctcccaaagtgctgggattacaggcatgagccaccgcgcccggccttattttatttattgtctgtcttccccctctaaaaatgtaaattatataaacagagggttttttaattgtggtaaaattatacataacataaaattgaccattttaaccattttcaagtgtacagtccagcagtattaagtacattcatgttgttataccttcaccaacaccactatgcatctccagaactttttcatcctcccaaactaaaactctatactcattaaacattaactccccattttccccttctccagccccttacaatctcctgtagtactttctgtcttatgaatttgattgctctaagcacatcatataagtggaatcatacaatgtttgtcctctttttttttgtttgagacagagtctcgctctttcgcctgggctggagtgcagtggcatgatcttggctcactgcaacctctacctcccgggttcaagtgattctcctgccttggcctcccaagtagctgggattacaggcacctgccaccacgtccggctaatttttgtatttttagtagagacggggttttaccacgttggccaggctggaatgtttgtccttttgtgcctggcttatttcacttagtgtcatgtcctcaaggttcatccatgttgtagtatatgtctgaattccttccttttttgttttttgtttttttttagaatttccttcctctttaagggtatgtatataccacattttgtttatccatttatctactgttggacatttgggttatttcaccttttatttagctattgcataatgctcctatgaacatgatatacaagtatcagttgaagtccattcatttcttttgggtatatacctagaagtgggattgcgggatcatacccacccagcaatgagattgctgggtaattctgtttaatcctggcaggaactttaaaggtaagggtttttgcctgtgttgttcactgatagaagcccagagcctggcacagagtacacactcagtaaattcttgttgaactaactgtttaatttccctgtctaggaacctggaatctcagtctaagaaggctgtgcagcttatctgacccagcttgctctcagtagtcccattctgacttctaatgcttgctgtttcgagttcaaagccccccaaacaggccgtaatagtgtgttctagaactttgctggggagtcacatcaagctcaccattgctttatggactccaccttccttccatggccccttcaggttcccgacccctttctctttctcagaagctcctatgtcaccaacagaaatcccatttacaagttcttgcagtgcctttggctgtcatatctggtcccttttagattagtctggtgcttgctgggtttctttgcttctcttgagctcacttcccccatgtccccaaaggctccactgctccttagtgcaaaaaaatgattctctttgataggaaacagaggtgaaaaggcctgagggaattctgctttctctgttacctccaacctgacccctcaggcccaaagaagcctagctttttctttgttcttgttgcaaatataatgctttttaaattgtccttcggggggcgatgtggctcacgcctgtaatcccaacactttgggaggctgaggagggcggatcacctgaggtcaggagtctgagaccagcctggccaacatggcaaaactgtctctactaaaaaatacaaaaattagccgggtgtggtggcacatgcctgtaattccagctacttgggaggctgaggcaggagaattgcttgaacccagggggcggaggttgcagtgagccgagatgaagccactgcactccagcctgggtgacacagtgagacttggcctcaaaaataataataataggccgggcacagtggctcatacctgtaatcccagcactttgggaggccgaggcgggcagatcacgaggtcaggagatcaagaccatcctggctaatatggtgaaaccccgtctctactaaaaaatacaaaaaattagccgggcgtggtgacatgcgcctgtagtcccagctactcgggaggctgaggcaggagaatcgctagaacctgggagacagaggttgcagtgagccaacatcgcgccactgcactccagcctgggtgacagagcgagactctgtctggaaaaaaaaaaaaaaatctgatgtagagtctgccttcttgtcatcgtttaaatattgaggtaaatttctttgcacctttcttcatctgcactttctgcttcaccagatggcttcatataagtggaaactgaccaatagctgcatcgcagcaaggcattctgtagaatttttttcttaaggtcttcctgtatggctaaaatattctctagttgtgagaaagcttgcttctgatcatgttaaacattaaagctaaagagggtggggagtcctctgaacctcttttggttctaggggctgctcaatttaaaaaaattaaagaatagataactgaaaataaactaaaaataaagaagtcacatataaaccaacatgacttctgcattacactgacatcgttcccttaagttacctatcaccagtgagccagttcatgttaaagaagcactttgtagcacaactgtctgtatttaattgtgatcatctggtttcctcccacctttattctttttttttttttttctgaaacagggtctcactctgtcacccaaactagagtacagtggcacaatcacagctcactgcagcctggacctcctgggctccagtgatcctctcacctcaagtttaccgagtagctgggactacaggtgtgtgccaccatgtctggctaacttttttttttttttttttttgtagagatgggagtctggctatgttgcccaggctggtctccaactcctgggctcaagcgatccacctgccttggcctcccaaggtgctggaattacaggcgtgagccactgcacccagcctcctccatatattatttttaaaaaacaaatagagatggtgtcttgctatattgtccagattagtctcaaactcctggcctcaagcaatcctcctgcctccgcctcccaaagtgttgggattacaggcgtgagctaccacactaaacctaatgtacaaagtaagttactgttgatgattgaacacaaattactcatcttcaagcttctgatatacattaatcttctcaatgctttgtacatcctaaattctcaaaatgtttaaagaaagcaaaactaggaacaactgtatagaactctagatccatggtaggaagatggattgcagccctgggcgatttggggaggaaagtgcatggtgaaatgtgtgaagtcatgaccaggtagataaacttcagggcttccctttgatgggagtcacagtgttgtataacctaatctcagaagttacatgccatcatttttgccatcatctgttaaaagcaagtcaccaggttcaacccatataccagaggagaggcatgctcaaagatgtcaataccaggaggcagaaatcattgtgagccatcttagaagctgtacaccacactcccatttcacaaatcaagaaactgaggtactgccaggtgtggtggcacacgcttataatcccagcattttgggaggccaaggcaggaagattgcttgaggtcaggaggttgaggccgcagtgagccaagattgcaccattgcactccagcctgagcaacatagtgagatccttgtctcaacaacaacaacaaaaaaaaaacaaaaaaaaaacacaacaacaacaacaaccaggttcagagaggtttagtaacttcctcaaggtcacctagtaatatgcttaggcaggattcaaacccagagcaactctccctttaattaatttatttttttgagacagggtctcattactctgttgcccaacaattcagtaatgcagtgctggctcattgcaggcttaaccccctgggctcaagcaatcttcccacttcagcctcatgagtatctgggactacaggcgcatattaccacacctggctaatttttacatttttttttttttttttttttgtagacagagtcttactgtgttgcccaggctggtctcaaactcctggcctcaagcgatcttcccaccttggtctcccaaagggctgggattacaggcatgagccaccatgcctggcccttttaatcactaagcatattaacaaagtcaccttaaataatatttaagtagtagctactatatgatgtttacatgttctctcatttaatcttcataataaaactgcaatgttggttaatatagttcctgtgggtaacagatgagaatggatgaatgaatccatatgtataggcgaggcacagtggctcacacctgtaatcccagcactttgggaggccgaggcaggtggatcactcgaggccaggagttcgagaccagcctggccaacatggtgaaaccctgtctctactgaaaatacaaaaattaactgggcatggtggcacacacctgtaatcccagctactcaggaggctgaggcagaagaatcgcttgagccaggaggtggaagttgcagtgagccgagattgcgccactgcactccagcctgggcaatggagcaagactccatcttaaaaaaaaaaaatgtataactgttctagacaaactctaaaaccatttttcctcagctctcacaacagttgacacagaagacttctgtgaccccaaaatatttgagaatttctctgcaccagcaagcaagcaagcagttccacagcagacaccaagagggtgtcttccaattcaattccgacactatctacctagagatagtgtcagataccacaggccaaggtctgggcccccaaggctgcagctcccttcagacactagtcacaagtccaggctccaaaacttgtgaccaaccagcttcaagttggagttcccacccctgccaacccctgctttggagttcaattaatttgctggagtagctcacagaactcagggaaacaatgtgtttactggtttattataaaggacattgcaaaggatacaaatgaggacatgtgtagggtgaggtgtggggaagggataaaaacccaattcgcatgtagcccccactgcacgagcggccggcggacggagaggaggcatggccacccgccggcgtcccgcgcgcccccgccgcgcgcccccgcgccgccccgggtcgcaacgcgcgccccgcgaggcgttcaaacacccacacgagccgcgctgcacggccgcccgtgtcgcgcactcctccccctctgcagcgagcgagatgctccaactcacacacacaacaagacgcccacaccccccgcccgcgtcaacccacgccgaatgaccgcatgacaactacgtacgcgacgtcacgcgtcgaccgaaccactatgccaacagcacctccgcagatcccagcgtcgacagcgagtcgacagaagtctaagtgcgacataagttccgcgacgcgacctgatatctcttcgactacctacctcagccgctcacacgagtcgcacacgcaccggcacgcccccaccatagacgcggaccctaactggcccgcgaagaacgctagcnnnnnnnnnnnnnnnnnnnnnnnnnnnnnnnnnnnnnnnnnnnnnnnnnnnnnnnnnnnnnnnnnnnnnnnnnnnnnnnnnnnagagagtgtgtgtgtgtgtgtgtgtgtgtgtgtgtgtgtgtaaaacaccacagtaaccattcgcccaaggccagagtggttgagggtactaccattcctagacaaagaggggaccagagagaaaggtttggcctggccttgggagaggaagcgctctggacagcctgcctctgctttctgtattgcaagatgaggatggttcatcaggctcccctgggcccgcgtggaaagacccttcaacactcttggcccctcttagcataggcccaccagaccaccactgataccctcatttcacttgctgtggatggaaacctgaacgtgtcaggcactggacgggagtcatgctcacaccgcgctcgggccacgctggcctttgagtcccctggtctcagagctttgacccaggctcttctctctgcctagaatgtgccccatccctgttacccggtaaactcttacccctgcttcagctcccaggtcagatattcctcccttggggggtcgcttctggctggaagactagatcaggcccctcggctgcacactttcctaagtgcacttacagcagctcctcaccgtgcaagctgtggggtgcagtggagggtgagcctcgggaagctggccgtgtctgttttgctcgacctttcatctagcacagggcctagcaaagaggaggcagtgggtgagtgttgctgtttatgggatgccagtcaggtcggggtgcctcctgtgggtgttgccaggatcagccagctggttttccccaggagacctctatcctgcagtaacctctacattaaaatgctaataggaaagaatggaagggcttcctgacttcctgtgtaaacacttaaaagggacttctggagaccactcattttgtcatgttctgtccctgggtaatgactttagggtgggactttcacgctctgaaggataaataaacccgtagcaggagggggtgcaggatctattttagggtagaggagaggcctgtttcagaacctttcaaattgcagggcctatcctggaagtgtagaaaagggtttttaataggagaggagcactatttcattatgttaaaataatgtttacaaagaattagtaagaatgctgcaagaaaatgcacatgctatataatataatgtaaatatatacacatacaactcatttgatctcacttatgtaaaaatatgcattcctaataatggcttatcctactgagtgacttattaaatgtcacaacaacgttttaaagtaggtactcttacctccattttgcagatagaggttaggtaattttcccaaggtcacacagctagtaaaggacagagttcatatttgaaacccagtctgtcaggctctatagcccctactcttaatcactatattatgcagggagaaatccatcaacatattgtctttgggtggtggtttattttcttctttattctctaggattttctatttggatatactctaggagttaaatgataaacttttgaatagggaagaaggtggggtggtgaaatttgaaggccaaacatatgctttcaaacaaaagaattcactccatttccttttccacttttctacattttccagaagaactgatgaccaccccaattttacagcccactgaggccctgtccccagaagatggagccagcacagcactcattgcaggtaatagactctgagccaactccaagggaccttctggatcaagggcatctctctccagagggagcctgaccaaatccattaatgggctcactctggcttgtaagttatattacacacacacacacacacacacacacacacacacacacagccataaaagactcggaggcttctgtcagaggcactaccagtaaatgacaggttgggaggtggccgcaaatagatatgcatacggacgttacacttgagtacgtgggtagggacgaggatatatgtggttggttgagtgggtgaggaagagggggaggatcagataaaccacttcctgttaggataagccatttcctgttccctccttcccgtttctttaagaatcaggaactggtttgggaggcagttcagttttgtcagaaatcaaaagcatgtgtccttagcttaagcaccaggagactccagctattatgtgccatggaaattggggttggtgggggaacatgggtttggatggaagtggacactagttaatgaaaacaagaggatctttacgaaaacagtgactaaatcagatgactccaggaactactgagacatcctcaatcctgaaacatctctacattttccctctcctttccaagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaatcagattctcatgtgcaagaagtaactacattttgacttatttttgcttaaacatttttgacattttcttttccctatttaacgcctttacatatgttctcttccaagcaataagaaccctaggaaagttctagaagtttgcagaactatctcagggatttgagacaaagatggtgcaggaaagcttgttccaggggaacatcattagaaacataccctgggagggccgggttcggtggctcacgcctgtgatcccagcactttgggaggccgaggcaggcggatcacaaggttaggagatcgagaccatcctggctaacacggtgaaaccccgtctctactaaaaatataaaaaaaaaatagctgggcgtggtggcgggcgcccatagtcccagctgcttgggaggctgaggcaggagaatggcttgaacccaggaggcggagcttgcagtgagctgagattgcaccactatactccagcctgggcaacagagtgagactccgtctcaaaaaaaaaaaaaaaaaaaaaagtaccctgggagatgagttggttcaagcctccatcctggcaagggccagaatttcccagaatcccttctacatatatacagaaggaaccagaaaaaatcaacctaccacctttcccagtgtatcctcagaatcaagccaagaagcttcttggattttagtctcaagataagttgtgtttaaaaggcacattttggtataaattattagctcatcagatattgttcactttggaattaaagctagatctcctttgaagtcttaatgtattgcctctgttgtccaagctcaaacccaaccaagttaagatcaagagctgaggaatctggctgggtgcagtgactcactgcctgttatcccaatactttgggaggctgaggcagacagatcacttgaggtcaggagtttgagaccagcgtggccaacgcagtgaagccgtctctactaaaagtacagaaatgaaccaggtgttgtagcaggtgcctgtaatcccagctactcaggaggctgagacaggagaatcacttgaacccgggaggtggaggttgcagtgagcagacactgccactgcactccagcccgggtgacagagggagaccctgtctcaaaaaataaataaaagagctgaggaatctatcttggcaacctagattctatgagttttcagtatttctccacatagaacattggagaaactaaaggtcatcctcaacgtatacaaattgctataccagaaccttttcttcaagccaaactttagagcaagttaggagaatcaatagttccctcatttctaagtttaggtccgaaattccaaaatttgtaagaggttggagtaaaatgatgaaaagttgaacatctggaatggaattcatgaaatgatcaagtcttaggcttgtactcctgcctttatttcaaagcgtcatcaaaggaaacagagcagcagcagcacctagctgaattctagatgggatataaataaaatatatatagaagaaatctaaaaacaagctaagtaaagaatccttgcagtgaggtgtaatgcaacttcatcactttattcaaatcttcaaaatagtctttattctacatttttagtataaaaattccacaagttaagtgcaccacagtgtagagagagacatacaacgctgaacttccataacagtcaatggtacagtcaaacatcacatgtacagaacacacaatttagatgaactgaaattataagataaaataaaataaaatccaatttcagaaaacaaaaatcaaaacattaaggatccctgaaatattcttaaaccctaatgagatttcactggactcaagtcattttgtagtgagacattcacaatatgaccctattaacccagtctaggaattctggggagccgaatgagtggccgcatcagacactctgacaaaaaatggtaaccagtttttgatctgaaaactcctcttaatttagctctgaacacatcaatcaagcttttgaaatgcatcctcctccttgcccctcatattttaaaccaactgttgttcacagtacagtttgcacgacatctttgttcaaacatagctcagtttttctggcaccaaagcaaatttgggttaggttcgtgtatgcagagacaacctatgaggagggcccataaggcaccctccacttttgcctgaggagatacgaaagcagaagtaatgggatctgtacttggggcacagagagggtttcagaggatccttgtgaaacactagttaaaagatgacgagtggggagaagtgcgaggaaagaaggaaattagtctgactggctttctgtcctgcaccattgattcaatggagactggcgggaggaaatggaagactagggttggagatgggatgggtggggcaagggatggaaaggaaaaggcagacaactaatgcgttccatttataacaagtaatatatatcaaagacttaaaggagattaaagaccaatcagaataatttggcaactttaattcttaggaagatcaaagttccctccaaacctaatttgatgttttattactaaaagcaaagaccagtatggtacagtattactccagagaaattaaaggaaaatccttagggcggcttcacccacattcattttatgaatggatacctcccctacctcaaaatgctttagggaggtactgctaccattacatggttccttattaaatttgaaaagtgcctgaaagtttgggcaccagaaagacaccccaacaacatgtgtctaaactgcaacttcaggttaatatgactaaagcagttacattgtgagaagtgctgaaggtatgtgatgtctttcccggcacagaggtggccttggttcctcaccagatggtgtagccaccatctgaaccacccatgaagaagttccccttccgctgagttacgaggacgttggctccctgcatgactgcaagctgagcagcattgggagggcatccaggaggtggaggctgaaaggaaatgacatgatagaatgggcacagggcagctaatataagcgaaggggacataggggaagcagaggcctgttaggatgaggcaatgtgctaaccagctgcgttttaaggagctagttccgccaccaatttgagttctaaagtaggtctatactttatgtgaacccaaagatacaaacaggaaagggagcctaccactcattcaaagggttccagctctaagatgaagcctatggctaccttctgaacatgaacagaccagaccaacagtcattttgagggtagagaaccactgtcctactcacattcccaaaacagggacagggtgccagtccatgtatgaatcccacatggtccctacatagtttttaatttttaattttttttttttttaatttttttgagatagagtcttgctcttgtcgcccaggctggagtgcagtggtgggatctcagctcactgcaacctccacctcccaggttcaagtgattctcctgtcttagcctcccaagtagctgggattacagacgcctgccaccatgcccggctaatttttgtatttatagtagagtcggggtttcaccatgttggccagcctggtctcaaactcctgacctcaggtgagccaccgtgcttcgcccttacacagtttttgaatgaactactggaaaactgaaggctcgctaatgacacattcacttcatctctagcatgtagttactgagcagtcatttgagctctaaatcccacgcactggggaattaagtaggaaaaaatgataactaaaattgttaatatctttctaaaagctacttactagggattatacattctacttttttaattatcagggttcctagtgcaacaccatgctgatggcaaatattaagtaaatggtaaatgcttatggaatgaataaggagcattactagaccagttcagtgtaccacaatgaactggaaaagcagcaagcaggactcgacagacatgaaaacaaaagaatctggttaactcagcccccagtgagatgctactcacttgccacagttctgccccctcaaacactttctgcctgagtattggatgtcagtagttgtaccaacactggcaactatcatccagaaatggtaagagaatgaatatgaagtcatttcagaaagttaaaatacacaagggctgagtttcttctgatgaggtcatactcacaggaatgttgccagcagtagccccagctccaaatctggcacctgcatcataccctccttccaccagcactgtggagccaggtggatagatgggaccgactggataataagccatggggattgtggaacctaaaggcccaacagccacagactgggccatgggaagatacagagaggctccaggaaatgcggctgacatggtggggactgtggcagcccctgggtgcacaaagctcggacgatagagctagaagaggcagaagagaaggcaaaatgttactttatgacattcctatttgagatctctttaatgagctaattcttaattctccttatgcaggttatactttttgtaagattatacaagttgcctttccactggccttcaatattctcctggatcactttctgctatagctaatgttgggctcacagaacgcaaattcatcttctgcaccttagcctgtgccaaataacacaaaatcatcaaataatgcactttcaactccgacaaaaattgccaaattatatagtgttttagattattcatgttagcatttgtgaagagtaaatatgtgaagtcagatttagctaaggactaaaggaccaccctaagagtattcccagctagttcaaatctggcaaactggaagcacctctgagtaggcaggtggagcatcggtatagggtggagcctgaggaagatgcaaggtctgagggtatactggattcccaggaggctgcacagggtaggttggctgtgttggatattgacctgaaagacaagaaaaaaatgaaggttgcctactacacagagctaccaaaatgaggcaggtcatatcgggtagctaacttagtgggagcaagcagaaggggatttgcaaatagtctgccccagagggcctgattcctggaactaagaaaatatgcattgtctttgcacccttaaaatggaaggtgctggattctaacgagacaagaaaggcactgctcactgctcctactaacataccgaagtaaggggttaagtctacctgggcccaagttccctccggaatgcaggacaggtctggggttctggcctgctgctgttctggcttatcaagggtgcctctgctctaggtagtctccacagcctgtctacaaccagcccagacttcgtgggtaacagcagttctgattttccttacagattactattcaaggtcgacttccaaacaaagggtgtgaatgatggaagtgaaccgtgagactgggaaaagggtgcagggctgaggggtgaggaggaatatcctcactggaaaagcgggggatcaggtttggttttttgtttgttctgagacggagtctcgctcttttgcccaggctggagtgcagtggcgcgatctcggctcactgcaacctccgtctcctgggttcaagcaattctcctaccccagcctcccgagtagctgggattacaggcgcccgccaccacgcccagctgatttttgtattttttaatagagacggggtttcaccacgttggccaggctggtctcgaactcttgacctcaggtgatccgcccgcctcgacctcccaaactgctgggattacaggcgtgagcaacctcgctcggcttttttttttttttttttttctattccttttttaccccctcaacctattcctgcgttatgggaatcatgttccgacagacacactggtacaaccacagaaaaggggagaagttctgatcccgtcagcgaagggcgagggggtgcgaagggaaggaaaagagacctcacaggccccggcccacgaaccaactccagcaattcagtagttaagttcggccccgctgggggttccggagcgcggcgccccgcctccgccggctctccattggcctacgcgaatgcctgcgctagcgctctatttgctcctgcggatgcccatcatgtcaagcccccccaccacccgagcccgcagctccaaactgcgccacagagtttacggaggaaagggcctggaggcagcaagctgccgtaatttgggtatgacgaaggcgtcaggcgcagcgccctggactgcagccggccaaggagcatggcgcagcccaccccaaacctggcgtttggtgaccctgggctccgaatccgctcgctctgggccagcagtactccccccgacggcctctgccaccctcggtccttgcctttgctgttcatggtggttgcgggtccggtttgtctcggcgtcgcggacggttatttttttcgtcctcttcctgttcggagctacttccgtgtcacatgatggtccgtccgcctagcgtcacccgacgcccgagtggcgctgccgccggaaactccgcccctgctccgggcctccagtcggccgcgggagggtccgcgcggtcccgcccactcgccttggccccaccccctgctcgtttctgtcctccacccccctaccggtgtccctcagctggagaaaaaccaaatgcaggtattgtctggaaacaggatcttttctctgttggacgctcggatgcagaacgatgcaagcattccccggaacctttttccacctacacgcattcactcaaggtcacctcaccttggcaaccttccacgaggggcttagatttctgcagatttgtcgcattgcctgaaatcggctccccacaccttagtttatcatgcgtccctccccaccaagcccaacttaagcttcagctctgttaaaatttattttgccactccagctcacatgtatcctttcctgaatgagacctgcactggaatcttcgctgccctgtcttccccaggacagtcgttgcctttctcacgtacaggaaggggttatgttttccgtgctgtacgcaacacctggcactgaaactgacataactgcactacccatggagtgtttgtggccctttcctttttttagcacctgttgcaggtgacctgtatggtacctctatttttctctatgtatggcttctctttctaacctaattatccttaagggcaaagatggcatcctttagggcagcgattaagtgttttcttttctttttctttttcttttttttttgagacggagtcttgctcgcttgcccaggctagagtgcagtggcgcgatctcaccacagcctccacctcccgggttcaggcaattctcctgcctcagcttcctgagtagctgggcctacaggcgtgcgccaccattcctggctaatttttgtatttttagtagagacggggtttcactatgttggccaggctggttttctttctttctaaaaaaagttttaattttttcttttcttttttttttttttttttttttgagatggagtcttgctctgtcccccaggctggagtgcagtggcatgatctcggttcactgcaacctccgcctcctgggttcaagcaattctcctgcctcagcctcccgaatagctgggattacaggtgcccgccaccacgaccggcaaattttgtattttttagtagagacggggtttcaccatgttggccaggctggtctcgaactcctgacctcaggtgatccacctgcctcggcctcccaaggttctgggattacaggcataagccactgcgccgagccttatttttatttatttatttatttatttatttatttatttatttatttttgagacagaggcttggtctgtcgccaggctggagtgcagtggcgcaatctcagctcactgcaacctccgcctccagggttctaagcgattctcctgcctcagcctcccgactagctgggattacaggcacgtgctattcattttttaatacagagatggggtctccctgtgttggccaggctggtcttgaatttccagcctcaagcgatctttccacctccattgtccaatgattaaagggttaactcttaggacccaggaactctcctgggcctacctcctgctcatgtaaactgccctcagattggtcaggcctactttacaggttgttgggtattttgcttgtcacagtgggacctgggcattgggaaaaccagggcagagccaaatgagattactaacaaaaatgaaagagttgcaggccagtgctttctctggcaggtggaattaagaagtaaatggtggctgggtgcaacagctcacacctgtaatcccaacactttgggcagcctaggcaggaggatcgcttgagccaggagttcagaaccagcctaggcagcatagtgagacttcatctctacaaaaaaaagtagtagtaattagctactttcttggacaggatcaaactttggcattttcttcattctcgtagattccccaatgagatgaagatgtttatttggtcatttatcaaacattctttcttacattaatttaacaaatattttttgagcacctattatgtgccaggccctgtgacaggcactagggaaataataatgaagagacaggcatagtccatactctcatggaatttatggtctacctaatgggagagacagaaaagtgaacacataatatgattagtgctgacataaagacagcatggagtgtgaggagaacacataggtgaggcacctactctattctgatgtaatcagggaaggtttcctgatgcaagtgatgtctgagatgaaatctgaagggtgagagcaggttaagcaagtgaagagggttcctggaagagggaactgcttatgcaaaggcctagaggtgagaaggcttatagagggggagggcatgaaagagttcagtgtagccagagcatactggtaaggggactgataaaagatgaccctgaagatccgggtgcggtggctcatgcctgtaatcccagcactttgggaggccaaggcgggcaaatgacttgaggtcaggagttcgagaccagcctggccaacatggggaaacctcgtctctactaaaaacacaaaaattagctgggcatggtggtgcgtgcctgtaatcccagctacttgggaggctgaggcaggagaattgcatgaacctgggaggcggaggttgcagtgagccgcgatcgtgccattgcactccagcctgggtgacagagcaagattctgtctcaaaaaaaaaaaaaaaaaaattgacgctgaagaactgtgagccagaccttgcagggacgccttagagcccatgtaagatcccacatgaagatactggattctatgttaagggcactagttagccactgaagaatgttaagcaggaaagtgatatgatcttgtttttgtttgattgattgattgattgggacagggtcttgctctgtcacccaagctggagtgcagtggtgcagtcacagctcacggcaacgttgaactcctggtctcagttcatcctctcacctcagcctcccgagtagctgggacagtgggtgcttgccaccatgcctggctaattttaaattttttatagagacagagtctcactttgttgcctagagtagtctagaactcctggcctcaagcaatcctcctgcctcggcctcccaaacttgggattacaggcgtgatccactgctcctggcttgtgtttttcttttagaaaaatgcttctgggccaggcacagtggctcatgcctgcattcccaacaatttgggagtccaaggcaggaggattctttgagcccaagagttcaagaccagcctgtgcaacgtggtgaaaccccatctcggcaagaaatttctaaaaaagtatccaggcatagaggcacgcacctgtgatcccagctactcgaggggttgagataggaggactgcttgagcccgggaggtcgaggctgcagtgagtcgtggtcacaccactgtactctgccagcctcggtgatagaggctatctcaaaaaaataaagaaaagaaaaggaaaaatccctctggttgctaaagaatatagaataggttaaagaaagggcaagagtggacgtatgtctgagataccatttagaatcaaatttagtcatttaggtgtgatgatggcagactggcctagggaagaggcagtacagtagagagaaatggggggattccagaaatatccaggaagcagaaacaactggactagttccaggactaatgtcaggacaaaatttctacaaagtcaaaactccatatagtcaaatgacaaattggaaaaatatatttgtaatttacatcacaaagagctaatcttcctgcatgtaaagaactcttagacatcagtaagaatatgatcaaccattagaaaaaaatggcaaatgacatttacagacagacagttcacagaaaaggaaaaacaaatgactccctaacacatgaaatgatgttcagcctgggtcgtaatcagaaggcagattaaaccccaccgatatcattatcagattggcgaaaatccaaacatttgctaacattatttgcagggctgtggataagcaggcattctaatttgttggtgatgggggtgaaaattggtacaaatcctataaggttaatttggcaatatccatcaaacttgcaaacataccattcccactaatgggagtgattctacagatatatttgcactcacgagaaacgtatgtataaggctattcattgcagcttttctgtaacagcaaaagattagaaataacccatatttctatcaataggaaacagaaaaaataaatcttgatacatccatacaataaaatactatgtggctgcaacaggagaatgagaaagtactccaaggtgttctttaaataaaaaagggaaagattcaaaaccatatacttagtgtgatacattttatttattttattttttattttattttgagacagagttgcactcttgtcacgcaggctggaatgcagtggcgtgatctcggttcactgcaacctctgcctcccaggttcaagtaattcttgtgcctgagcctcccaagtagctgggattacaggtgtgcaccaccatgcttggctagtttttgtatttccagtacaggcggggttttgccatgttggccaggctggtctcgaactcctggcctcgagagatccacccgcctcgccctcccaaagtgctgggattacaggcgtgagccaccgcacctggccaatatgatactttttatgtcaaagagcagggaaaccaagaatattcatcagaatttgagtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12774 - DNA, 60785 bp, Human
  misc_feature (1)...(60785): n = A,T,C or G
acctgcacggattgctgtggctaaagacacttcagggacactcggcctcattttttaaattattatttcttattttatttaatttatatatattttttgagatggagtttcactcttgttgcccaggctggagtgcaatggcgtgatttcggctcactgcaacctccgcctcccaggttccagctattctcctgcctcaacctccccagtagctgggattacaggcgcctgccaccatgcccagctaattttttttattattattatttttagtagagacagggtttcaccatgttagccaggctggtctcgaactcctgacctcaggtgatccacccacctcagccttccacagtgctgggattacaggcgtgagccactgtgcccggcctactcggcctcattttgaagtcgattccttaccagcgcgggaggggggggggcggacannnnnnnnnnnnnnnnnnnnagggggtgggggcggacacaaacaacacacgctgtgaggattaatgtattataatgtattgctaggctttcctctaaaaatagtgttccccggctgggtgcggtggctcacgcctgtaatcccagcactgtgggaggccgaggcaggtggatcacctgaggtcagacgctggaaaccagactggccagcatggtgaaacccctcctctactaaaaatacaaaaattacccgggcatggtgatgcacacctgtaatcccagctactcgagaggctgaggcaggagaagcgcttgaagtcaggaggcggaggttgcagcgagccgagatcacgacactgcactccagcctgggcgacagagccagactcttgtctcaaaaaaataaaaataaataataataataaataataaataaaaataatggtccgcaggctttcagggatgtgtgcgggccggttttccatatgggaacagggaaaggatgtgctgaaggcttcctccggtaggcgactttggctgatgtgactttatgcctcgtagtgagggcagggcgacagagggacgggccggtgagcggctgtcctggagaaagagcagtggcatccggggggcttagggtctcaggtctgctcactccgcacatcttttctgtgctttcattgaaaaacaaaactgaaacaagagcggacacctaagtctgcctctctctttcctgtcacccgtctcaggctggctgtcctctgtgtgtgcgccaggaattctgcaacgaagcgcctgcctctccgcttggttttccttggggaagggcctggggcctcctggggggtgggcaccgggtgtgtgggtgtgtgtgggggacctggcagggagcagcgggggagaggcggggtggggggtcgcgtacaccccaggagcctgaggatgcgctgcctgctgggagagacagccttggggcgggtggtgtgcacagagctctgtcggccagcgcgggcgggcggggccgttgttgggggcgctgaggcgagtgaggctggagctgggagtggggggctcgtcgccttcgtctctgggccgccccctccacctgcggaggcgattgtaaagggaaggggggaatccctctgccatcacctcccagatacttgggggatggaaaacgacaaaacacggaacctcccactccctaaaaagtgggtggggagggtgaagggaggacaccccttccccgcccccagcgccagcagccggggtgggggcgggcgaggcgcgcggggaggagagggcggaggagaggacggggggcgaggtttgcttcaagaaggggcgtgtggccggcgcagcgcgtgcaccagcggctccggagcgagcggccgtggctgagaaggggagggcggaaagtttgtttccccgacgtcagcgccgggcgggccgcgaggctaggaggcggcgggagctgggcagagcgcggggcggccggggctctcgctccgacccgcgcccgcgacccttcctgggacccgagcccgagacccccgccggcccccccggggccgctcgcgggcatggacagcgcggccgccgccttcgccctggacaagccggcgctgggcccggggccgccgccgcctccacccgcgctggggcccggcgactgcgcccaggcgcgcaagaacttctcggtgagccacctcctggacctggaagaggtggcggcggccgggcggctggcggcgcgccccggggccagggccgaggcgcgggagggcgcagcacgggagccgtccgggggcagcagcggcagcgaggcggcgccgcaggatggtgagtacggccggccagggacgggggtggcggggccggggccggggccggggccggggcgcggggtccggggagccggcgcggggcgggcgaagatgcagggcgcgtggtcggcggcaggacttctgggggcgcgtgtaagtgacggtggacggcggttgaccagcactctgggctgggggagggggaccctcttcgggtcttggggtgcgtccccacggggaagtgcgctgccttcgctccccagtattcggctcccgaacagcctgggaagtgggtgtggctgctgccgggttacaactggggaaacagagacctgagtcgggcaaagccgctgagctgcacgttggggtttcaaacccgccccctcccgcacgagctagcgccgccccagctcctcctcggtcttaagttgggctctttggggggcgagggtgcctgcccacccccccccaccctccagtttgccccgggagcagctgcctcggtggaacggcccagccaggcctctcttccccggcggaggtcaaaggtcatcaggaaggggctttaaaaacaaacaacccacccaagtggcctttttcaaaaagtgacacaggatggcagggtcctgagcccttggtaagaaggggagggacggggagaagatggagaaaaagcaaaggccccagccccggacggttcagtgggggaggggaggaccggagtcctcgcggctcagcacacactaaggatgggggcccggtgatctgaaaccaggcccctgtcccctagctctggggatgggccggcctgctgggggctctgggcccctgaagtgtgcccgcctgactccagcagccctcccacccgccccgggggaccctgttcccggcaccagcctccaggtctcagggtgcccaggctggtggctgcgttccttggcttttcagagacaggaggtgcagggaaaacagaggtggctgcagcctagtctgaatccatgtgcgtccacgaggacgcctgcgacacgcctgcctttcacggggcaccttctgccagcctgtggctgagatgaagccactggctccctcatggcagcggccaccactcactggccacagtggactggccactggctgcaccctccggggtgagtgtgaagccagcagacctcccaggagttggggtttagctcctcagtagaaaaggggagggagatgtccactctggcccggaggaaagcaggtgccctctggtttgtgctgggggaatgccctgccggcccaaggtcatttgaggacctcagcggctctgagccggtcccccaaccccaggacagaggagaggtcccggtttaccctgatgaagggagactccaggggttgggaagagaaggaggaacaacttgaaggtgaagggaaagaaggaaaggagaaggcaaggaaaggagagagagagggaggagagacagaggaagaggaaggaagggagaggagagaggggtgaggagggaaggaagggggccagggtgtctcgtactccagtcctggccaggggacggcctgcccatttctgacctacccctgctgtggggacagccagggaaggccgtgcttctcccggacacggtgttggaggtctctggtggcgggtttccccggggatcccagaacagctagtgtcagctggggatgtgggcgcctagacaaggcccttggcagcctccaggcagctgggtgtgcagtgggtctccccagcagctccctggggctagccaccctcctggagagcccatgaggcctccaggccttctcctaagaaggggcattggcacactgggagtacccaggcatgcttgggacacactgggtgtgggatcaggtggggtggggtctgggccaggctccaggaggcgctcgtgggctggtccgtcttggaagctgcctagctctgccctgaggacgatggagccctggcagggagagtccctgggctccgcccggggtgtggcccggatctgggtctacaggcagaaggtggagagaggggactgcagggcaggcgccagtttccaactcatccatctgggtcaggcggccccaccactgccacttgctgtggactcccaagtcctgaaggctccaaaggtgggggagatgggatccttctttccccatcatcgaccctttgaaagtgggcagccaaaccttgctgggcttgccgggactgcagaccccaggccagtgggctgagtcttgggttgcggcatcatcctccagtcctggacatacaggagcccggtcccctcaccacggatccagacatgcttggaggtgggttttcctgtggctcttggagttgttttcaggtccaaagaaagatggtctggccgggggcggtggctcacacctgtaaccccagtgctttgggaggctgaggtggttggatcactagaggtcaggagtttgagacaagtctggctaacatggtgaaaccccatctctactaaaaatacaaaattagccgggtgtggtggtgcatgcctgtaatctcagctactggagaagctgagacaggagaatcccttgaacccgggaggcggaggttgcagtgagccaagattgcaccactgcacactccagcctgggcaacagaatgagactccatctcaaaaaaaaaaaaaaaaaaaagaaagaaagaaaagaaaagaaagagatggcaccaaagagggagtgcccccattagaaaaataagggttagccaggtgcagtggctcacacctgtaatcccagcactttgggaggctgaggcagttggatcacaaggtcaggagttcaagaccagcctggccaagatagtgaaactgcatctctactaaaactacacaaattagtcaggtgtggtgacagacgcctataatcccagctactcgggaggctgaggcaggagaaaaaaaaaagaaagaaagaaagaaaaataagggttaatgggggacaccaatgagttaggaattaatacgtcttcaatctgctgggatagcaggctcaaactttttttttttaatttaaaaatttttgtttgcacaaagccaccagtagataaagcccgctactgccaatgactttctaagaccaggctccctccagaaatggccgggaagaccgtggcttcgccagtgactcagaacaaaccagggtcgcgggttccttcctcgccagtcaaacgctgagggctgcaccaggcacgttaggaaaacaaaccctggtttgctgcctttgcaatgacttacaacaaaagaaaccacattaataactgagattttctctaaagcattccctcctgtgggcagagtggaaacggggacgtggacacactgggaaaataaacaaagcccctagagccaggcaggggtgaggcctctggccagggaaggctgggcggccagtgctcagggctggtacctgctttggaaaaccccaggattcactgcaggagaaaccttgggatcccacgtggattcattttccagagatttcggaagatgaagtgcttgcatctaaggcacggggcaaggcagggtgaggtgggagccctcgaggggctgtcggtgcatctgttcataggggtgggtctggtttgtggtgggggtccccagggctcagctcagggcctgagttaagagactgagttaagagactggcagacctaccttcaattattttttattgcgataaaagatgcctaacatcagattgaccattttcaccatttacaagaatgctgtccggtggcattaagtccgttcacattgtcgtgcagtcgccaccaccatccatctccagaactttctcatcttcccaaactgaaaccgcacccccttgaacatgcattccccctcccccagcccctggcacccagcagtctgcttcctgtctctgtggatttgactaccctagggatctcgtatgtaagtggaatcctacagtatttgccgttctgtgaccgtcttatttcacttaatgtgacgtctacagggctcacccgtgtagcatgcgtcagagtctccttccttctgaaggccgaatcacattccactgtacggatggaccacattgtatccgttcacccatctacagacacgtgggttgttcccatctactgtgaacagcaccgctgtggacgtggatgtatacaagtccctgcttttaatgatttgggatatctagtcagtgttggaatggctgcattctatggtagttctacctttaatttttttattttttagtttttcacggagtcttgctccattgaccgggttggagtacagtggtgtgatctccgctcactgcaacctccgcctcctgggttcaggtgattctcctgcctcagcctcccgagtagctaggattacaggtgcgtgccaccatacctggctaatttttgtatttttagtagagacagggtcttgccttgttggccaggctggtcttgaactcctgacctcaggtgatccacccgtctcagcctcccaaagtgctgggattacaggtctgagccaccgtgcccggccctacctttaaatgtgttaagggtccataatactgttttccacggctaacttcggtttttaaccggcctccctgtaactgatgctgaaacagggcatcatcacaagaccagagccaggctttggaggaagagacaaaggggtcccttcagagcccagcctttgaaaggcagcttgcgttccttcccctcccctctccccttccttcccctttctctatttcctgggacaaggggagtcatgcagtcagtgagcattctttggggtgctgggatgctccagttggggtccttgcttttgccttcctctccgtgtgtgaccttgggggtgtcatgtcacctctctgtgcctcgttcaccacctgaacagtgggagatggcgtacaagggttgggaggccctcccgactgagatgatttgactcaggcttaggaaccccatgatgggcgtgtctccctgggatgtggggtctctgagcctgggtctgagctgggcctggtgcctggaccctcagatgatcatgtctcagcaggagccggggagcagggagggaggaggagtgagtgagaggctgagtgcccagggggccttccgtttgggaactgctgggcctcccagcgtggctagggcgggacagtggcctgcatctcggccttcttttcgccagggagggttggttcattatttgtggttccaggacctcttgctcctctgtccagtagatcatctgggtggagcttgggggcctggcacagggggcttagaccggcttgcccttctctgtgagcagaaactcaacaggctggagccaccactgtcccctcccagaaaactccagaaaagcagcttggagcagtagtgacagcgccggcttacacacctcccttgaggcctgaaaagaaccctgcgagtcagtgttgccatctgtgggataggaacaagggctgtggtatccctcaaagggcgtgtcgagccctgagtgggtgagggttctgggtaccatgcctagtccacagtaaagtgtctccactgcagctcctggagatgctctctgagggcctgtgagtcaggcgaggctgtcagaggcccagacaggcaaagcaacctgcccgaggcctcacagctgggaaaggagaggagggatttggttttggatcacaagtccaggcctccctctcctgcacagtccttgggctggaggagtcagggaaggggagctctcctggctgttggggagattctggctgaggcttgttggggactaaagcgggtgggaggggaggggcagcacggaacgggctctgtgcctatgttaggcgtttctgagtaggtgggggcaggaaggaaggtttgcggtggcttgtcccaggcaagaatgtggggtcaggctggacgcggcagaacttggggcacttccgtggtttcctagaccctaaaggacagtggctcacccagggtggaaggggaccttgggggtgatttaaggggacccaatgcttgcttgaagatacccttacagcagtgtaccaccctgggccagaggctgcgccagtggagcagaagggggtggccgtggtggggctgaaggaaggcgtgaggggacgtggtgagagtgaccgggaagcctcgtgggcacagcagctgtgtgctctgcatgtcggctggggcatcacaggcctcactggagttgtcctcctgccagccgtgtgaagcccattttatgaagagggaaactgaggtgtgaggtgaaggtcacaccgttcccattcctgtaagattccagcctggccctcctgttccaaaacccctgatctctaccactgcctgaagctgcccctggctcccgggaatgctggggtggcctgaccagggatgtccacacccaggcaggcgcaggctgcattcaggggccgtgaggtggcccggggttggggggtttctccttaatatctccagcaacctggcctgggtcatgtcccaagtgtgagggagatgggtcaggcctggagagtggggactgcccggggctggggtgtttgacatgggagtgtgggggtgatgcccttcccctcctgcccagaaataaccggaacggcctccctcacctgtctccagctgcccggatgcacgagagctgtggagggtccctgtctctgtgtaacagcaataggacaggttccctttccccctccatccccagctcccgcacttgttcattcattcattcattcattcattcattcattcattcattctacagtcattttccgaacacctataatgtgtcaatccttgagttccactgccggcctgtggttcccagacttccagttttcaagtccagttaaatttccagtaactgagaggaagtggcatacagtggacagcgttaaaggtttgccaagaaaagccatttactcacagccctatgttcccaccctttcatccaagaaagaaccttttagtatcttcatctctgagtacagaaaggttcttggctgggcaaggtggctcaagcctgtaatcctagcactttgggaggctgaggctggaggattgcttaagaccaaaagttcaagaccagcttgagcaatgtagcaagaccttgcctctacaaacagtaaaaattaaaaacaattagctgggcatggtagcatgcacctgtagccccagctactcgggatgctgagacaggaggatcccttgagcccaggagttcgaggctgcagtgagctgtgattacaccactgcactccagcctgggcaacagaacaagaccctgtctcaaaaaataaaaaaacgaaacaaacaaaggttcccaaaattgacttcatttagcttcataaaaagctcacttattgcccctatttttctcattttgtcggtgaaaactttgtcctaggctggcatttgggaaccacatggtctggctttcccagactcccagacacaaagacacacacagacccataccccccatgccacacacacacacacacacacacacaggcacacacacgcccctcatcacgagggctccagcccggccccctgatggagccctggctgttagtggtcagggtggccgcagctgctggagagtagatgggcagatacatctgcacctgtgcgggccaagggttaagtgccttttgcgaggtggtgagtaggagagagtcgtgggagcttcctgtttagacagagggaggttggggttatcttgctggctcccacactgagcagacgaagagatggggtgcccggcggtcagcatcccgcaggtagggaggtgacgtggggcaggggggcaggtggcagagcatccccagcctggaagaggcagagctggccacggctgcccctcccaaggagcatggcttaccaggacaccccgctctagccagaacccaggagccacagaatcgcaccagatcctggaaacagaggttgttatgagacccagaaagcactgggtccctggttgctctcgctgccctgagcccgggtccagctgccctgctctgtgtcccttccacatcacggaagttgtttgtgcccagccaggctctggggggccaccaagatgacagaatgggtccccatggcgcccttgatggctaatgatatctttccttgtgtcctaaaaatgaagcagtctctggaagatattattctggtttatctctgtgattgattctgcttttctgtgcgtgggatgggcagcctggaccttccagtttgggggcggtaggaggggctaggagtgagtgggggcaacgggtgatggagcagccaaggagctgaggcctgtaggattggggaccgggcaacaggctgtgggctgcaaaactcgcagtctttggagaagacttgggagtgagacaatgacagagaaggaggcccaggctgtgaggactggaaacttccacagagggacccccccgcccccagagctgagcgaacacctcagttgcttgagatttgacaaggtgagggcaggtgacctcctgtaacactgctgcccaagacgcagtgagaagggccccagactaggagtcaggacatggggttcctgcctcgccttgcccagctctacagcttgagacacaccctgtggctggtctgagcctccgtgtccccatctgcaagacaagaaggttggacatttgtttatggacatatttagtgtggtcccaggagtcactgcgtcagaatcacccagggagctggtgcgtgttcccaggtcccaccctgacccaccggatcggactcggagcctaggcctatgcgtctgcattcaatagccccctgcctagcgattcttgtaccctgctgcgggctccttccagagctgactctgcctccattaccctcctcagtttacccgagtggaaagcggtcctctcgaggggacagagaggccgggcagagctgccgcaggatgcataaggctggctctggacctggaagggcccggaagtgtccagtatacaggagagggagggggctgcgctgaggctaagccccagcatccccagggactggattttgtgccaaagctgcactgccgggtctaggaggaagtatttgctctcgaccatccaccagcatccattgagcacctactgagtaccagcccaaggcagcccaggggcgtggaatgcaggggtgatgtgatagggacgattcctgtctctccctcaccagcatcctgaccccctctagctttggtggccagggttggggtgtaggaggcagtcaaaagcacccctgctgagctggagccactggacaagccccctcctggcatcctgccggcacctcctgcccccctgctaccctccctcccccatggggtcccctcaaagggctctcttggggatggggatccactgcccccagggggcggctgccttgccccagactttgtcctcctgcccccacccccgcctccctgtctgtcctcccccactgccggtctccccctcgctggcctcccttcttgccgtgggcgcagacgtttacacgccagagatggcgttattaaaaatgacatttaaccagagctggaattaccacgcggatggctgcaaacctcggaatcaaagcgggagccgccaggcgggcgcgcctggcaggggcctcgcagcctctctcgccgccagagctctgcgcgggcctcccgtataaaaccccgcagaacgccgaggtcttgaaagccagtgcacctcctttcattagactaacaaataacgcgtaacagaaaacagctgttaacagcagccctctaatgctctcaagatggtgcctcaggcagctggtccagccagtgggcagccggtgggcaactcagcctcaggtggaggctgctcccaccccaggtgggtgtagaatgtctggcaccctcccgtttttccagggctgggtctgcaccctctgggacctgggagcctccttctccttctgtccttcctcctgctcagtcattcacccgctccttgctgagagcccatgtctgagggtctgttggcgaggggttgggccctgggacggtgggaatcaggggtggcatggccaagaacatgggaagcaacagccagatcttgagctccagccccacctctggcccgctgagggaccatggctagtttctctctaagctccttatttgtcatctggggaggacaagagtcacaccttcttgcagggaggttttatggatttgggagatgatggaagtggagttctcagcaggcagccagacagtgctcagaagaaagagtatctgcaatcgtggttacagctgaggaaccctgtgctcagagaggctaagtgacttgcccaaggtcacacagggggtggagaagccagagcccatgtgctttcaggacactgtgaagcagggactgaggcattcagaagtgggtctgaaccggcccctgccctcagacggcttccagtccacagttgatgtagaggatgagctccctagccctcactgaggccaggcaaccccttgaggcccccaccactaaccctgcgggcttggaagccagaggggcctccagatgcagacatcattccaagtgtgggtgctgggagacccggggcctccccagaagccgaagcgtgatgcccccagctcagaggggctctgtcctcaaacctggagaaagaagggctgcatcctaggctagggagaaaaatccagagaaaacctccctaagttgggaagaaagacaaatgggcattttgtttcatttcccctcatggtgaagccacagaagagacccctttgccttccccctaagagactgtatgttaaactccgtgcctccccacttgccaccaagatcctgctctgcattttgcttgcaagaaaactgcataggattctccttatttgctcatttgttcagcgcatgtgcgtgttgttttgaggcgtggtgctgggaaaatcccagtgaacaggccagccctggtcccaaagggcataatctcagcacagagcgcccccagcgatcccgttcttaccatctgccagtctccgagctctaggatttatgcagagcctctcactgaatcactcagcagcctcacgagagaggtgaagctttatcctcatcttacaggcgaggaaaccgaggcttagaaggataaagtgacttgacccaggaaatacgcagtgatccccagagcccaggtatcacactggccacctcacgccggtgcctcagatggccaaggagccgcgcggggttctcctgctagaagcagcctaggctctgcctctgggggaggcccaggagggatgggggggttcctccccacctcccggttcctgcctggagagctctgcagtgtcctgaggaaggcccccctccaaaccccccatttgcagggacacacccatgcagacactgggccgtggcatggtcaggcggggaggctccaggccttgctgtgatggggaggggggtgaccagggaggggcccttgccttagggaagctcatgtttcctagagacatcatgttttaattggaaggccagcctctcccgcagagcgggccgccccaccaccacatccctgcgggaggagagtgtcagggctcaaagcgggaaattgctagagacaagaagtaaaaacggactactctgatttcactgggaaggaagaaagaaaaggcaaagatctaataccagctgaaagcagggttgctgtttaaagaaaactgttgctgttgcagcaaatttaaggctgcggctgctttttctttctttctttctttttttttttttttttttttttgagatggagtctcactctgtcgcccaggctggagtgcagtggcgcaatctcggctcgctacaacctccgcctccagggttcaggtgattgtcctgcctcagcctctcgagtagctagaattacaggcacgtaccaccatgcctggcacatttttgtatttttagtagagatggggttttgtcacgttggccaggctggtctcgaactcctggcctcaggtgatccgcctgcctcgacctcccaaagtgctggggttacaagcgtgagccactgtgcccagcctagggggcggctttttcaaggggctggtttctctgtcaagggaggaaaagtcagggaggccttctgtgaatgcttctctccttccacaaatattgttgagcacctactgcacgccaggccctggccaggcacaggggcccctgcaggaatcaagggagctgtggtccttggtgtgaaggagacatgctggatgctatgacaacacacgacggggcccctacattgtctggaggttcagggacggtttcctgggggaaacagaatttcagaagggacctcaagaatgagtggagttgtccagtagaggaggtcagggagggcacgccgggtggaggaaacagcagacggaaaggctccgagttggaaagagcatggctgttctggagcagaaagggtgggagagagcatgatgggggcctgtgatctggcagaccttgtttgaggtgtgtgacttttgtgttaagagcagtggggatgcgttctgtgtgtctgtgagtgtccagagtggccactcactccggccctctctgggggcgctctcagtgagcatctcttacggtcacatgggaagccagtgtgtgatatggggatgacagttgtgtctcagttgcccagagctcgctgggctgccccagtctccaaaggagctgaccacaagcccctaactggctgcccctggcccagctgccgtgagacctgcactgcctgagaagcccagatcctcagccagggagggaaagctccaggagccatttagagccagaggtggggcaggtggccgtgccccacgtcgcagtccaccacgtgcaggacggcagcaccaatcagggaggtggggacgggggtgcagatgtccaggcactggggagccatggctggtgatgaattcatggtgtcagggacccaggaccagggctgtgtgtcccaagtgcatgacgaccctggggtggaagctttgttcacaagatgaggaaggaaggccatcccaggctatctgaccttgaatcctgtattccacaaggaatggagggagtccggggtgctgctgcagagtcggaacagttgagctgggtgacggtggcaggggggaggtggctgtgagggcccacctccatcatcgtcggccccatgatccaagaggaccatttattgtgcacctgccaagtgctacaccctctgcatggatcatctcattaaatcctcccaaacattctagaaggcaggcggttttatgaccccattttctaggtgaggaaactgaggcccaggaagccaagttacacagtaagtacgtgggggcaccaggccttgggctcttgactgtgatctattccctacccctgccgacctggagtccctggattgggctgactgcgaccttacccagcctctccaggcctggttaggaagggaaaggtaagaaggttccataacgctggagcaggggctgctgaacgaaaccagaggtgatccctggcccaggcaggcgggctaggggcaggggcagcccctcttgtcccccatgcagctcagtggtgatgcagacagagaaatgtagagccagctccagagagctcccaagggcacccctccagggcctccgtttcccagggataggacacgctggggagtggcccggctctgctgtggagattctggcccaacctcagctccacttgctgggtgatcttggcaaagcactcatgtctctgagcctcaaattcctcacctgcaaaatgatcatcataatagtacctggggtttgggctgctcagaggagtcgataagaccaggcaggtaggggattagctttacgcctgcctcgcccctgaagagtgctcagtaaacaccaatttaggcaggcacggtggctcatgcctgtaatctcagcactttgggaggctgagaagggtggatcacctgaggtcaagagttcgagacctgcctggccaacatggtgaagccccatctctactaaaaatacgaagttagctgggcgtggtggcgtgcacctgtaatcccaactactccggaggctgacacaggagaatcgcttgaacctgggaggcggaggttgcagtgcgctgagatcatgccactgcactccagcctgggtgacagagcgagactccgtctcaaaaaaaaaaaaaaaagaaaagaaaagaaaaggaaaaataacaatttgctttctctctctctctcccaccccccccacccgccctagacacctgggaggaggggcagatgtcccatttaggaccatcacgttcccttcacagatggaaaaactgagggagaggtttccccaagccccacaggaaggggagctgagattaggaacagagttctgggtgtcaggagcttgcctcacggctttgctggtatctaaccatgctttccaaaagggagataagttacccagcccaacaccccgcccccagcccgcacacaggacccagatccctctcccctgcccagccctgcctggcgacctgggatcccctctctggaaggacagtgctgatccactgcactgaacctagcttctggctggatgtgaccgccactcctgtgcagaaggaggcatcttgctttattttccacagcacaaatggtaaccatatataatggcagataccatctataaaacacaactgtttttgtaatgtggtgtttgaagttaaaaattcaaattagagattaattacaacatctagaaggtctgtggctaagacgaccttggggaggaaggctgacacgttcagatttgcagcctggagcattgcaggtgggtactccctgcgtgcctagagcgtgcacatgcactcgcacccacactctgagccagtccccgggctccggcaaagctgggttccatgtggcattggcatccctgggagagctggtttcagtgctggctccttttctgcctaggacactgaggtccaagcaggcatcagagagcaggttccctggttgggtgtgatggctcacacctgtaatcccagcactttgggaggctgaggcgggcggatcacctgaggtcaggtgttcgagaccagcctggccaacatggcaaaaccccgtctctattaaaaatacaaaaattagccaggcatggtggtgtgcacctgtactcccagctactcgggaggctgaggcaggagaattgcttgaacccgggaggtggaggttgtagtgagccaggatcatgccactgcactccagcctgggcgacagagcaagactccatttcaaaaaaaaacagaaagcaggttccttgatgataaagcagccctgggggttgtggatgcggcagcaggtggggagatgcccgtgtctggggcacccagaaaagttgtgaatgtcttggatttgcctccatccggtgccccctctctgctcctccctaaacccgccctccctccaccccccaaaaccagaaccagatggaaacccaaagtgaatagtggatctgaggctggggcagatggtgtgggatgggagccccggtgtggggagtgaaccccattccagaaacactaaaggccaatgcatctccttcggcacagggacagcttggagcccgctgcggaagaacctccaggttctggaggcttctgggctccctggggatcacgggcacatgtttgctgctttattcaaaatggggaaccacagcagtgactggaagcgtatgggctgcctgtggcgccgagaattttcctccctccaccttcccacggtacaggctggtccctgaggaggaggcgtgggtcttaggaggaaagcagctctggggagctgttggccaaatgcccgtggcctcctcctgtgcccgaggtaccccagggagaggaggtccagagtggggccaggatgtcacatggatcccacctggctccctggggcaaggggcttctttccctcaacctcagtttcttggtctgtgaggtggggacggtgacagcacctactcagaggcgtgggtggtgaggatgcagagagataggaagcacttcacaaagtcctggcacagatgtccccgccgctgctgctgtgcgcactatgttactattactgccattgctattattcgcaactcctgtgagggcccctaagagaggaggggctgaggaccagccatacccctggcaaccgcaggcccccaaggacgctcatctccctagcatggggttggagaactgtcccaacccacactagctccatattaaggcaaaaactccactcctccgccccagccccaccctggggcggggtggtgagaatagggacttgtttattcctttgtctcttgactggtccagggtgaagctggagggaggagggcagggagtgtctccaccccctctcagcaatggcttcgcccaatcccggaaacagctcaggtatctgtggccctacccagtctttggcacagcagacaaaagcctgggcctgtggcggggtcaaggacagccccagagaggggctccatcctcaggtcttccagcaccaccatggagaccccagacccgtccctcaatcttcccctccttggccgggcccagtggctcatgcctgtaatcccagcactttgggaggccggagtgggcggatcacctgaggtcaggtgttcgaaaccagcctgaccaacatggtgaaccccccccatctctactaaaaatacaacaattaatccagcatggtggcatgcacctgtagtcccagctactcgggaggctgaggcaggagaattgctagaacctgggaggcgaaggttgcagtgagctgagatggcgccactacactccagcctgggtgagagtgagactctgtctaaaaaaaaaaaaattccctctggctatgccagttcctgccaggccaccattaagtcttatttgggtgaagtcactgcccatcaggaacccctcctgggactcccttcataacagtaattaatcatctcccttttaggaagcccccactacagactaagcacatgacacacacggtctcccctcatctttatagacagatattgacatttccattttagagatgagaaacagaggctccttcctgcagcacatatttcttgagagcccctgctctgtgcaggtcctgggcacacacccacctgccagcccttatcgagcttacaggtaactgataaagacacaggcaggaggccgggcgcggtggctcacgcctgtaatcccagcactttgggaggccgaggtgggcggatcacgaggtcaggagatcgagaccgtcctggctaaaacggtgaaaccctgtctctactaaaaatacaaaaaattagctgggcgtggtgacgggcacctgtagtcccaactactcgggaggctgaggcaggagaatggcgggaacccgggaggcggagcttgcagtgagcagagatcgcgccactgcactccagcatgggcgacagagcgagactccatctcaaaaaaaaataaaaaataaaaaagacacaggcaggtaatttactgcagtgctgttaaattccaccgaagagaagcacaggggcctctggggctcagaggcgggagcgccacccccaggctgcacagccagcacctgcagaggtaaggctaaagcccaggatcagacttcagagccctcctgtccctaccctcttcctgtacaaggctatggctaacgggagcccctcccaacaggctgcagagactcacatcctaaattcgcccagagagggacccatgaccctggaccccatgtggtggaggcagcgatgggagcagaggagagaagattcctgaggcaggtccaccagtccctctggcactgtgctccctgcagacctgggggtgaggggttcctggagtgggagccacactactctagttctgccagggtgaggacaagggtacggttatagttggactttggcattatatcagtcaaggctgtcacctatgatgggtagaagactggtcccagctagcttaagcaaactaggatatatttattagcctaatttagaaatccagggtgggacttcaggcactgctggatccaggcttaagcaatgacactggggcctgggttctctctctctggcttcaccctttcctatagaggagacacacacacagagagagacacacacagatacaacacacacacacacacacacacacacacacacaccccaacagaaaagataccagaaatcacacacacacacacacacacacacacacacacacacacacccacacacaccccaacagaaaagagaccagaaatctccgaaaaagtctcgctgtgccatgattgggtccttacccacttctgaaccaatcatatggccaagagaagtggagtgctgattggccgaggcctgggctgtgtggggtggggcctcagtggcacctctgggacggggaatgtagggaggttgctctccacgtggtgctcctgggtgtaacagaactcacgtttataaaggaagagttctctaaacaggacaagcagtgcttcaggtacatctcatgtattgtctcacctaatcacggagggactgttaattgtgcttgctttatagacgaggcagccaaggctcagagaggtcaagaagctttcccaaggtcaccaagcttgtgggtggagttgagggaactcattccggggttcctgtgtcaatcatgactctcaaagcaaccaggaggcctggacaactgccactgggccacccttccaccatcttgtcccctctaccagggcaggcagtgtgccactgacgcccctcctgccctctccctgggctgagggcatcactctggccagagtgggccccgtgggctgagtggtactcaggaagctgtggaggggtcatcaccaccctacctggttccaagcacaggcctgggaggccagggagcagggcaagttggggtctggctgggcccagggccccctaccagtagcagcatccccctcacgttacattaagcaccatggcaagtatgcggagccaaaagcagggtggactgtggtccgcttgccgtgccatcacaggcagtccacatttcactcactgtttgttcatttcctttttttatttttatttttttgaggcagggtctcactctgttgcccaggctggagtgcagtggcacaatcacagctcactatagcctcaacctcctgggctgttgatcctcccacctcagcctcctgagtagctgggtgacatgtgccaccacccccacctggctaattctttaaattttttgtagagacgagcgtctcgaactgctggacttaagcagtcctcccacctcagcctcccaaagtgttgggactacaggcatgagccactgcgcccggccagtttcccttcttcactgtactttggaactaagttaaaaacaatttccagtctcccattttcctgggcctttaaaaagctccagggccttaggtattatgcacccaaagacttaagggcgtggtttgtgagtcattcattcattcatccatgcagtgtttactgagcaccgacaatgtgccaggcgccactgctgacacagccctgagggcgcagagggaacccggttcttggtgcagtgtaagcaagttgagttagtgatggtggagtggctgggagacgtggccagacccccacgcctttctggaccagtgagggaagggttcctacaggaagtgttgtctaagaagagaggtgagggctgggttgggctttgtgaagaggtgggaaaagtcttccagccagggggaactgcatgtgcaaagactggaagtagcagagtaccagcgtccaaggagcataaggaaggccaggatggcttgtagtgggtggggctcgtagggggcaggggcacccagtgaagctggagggggcaggtcctgggaactagaccctgggctggcatgtaggctccccttctggtgttgctcagaaccagagtcaagacaagggtgaggggagtgagatgcctcaggagcagaggcaaggaggcatcgctgttagggctgggcccatgaggggcgggtatctggatgcagacctccttacttttgttttgtttttgagacttggtcttgctgtgtcgcccaggctggagtgcagtggtgcgatcacagctcactgcagtctccatgtcctgggctcaagtgatccttccgcctcagcctcccaagtagctggccacaggtgcacgctgccacactggctaatttttttaagaggagtcttactgtgttgcccaggctgttcttgagctcctgggctcaagtgattctcccacctcagcctcctaaagctctgggatcacaggcatgagcctcccacctcagcctcctaaagcactgggattacaggctacagccaccacacacagctgaccctcttacttttgcagcctgggtgcctccctcaccttgccccacaccaggacctgctcagaagggggatccctggtcatctgcagcctccggattcgccctcaccaccggccgcccctcctccacccaggcccctcccctcccttccagaaaatactccaatgtccttattttttcgggggagggccttgatgggtccagcgggggagtggggtctgggcagaatgctaatgaaatcagaggagcccgggttgggggcaggccctgggcaggggagaattaagcaattgcaggcaggctcttttccatatttgattggcgctggctgagggacagccacctgcagggaagccccctgcagagggggtgggggagtagtaaaggggacagatctgcttcttcaggtgccctcctcctacttggctgaggcaggctgcaggccgggcatggtgtaatcccagcacattgggaggcctaggtgggaggatcacttggggccaggagttcaagaccagcttaggccacagaatgagatcaccaactctataaaacattaaaaaagaaaaaaagtcggctgcattcaacatgcacagatgcttcatggaaggaaaggggcaaaagtggcctcgaggcctggcaggggtgttgttcagcgggcccctcggggttggtgaggggtgtggagggccccagggacccctgtgagtcctgccacctgaccaccttccaggcatcatctcagaatccttacaatgatccatgagtggctgggaaactgaggcacagagaggaggagccgcgtgccagaggaagggctggcagccactccaccgtcactaactcaacttgcttgcgctgtaccagccggcttccctctgcacactcaaggctgtgtcaacagtggcgcctggcacaagggtggtgctcagtaaatgctgcctggatgaatgaatgagtgactcacaaactatacccttttgatcgctgcgccaactccgtggaattctagcagcctggttggtgtgggaactcatcacacccgagatttggggagcagaaaggtagcatggcccaggagacaagggcaggcagacagactggctcagaccctggccgggcaggcctaggcaggcagcatcagctctctgagcctcagtttctccttttctaaagcaacctgatgacagtagccccctcgcacagtgattgagggtggatgagaaagggctttctggaggtagcggggacagtctgtcactcaggctggagtgcagtggtgcaatcactgctcaccgcagccttgacctcctgggctcaagcggtcctcctgcctaagcctcctgagtagctaggattacaagtgtgcaccaccacgcctggctaacttttatattttttgtagagatgggggtctcactctgtcacccaggctggagtgcagtggtgctatcttggctcactgcaacctccgcctctgggctcaagccatcctcccacctcagcctgccaggtaactgggactacaggcatgccactaccatgcctggctaatttttgtcttttttgtagagatgggggtctcactctgttgcccaagctggtcttgaactcttggactcaagcgatcctcccacctcagcctcctaaaagtgctgggattataggtgtgagtcaccgtgcccggtcaagaaatggctttgaggactgggaagagccccatgatataatgggggtcatttgaagagctaccctggacctgtgtctacagtgtggtctctgatcatgaactccctcccacagtctctgccccaggtgccttcctttccctaccccgcaaacacgcagtagcacactgacctcacgtttctcccaagaagcatcatccacgtcaggacaaggtctcttgactctgaaggagaacagccaggagggctcactgggtccacatttctgtcactctgtctcctgccattcaatggcatgggccccaaagagacacctgaaacctgggagcctagcagagctaggacaggagaccaagcctggaacccagtgtgaggaggctgaagcaaacgtgcacaggggttctgggcatcaggagagggcttttccagttgggtcttgtaggatgagtaggagcccattgtttactctcttcaccagttcacacagcaccaccctctggttgggtggctctaggcctagcatcctcccctctgcggcctcaggcttctcattcatagaatggaaaggaaaggaaagtgtctgtcctgttgctggaatcatacagaatagaatcttttcaggttgggtctcacagaaaagaggtgaagtgtgcacgaggccagaaatgttgtgtgtcgttggctgcgggtaggctcatggcttaggggtgctggtttggcttcatggcacagagagacactcctgtgctcctgaacacactcctgtcttctctccatttctctcctccttcaagcttccctgccttctccacccctaagctcttctctgagctcccagagcacaggggtcttcagtaagaagcctgcctgcttcggctggaatcctgcctctgccacttgtgcaggtcaccatgctccctgagccagggcttcctcgtttggaaaaggggagtaagtgataatgcttgtctctcaggactgccagatttcggtgtgaccaggcatttggcttagtgctccgcttgaaggaattgctccacgcgagttagtggcatccatcatcatttcccattctcccatctcccactgtgcgtgtttgcttgagttatcaccaataccaaccctgtaagtagatgtcgcttttgcagatgaagataccaaggcttatttgggacaagtggtccctggccatagggctgggcctcaactctaggctggtctgatgcgcaaagaccttgcacttggtgtcgccagtgagtggtcctcaaccctggctgcacggtagcatgagctggcgagctttcaatgaatgctgatggccaggcctcactccgaacctgtggagtccgactctccggggtgggggcgggggcttggcatcttattttgcttatttatttatttattgagacggagtcttactctttcgcccaggctggagtgcagtggcacaatcttggctcactgcaacctctgtctcccaggttcaagcgattctcctgcttcagcctcccaagtagctcgtattacaggcgcgcgccatcacgcctggctattttttgtatttttagtagagacggggtttcaccgtgttggccaggatggtctcaatctcttgaccttgtgatccgcccgcctcagcctcccaaagtgctgggatcacaggcgtgagccaccgcgcctggccaatagcatcttatttttaaaggctccaccctctactgctccccagtaatgccccgtgcagctagggccgaggccctgtcccaccctgctgccttcatccctcccaccttacccagcctgtcctcctctccgctgcgatcctctgttttcagggctgcgtcattctctccctgagagttggcctaagagctggggcccgagttttctccaacatgacttttccagccctctgggcacacttttgagggtaacaactcactttagaaaggcccctgctgcccggcgcaggtgatggagttggcacacaggttgtatcacgccaatgggtaggatctgaaccctgatcaaggtacccaggatctggagacctgagagggccctcccaaaggcagcagctctgggggctgctagtccttggacagacatgactagcaccataagtacggtgccagctcttttttttttttttttttttaagacggagtctcgctctgtcacccaggctggagtgcagtggtgcgatctcggctcactgcagtctccgcctcctgggttcaagcgattctcctgcctcagcctcctgagtagctgggattacagatgcctgccaccacttctggctaattttttgtatttttagtagagatggggtttcactatgttgaccaggctggtcttgaactcctgacctcatgatctgcccgccttggcctcccaaagtgctgggattacaggcatgagccaccgcgcccagccagtgccagctcttaactctcaaatgggctctacaccatgaggccatctccaacaaaacacagctgcatatgggtaaggatgagaggagagaggcaaaaataagaccctctcctttaggtgggctgtaaactagagtggtgtgcttgtgcccgcttgtcctactgcacaagagcctattgttaagtttttagaattttggaagctggttgtcaaacacagatattattaaaaattaaggcccggacacagtggcttatgcctgtaatcccagcactttgggaggctgaggcgggtggatcacttgaggtcaggagttcgggaccagcctagacaacatggtgaaaccctgtctctgctaaatatacaaaaaaaaaaaaaaaaattagacacgcgtcatggcgggaacctgtaatcccagctacatgggaggctgaggcaggagaattgcttgaacctgggaggcaggggttgcggtgacccaagatcgcaccattgcacccagcctgcatgacaaagcgactctgtcaaaaaaaaaaaattatataaacttacaatcacagaaattatatttaaaacacaggcaatagatactcagatctcatctctttctcataattttacattttgctgttatttatgcttgaggttatttgcactgtggtatctggatggtaggaataccacacactggtgggctttagggcacctcttctcgatttcgtcttcattgatgttatgttgtggcttgaaattggccatggtagaagtatttataccccagaaattgacaaacactgtaaattaaggatctcctcccccacagagagccagttgtgaaatttattttttaatattcttttccctttttaaatatactttttttttttttttgagacagggtctagctctgtcatccaggctgaagtgcagtggcatgatcacagctcatggcagcctccatctcccgggctcaagccatcctcccacctcagcctccctaacagctgggactacaggcacacaccaccatgctcagctaattaaaaaaattttttttgtagggacagggtgtcactgtgtttgcccagactacaggtatgagccatcgtgcctggcctagacggtacttatttatttatttatttattttatttttgaggcagggtctcactctgtcacccaggctggagtgcaatggtgtgatctcggctcactgcaatctccacctcctgggttcaagcgattctcccacctcagcctcccaagtagctgggactatacaggtacacaccaccacgcctggctagtttttgtatttttttttagaagtgataaggttttgctgtgttgaccaggctggtctcgaactcctgacctaaagtgatctactctcctctgcctcccaaagtgctgggattacaggcatgagccaccacgcctggcctagactttatttttttagagcagttttagattcacagcaaagttgagtggaaagtgcagagattccccatctatctcctgtccccacctccacccccaccatcccccaccagagtgttacattcgttacagtcagtgagcctacagtgacataccatcatcactcaaagtccatagtgtacattggggttccctcttggtgttgttcattctgtggggttagagaaatgcataatgacacggatccaccactgcagtatcacccagagtggcttcactgccctaacagtcccccgggttctgcctcttcatccgtccctcctgcagccctgcaaccactgacccttttactatctccaaagatttgcctttttcagaacgtcatgtggttggaatcatacagtatgtagcctcttgaggttggcttctttcacttagtaaatatccatgtaagtttcttccacattttttcatggttcgatagctccttttttcagtgctgagtaatattcctttgtctggatgtagcacagtttatccattcacctactggaggacgtgttagttgcttctaagttttggcaattatgaacagagctgctataaacatccctgggcaggcctttttgtggacagaagtttccacctcatttgggtaggaaccaaggagtgtgatggccaaatcgtacggtaaaagtatgtttagttttgtaagaaacggccaagctgtcttccaaagtggctgtaccatttcgcattctcgccagcagtggatgagagttcctgttgccccacatcttcgccagcatttggttgtcagtgttctggattctgggcattctaatagccgtgtggtggtatctcactgtagttttaatttgcatttccccagtgatacaagatacggtgtatctttcatatgcttacttgccatctgtctgtctttttggtgaggtgtctgctcagggcttccgtccattttaaaatcaggttgtttataatttaatctgctaaagaagttttctcatggtagatagtcttttaaaaaaaatagattgttctcagctgggtgcggtggctcacacctgtaatcttagcactttgggaggccaaggcgggcggatcacctgaggtcaggagttcaagacaagcctggccaacatggcgaaaccccgtctctactaaaaatacaaaaattagctgggcatggtggtgggtgcctgtaatcccagctacttgggaggctgaggctggagaatcacttgaacccaggaggcagaggttgcagtgagctgagatcacgctattgcactccatccagcctgggcgacaagagcgaaactctgtctcaaaaaaaaaaaaaaaaaagatcgttcttttggggcaaaactcgccttgccatcattactggttaatacagtatttatgtgcaggaggaagaatattgtccctattggaaatatgtccagagaggttggataatttttcctgccaccaccaaggccttggaagagggacgagggtttgcctcctggcaatgccacattgctgcttgtttattttaaaaggcagaattgaacatcattctcttcaaatgtctttctgtggtctatgtggaacttcccaaaatgagcgtgtcaagggacaagggatggtaagacgatgccacacgtgacatagtttgctgtgtccttggaggtagaaagggcccccagcagggagtgaaggcagagtccttgcttggggtttttctgaagctcttcctgagcccatggcagacgaagctcatccaccagagaccctccgaatcctccacaacacagggttctaagcagctactagcaggcgatcaggagtggcagggaaatgacaccatgagccagccccggcctgagtgtgctcaaaaacaccccacgtctcccctttaattttctaagacagtctccctctgtggcccaggctggagtgcggtggcctgatcctggctcactgcaacctctgcctcctggattcaagccattctcctgcctccctggattcaagccattctctcagcctcccgactagccgggactatgggtgtgtgccaccatgcccggctaacttgtgtatttttagtagagatgggtttttgccatgttggctgggccagtctccaactcctgacctcaagtgatccgcccgcctcggcctcccacagtgctgggattatgggcataagccaccgtgtccagcccttcagaagtcccttctgactctgacattctgtgctggctgcctcctggggagaaggtgaagggagattcatgcgtgctcggcagggaggcagcgcggttcaggggttggaagcttgggtgctggaatctggtgcatcaggatgtggatgagtcccagttcttccaccaactggctgtgtggccttagagaagtcacttgaccccacagatcctgtttcttcctcttgttaatacttgcttcctgggtttgcaggtgtgaggattcctccaagctctgtgtgtgtgtgtgtttaaagtacctggcacataggggagtccatggggggcagcggagggagccccattcagaatagtgataaacactatgatgtgtgccatgaccctagtggtccaacgaaggcttcatggctgggccagccttctggcctgggggattcagccaccatcccctctcatcagccccccaagacccacttgcctgcagcttccagatgaaagggctcaccatggaggaggaatggggcgagctgcaggctggctcagaggggtctgggggcagggtcccagtacccactgattaatcttttggggtcacctagcagtccagggagaaccccaacaccccacaggcaagtggctggacctggccaaggccagggcctcatgaagatccagggtcattctagaagttctaggaggattattcccttctccaccccacagtccgtgagtgtggataggtggcccgtaatcaacactccctccagaggtttctggctaagggggacagaggagaggccatggaggagaaggaaaggcaagaggacagagttctgtgacctgaaattgccaccagctgtctttagccccagaggaaactgtcttttcaaagagagaggctgcggaaatggcagatgcttgaagaatcagcttccctccaaattcccggtctcttgctctgggctttacttgaccaatgtgcttctttggtttggtttttatacaccccacagccttgttgtgtttacccccttttcaggcctgctggggaagggctcagtcttagcctggcacagagctgggagccgggccgggagcccccagctggcaggcacctccctttcctggcccacgctgctcttcctccaggcccccgccaccccaaacctttaacaggagacttggctgggaagtcaaaaggactttcccgctgctttcagatgcttaggcacattcaccaggccattatgggcctcactacctttaggcggggaactttttaaaagtgagttttttttctaaaatccagaatttctgacagcccaagttaacaagcccccacaagtgaattcagagagcattaacgggaaagttctaaacagaacctctgctgtcatgtaagcagctcagaaaaaaacactcttctcccattttaagggtgaacatggcactttgatgtggccccatttccttataaagccccctctgagaaggcggaaagctgaagtttaatctggagccaacaaattacttggaatttgcaagcacacatgcttagcccataggagctaaagtccacagtaaaagaaagaaaacgaaaaaaaaaagaaaggtggggtagggagtcacagaaggagagaaagggaggaagacaaaacccacctccactcaccaactggctaagactcagatgtattatcatggaatctagtgtggggggtcctaatgctcacagcccccttttcaaaacgaaaacaagccacatacccctgaatagtagaatggtacttctaaagcagggcaccttggctgggcacggtggctcacgcctggaatcccagcactttgggaggctgaggcggatggatcgcttgagcccaggggttaggcaccagcctgggcaacatggtgaaaccccgtctctacaaaaaatacaaaaattggccaggcgtggtagtgggcgcctgtaatttcagctactctagaggctcaggtgggaggatcgcttaagcctgagagttcaaggctgcagcggagcccagatcgcgccgctgcactccagcctgcgccacagagttagaccctgtctcgaaaaaaataatagtaataataatttttaaaaaatacattttataaagcaaagctaccctcggttcccggtttgataaggggtggattccaaataagcagctgtcttgccgccttgccaagggaaaggagctgggcaaattcctgcagagtccccacaaagcttcactttccccagatgcttgggtgggaggaccctcgctaagggatcaaggttgcaggtgcagagggggtccctgacagagggagggcaagggaggggcgccccgggtgaaggtgactttgagttccaggtgtgtgggctagcagttgaagagggggtgcagcgcggacccccctggggccagagtccgatagaccagctgaatggccgctctgcagctttctcgctgtgtgaccttgggcgactgacctccctccctagtctcggttatcccgactgttaaacggggacggtagcagcagtacctgcctcatagggttaccgtgtgtggagacacgcccataggcgcccggcccggcctggcccttagccttggccttggccggagctggacacgtaggaactgcctttgtcactaatcgggggttggattcccttgcactcggtgccaggataggaaagagcagtcagtcctggctcccacccgggacctgcctggagagcgggagtggagagggaggtgtctgagctggaaggaaggcgaggagggagctggctgggctgcaggggagcgctgcgtcccgctccccctcccctaggccgtgccccctcccgcccggccggggcgcgcaccctcggagcagctgggcggcggcggcgcgggcagcgcggggctgggcgcgggatctattaacgtctgtgtgtctgggccgcgggactgcggcgaggcaggcgccaggggctcgtctggaaccagatgtgccgcggcgccgctctggccgccaccagcgcggcgcgctcgcacgcactggctggcgcgcacatggccgggctgggcggcggcggctggcgcgccggccctggcatcccctggatttcggaccgaccccagacccgcgcgtgcggaggggagacccccgcccagcaagccagctccccgtccagatgggaaagccacccacgagacgggtggggtccgcctcgcccctcggccctgtcccgggggagggaaagatggcttctcagaaacctgcccccctgctagcgcccccgctgtctccaccccacaaagggctggggacgcttccccgccccccgaagtttgttttcctaagtttgtgcgtaagatttttcaaaattctgagtcagagcttcccctaagatgaggcctttggggcatgcgagaaacgccaaaatgtgggtgggggaggggagcgtggaggttggagggttttaagcgccgggattcggaagggggcttttcacccactgggtgagtacaagggcttcattgaggccggtcccagctccgcaccaaatctgtcttaaccacaaggtggtccctggtcctggctgctgtcagcaccgagccttcccgtccccaggcagcttcggggtgctctgcctttctggaccagccccttcagctctctgggccccctcgcagggcctataaagtgagcagtggagctgggagctcccagcaggggagcttaggagaaatgggtggttggatggggcgggggggggggggggcgggggcacttaggctctgtctccatggttctccaccaaaaggaagcgtaagaccaggcggtggtgctgccaggccgggctgggccaggccaacccagtctggctgcagagaagagggcttgcccagggcttgggactcagcagttccccgagttccccctggtgtgcagcccttccccatgatcgggaggagggtgtttggtgaaacacacgtggcaagagcgggtttttcccgccacgcctgccttccttgttccggaaaaggggagctgggatgctgggtagggtgggggtgtcagccatgcacatcaactcagagactaatccctgctaggcgcgtgtgggcagaggttgagacaacccagactgggcagccaaggctttggccatttgtcagtactgggtggacgccccctcacgtcactacctcacgtcactaccatcccatctgaggccctatgggcccacttcacagggaaacaggcccagagaggagcggtcacaggctcaaagtcacagagctgggatgtggagaaggtaggattcccaccctgcctgctggactccagagatgaaaccttgggcttgggatcaaatcttcctggtgtctggaggctcaggaaacaaggtggttcgttcctaaactctaggaagtagagggaggatgctggcccagctggagggccatcaggatagcctgactgtcccttccctcccagggcatgctggaggcccttccccacaggaaggccgctgtgcctgttcctctgactatgagcaccagcaaagccaggctgaagcatttccctgtgggaggtgatttccctagcccatgctctggcctgtcaattaaaaaaatccatcaataggctgggcgcagtggctcacgcccataatcccagaactttgggaggccaaggtgggcagatcacttgaggtcaggagttcgagaccagcctggccaacatggtgaaacctcgtctaaaatatatacacacaaaattagctgggcgtggtggtgcgcacctgtaatcccagttgcttgggaggctgaggtgggagaaacacttaaacccaggaggtggaagttgcagtgagccgagatcacgccattgcactgcagcctgggcaacagggcaagactctgtctcaaaaaaaatatatatatgtgtgtgtgtgtgtgtgtgtgtgtgtgtgtgtatacatatatccatcaatatattagtttctgcagataggagggtccagaagtgagaaggcttgtaatggtgtatagtgcatacaaattttcaggtgtttgggcaagcagagaattgagattatgttcccatcaggagccaaaatccattcattcattcacttacatattcattcagtatttattgaggacctgctatgcatccgcccggaataaagaatatccagtgtgtgactgtgccatggctttctacatggtccagcccagctttctgggaagcatccacgaaggatgaattctttccttgggcaccttcagggcagcctctgctctgtgtgtgtcagtgcaagctttggggaggaagtgtcccagggagcagagaacttggtctctgaggcaccgacagcagctgttcaggagagagacctcagcgtgccaggcacatggttgcttctgcctctcagcatcccaagtctccaccagacagttacaaaccgaggtctagagaggttcagtaaattgcctcaaagctgcacagccaatatacagcaagtgtgggaggggaatgcacacgcacctaactccagataaatatactaatggctaacgtgatttagcacttactacgtgccaggcactgctttaagaaccttatatatatattctttcatttaattttcacaacaactctgggaggaagatcttgttatccccattttctggatgggataactgaagcacagagaggttgtaacttcctcagggtcacacagcagtgaagttgggatttgaacttaggcagcctgccgccagggtccagctcttcctcagtggggtgctgtatttttttttggtttgttgttgttgttggctttttttttttttttagatgaagcctcgctctgtcgcccaggctggagtgcagtggcgcaatctcggctctccgcctcccaggttcaagcgattctcttgcctcaggctcctgagtagctgggagtacaggcacatgccaccaagcccggctaatttttgtatttttagtagtgacggggtttcaccatggtggccaggctggtcttgaactcctgccttcaagtgatctgcccgcctccgcctcccaaagtgctgggattgcagagccacacctggccgttattgttgttttgagacagggtctgaacctgtcacccaggctggagtgcagtggcacaattgtggctcactgtgaccttcatctcccgggctcaagtgatcctcccacttcagcctcctgagttgctgggactacaggtgcgtgccaccatgcccggctaatgttttaattttttgtaaaggtgggggttttgccatgttgtccaggctggtcccaaactcctggcctgaagcgatccacccgcctcagcctcccaaagtgctgggattacaggcgtgagccacggtgcttagccagtacgccaccttttgtgggctggcctgttctgaccaacttggtagcaaaaaggttccttctggagaggagagcgctgttggaagaacttatgtgaaggatttggggtcttgaaatccagcagaaggacaaagaaatgagacatttttcacagtgtttacaatagaggaaaatcgcaagagacctaaatatcccacaagaggggaagggctgtgaggccgttttggcatccccactaggggaagtgatgcagccgctcacactaacgtgaggaagaagataggaaacagagcagagggtttaggatggagcttgagggaccatcgttcactgtgtgtcgctcacagcgggaagcagtctacctgcaccatcacattgacttcgcttcataaaatggtgaggtcatggcagtcaccaacgcgatagctgatgttacttgaccactaactgggtgccaggtattgtcgaggcactttaggtgttgctgttcccacttacagtggggacactgagtctcacagagctcacagagctggcatggaaagccagaaccagaatgcagctatttccaggaaagcgggatatggttgggcaggttgtccactgcataactgcaggggacaccagtcacactggagtctgtgggaatggcacccctgaagttgtacagtgcacagcctgtgcaaccatacgcagcatccctgggtgtgtctgatcacaatcctaggctcttaatccatgccccatccaaaacagaaaatgatattcatgcacactgtaaatggagtcatgtgatagctagatacatgtggacatgcaacaaaaagtatgcaaagaattaaacagatatgctgttgtcgtgggatttgtaggagatttttttcctttcaaatgtccttaggccaggcgcagtggctcacgcctgtaatcccacactttaggaggccaaggcaggcggatcacttgaggtcaggagttggagaccagcctggccaacatggtgaaaccccatccatactaaaaatacaaaaaaattagtcaggcctgatgccgggtgcctgtaatgccagctactcaggaggctgaggcaggagaatcgcttgaacccgggaggcagaggctgccctgagccaggatcgcaccactgcactccagcctgggcgacagagtgaaactccgtctcaaaactttctacaactgccaggcgcggtggctcacacctgtaatcccagcactttgggaggctgaggcgggtggatcacgaggtcaggagatcgagaacatcctggctaacacggtgaaaccctgtctctactaaaaatacaaaagcattagctgggcatggtggtgggcgcctgtagtcccagctactcgggaggctgaggcaggagaatggcgtgaacccgggaggcggagcttgcaatgagcagagatcgcgctactgcactccagcctgggcgacagagcgagactccgtctcaaaaaaaaaaaaaaaactttctagaactctctgtgatgatgaaaatgtttcctatctgtgctgtccaatgtggcggccactggccatgtgtggatattgagcccttgaaatgtggcctgttcgactgaggaatggaatttgtatttttatttcattttaatcagtgagaatttcattgagatggccacgtgcagctcgttgctcccacgttggacggtacagagctagagtgtggactggtgtctttcagtctgagccatgtcattcccagatgtctgctctgaagcttgtggttcctgaacttgcgggtgagggagtgtctactgcagattcccagctggacccttgagatgggagtgtctggctttaacaagcttcccggggaattcccaggcaaattgtcagtggactcccttttaagaaatgcggaagatgtggtgccagcctcttcacgtggcaaagtgtggcaaggggggcggggcagctcccagagctgtggctgaaatcaccagaacagctgccctcagaggctagcaagggggtcgttgaggaatagagtcctgtgtgctgcccttcaaagtgtaaacacagcatgtcgtggggaccacagggaggtggactaggacctactgtaatggagaattttctagagccagggttggctgttgtgtgaggatgtgattggaaacatgctggagatgtcgaagatggccccgtgcccagactctgagcatgcaccccactggtgaggctgtcctgggtggggcacagcagctggtgggtacctggtggaggctgagacatagcaggggagccaggtgggtgggtgtgggccgagcattccgacttgttcgggtagagaggggtggccaattaagccgcaggagtctgaacggtctctgcgcctggccaccagcacttgccctggcttccctgcaggtcctggctgcagactatgagcagcccaggagctcttaaatggggaagagctcatttcccacatgggacccttagcagcaacttcgcctggtctggaaatggttaacttttccaagggcagctttcatccagataccagccactttggggacagagtctggacataaatcacccctgatcactggcagtggtacctgggtttggtactttacctctctgaatctcattgcccctgactgtgaacagggcttaataacagtaccctctgcattgtacgacgcagggctccataacccagtgccaggcgcataataaagtgggttaaatggaaaccaaaaaagaaaaaaaattaagggtgtggaagaagtccttctcgcctcaccacagtcccatgctgcggtgaggggcgcggcagaaacactcaggacgccattggagctttgccgagcaaggctcagactcacattttccagcactgcccggaactcacaaatgggtcatagaaacctccagcgatgtttaaagttgagcctctctgggaatgcagcactgcccagagccaggggcacggcaggtcccgtcagcctcgcaggcactgcccttgtctgggctgctcgccatgaagggctggccaggggaccccaagagggggcagaggggcaggttcttccaggacagagagaactgactttccatggagctggtgctttagggtggggtctgtggacaggattcaaagtgtgtgaaccacctctccgtacaacattgcatgcaaacttttctgcacgcctgtgtttttctagggaatggttcgtagagttcctcagagttctcaaggggggttcatgattaaagtggggaagaaccaccaggccaggcctagccttcatatgggatgaataatagtggggttagcagtcatttctggagcaccacgttaagcatgtccttgggagagccctgggccacgccatcctcactgagccacctgagagggagggagagatactgttttgtcccaatacagatggtgaaaccaagaatccaagaggagagacctcttgtctgaggacacacgggggcaatttttctcattctcagatgctcagggcaggcaggcgtttgctatctgggtgggctgctggtagcccccctaacccaattgctgggttgggaatattctctcctgcatcctcccaggaaacccgggaacagagatgggagcaggaaggaagcgcatgtgtgtctgcaggcagcacatctcagcagacagaacttggggttccactgccttgctgtgagtgcgtggccgagtcactgcccctccaggcctcagttttcctatcagcaaaatgaggggtcttgacagatgacctctaaagtcccttcagaccctgagtcctcgagacgacaagaatgacaggtttgagaccgcagagctgtttgcaggtttgttgcaaaaccaagccacacgaagtcaacatctttgtgcctgggccccagccctcaccccaagttcccaactggctctgggctttaggaggcccaggagctcttaaatgggagagaaaaacccaccttgggccctgagcagaaaacttcatcgtggtctggaaacagttaacgagggcagctttcctcccgataccagcgccttattaaaatgtaggctttacaataaacctggcatttggccatcaaccttagattaaaaccagacgggacagacatgaacccctctcttagaccaaatttcgagcagagggctgctccccttcctcctgggtgactccctgcctcccacccaccccgcaccccattccaacaggtgcccccctctctagagcttagttttggggtctcaggaatagagagactgagctggacttgggacccccagctcctagtgcagagggaggtagtcaggcaccaaaacgcaggggctgagggatatgaggggaggctcctgctagggccacgctggggagccagggcctcagagccactcggctgcatctggccttggcccccctggccctttgattgcctgtgaacaggaggcaaatggagttcagtggcttgatcctggcccacggcaacctccgcctcccgggttcaagcaattctcctgcctcagcctcccgggtagctgggattacaggcaggtgccaccatgcccggctaatttttgtatttttagtagagacagggtttcaccatgttggccagactggtcttgaactcctgacctctggtgatctgcccgcctcggcctcccaaagtgctgggattacaagcacgagccactgtgcctggccctgaagactccttttctcaaggatgcctgggctcagaagaacttttggcctcacctgtccccaaccctggctccccgctaccgttagcctgctgctgtgaccgcgccgcatggggacattctgtgcgagagccactccctggctgggcacggtggctcatgcctgtaatcccagcactttgggaggccgaggcaggtggatcgcctgaggtcaggagttcaagagccactcctgctggctctctcactgagggttccccaaagaccctaacccagaggcccctgacctcttggggcctccccggcaccccagcccacctcactcctcaccccctgtcacctcactacctgtggcacccccagagactcaggagatatcctttgcttgccattctctccaatctcaatgcttctcttgacaccacctcctttttctgtgtgtttttaggaataattttatttcgtatatttcacatactgtacaatcacccatttaaagtgcacagtccagggccggatgtggtggctcacacctataatcccagtgctttgggaggccaaggtaggaggatcacttgaggccatgagtttgagaccaggctggacaacatagtgagactcccatctctacacaaaaatttttttttcccaggcgcggtggctcacacctgtaatcccagcactttgggagaccgaggggggcagatcatttgaggtcaggagcaacccggtaaaaccctgtctctaccaaaaatacaaaagttaacagacgtggtggcatgcgcctgtaatcccagctactcgggaggctgaggcaagagaatcgcttgaacctgggaggcggaggttgcagtgggccaagttcacgccactgcactccagcctgggcgacagagtgaaactccatctcaaaaaaaaaaaaataattatttgagcatggtggcgcatgcctgtagttccagctactggggaggctgaggtgggaggatcacttgagcctaggagttcgaggctgcagtaagccatgatcgcaaaactgcactctagcctgagtgcagaggaagaccatctcaaaaaataaaattaaattagaaagataaaatgtgcagtccagtgattttttagtatattcagttgtacaaccatcatcacaataaatattaaaacattttcatacccccaaaagaagccctgcactttttagctgtcactctccagcatcctcactgcagtccccccagccccagcagctgccagtctacctccatctctatggatttgcctattctggacatttcatataaaagaaatcattcactagggcctggtgcagtggctcacgcctataatcccagcactttgggaggcaaaggcgggcagatcacttgaggtcaagagttcgagattagcctggccaacatggtgaaaccccatctctactaaaaatacaaaaattagccaggcatggtggctggcacctgtaatctcagctacttgggaagctgaggcaggagaatcgcttgaacccaggaggcagaggttgcagtgagctgagatggcgccactgcactccagcctgggcaacataatgagtgagattctgtctcaaaaaataaataaataaataaataaaagaaatcatgcactatatattcccttctggctggctgctttgatttagcatcatgttttcaaggttaacccacagttaccatctctaagtgtttcatttatttttattgctgaatactattccattgcatgaatgggccacattttatttattcattcaccagttgaaggacatgtgggttgctttcactttttggctattataaataatgctgctatggccgggcgcggtggctcacacgtgtaatcccagtactttgggaggccaaggctggtctggtgggtcacctgaggtcaggagttcgagaccagcctggccaacatggtgaaaccccgtctctactaaaaatacaaaaattaacccggtacggtgatgtgcgcctgtagtcccagctaccagggaggctgaggcaggagaattgcttgaacccaggaggaggaggttgcagtgagccgagatcgtgccactgcactccagcctgggtgacagagggagactgtgtctcaaaaaaaaaaaaaaatgctgctatggacatatgtcattgtgtacaggtttttgtgtggacacatgtttcatttctcctgcgtctgtacctaagagtggaattgctgggtcagatggtaagtctatgtttcaccttgtgagcaactcccagactgttttccacagcagctgtaccttgcattcccaccagcagtgtatgagggttctagtttctccacttcctggccagcacttggtgttatcaggccacctgccctggctcagcctactggagtctcgctctgttgcccaggctagagtgcagtgcgtgatctcggctcactgcaacctccacctcccaggttcaagccattctcctgcctcagcctcccgagtaactgggatttcaggtacctgccaccacgcctggctaatttttgtattttcaatagagacggagtttcaccatgttggtcaggctggtctcgaactcctgacctcaagcagtccacctgcctcggcctctgaaagtgctgggcttaaacaggcctgagccaccatgcacggccgttatctgtcttttgattctaactatcctagtgggtgtgaagtctgtctcatcatggttttgatttgcatttccctgctggctgatgattttgagcgtctttctgcctattggtcatttgtgtattttctttagagaaatgtctactcaaatccttcactcatttttaaattgggatatttgtctttttattgagctgtaagggttctttatattttctaaacataagtcccttaccaaatatgtaatgtgtaaataatttttctattctgtgggttgtcttttcagtttcttaatggttataacagttacaaaactgtttagttttcatgaagttccatttatctttttttctgtagttgcttgtgtttttgatgtcacatctaacagccatcgtctggcccttttgaagataaagggacctggctttggaagttgagacttcagatccttttctggagtgagccgctccttcatttacatagtcattcattcagaaatatttttgaaaccaaacttcttgcctggtcctggggatacagcattgacaaggaaaacccaggccctgcccgtctggatcttagagtcaaatgtgggatagacaggcatgaagcagataacccaaacacgtcatttctctgttttagttaattgcagatgtgcaggagagggagaaggcctaggagtccataacaaggagacctgcgcttgtatgggagccgggaaggcctctcagggctgggcatgtaggctgaaatccagggctgggtcagctttagccagtgcggtggggatgggggaagggtgccctagctagagggaacagcagataccaaggcccagaggtgggaaggtgcttgtgctcccttccaggggcagctcctgctgggtcactggcccctccgctttcttgtgggtctggtggccccatggaaatgtgtgcatgtcatgtatttaggggtgaggctcccgaccccagagagacccagatacaccgcaactgcctccaagcagggctctgctgaggtttgtgggggacatgagggaacctcctccagcctcctccaaactccagggtcatcctgagcctgcggaggccacactagccaccattcttgcagccacactggctaccggcccccagggctgggagcaggtcagagcacggcagtcccaggttgggtggcccatgcctctcgctcttgtgtgctgtgccgaggccggggaagccatgggatggggccccctggggacctgtctgactcctcgggccccactgcggcttccatcatcaccttccttcccgggatgtgtttctccttctccaggctggtagctataaaaatgtgtcagcgtcacgggtttttgttcaaaattaatgaggtgaaacattcttaaaagtgtggcagggcagtggctggtggtggccggcctcccccagcctcttcctcactcggaggacgtgtcctcaccaggcctccatggctccaggggaggaacctagacccctgcacaggagggcgggctctgcaggctcacccggcccttcccatgcctccccttcactcaacactcagcactcaacacagattgatgagaggttccctgtgccagcccctgtgatgcattccaaggagacagaaaacagtaagtcccagcccctactggaccgatgaccccacacttaccctacagtataacagagctacaatgggagaggcacagggctttttgggagcttaagcctgtgggtccaggagggcttcttggaggaggaggcatctctgctgagacctgaaagtgagcaagagagggaggagacgttgccagctcaggcaggggtccatggtgagagggcgtggtgtgtgtgatgcaagcagtgaccccaaagaggcagggacctggaacagcggccgggcagccctgaggccacctgccctggctctgcctactggagtggcctaggtggccccatccagcaatggtccagggaggtgaagatggacctgtgccttgtaactggcaccagaggacccaagaccctcctttgtgccttacacctggtccctgaatttctggggttgaggccagcttggcctgattgaaagctagcttggccgggcgcggtggctcacacctgtaatcccagcactttgggaggctgaggcgggtggaccacaaggtcaagagatcgagaccatcctggccaacatggtgaaaccccgtctctactaaaaatacaaaaaattagctgggtgtggtggcaggcacttgtagtcccaactactcgggaggctgaagcaggagaatcgtttgaacctgggaggcggagattgcagtgagcagagatcgcgccagtgcactccagcctggtaacagagtgagactccatctcaaaaaacaaaacaaaacgaaagtcagctcttgggccccttggtcggggtgctggctggggcagggctgcactcctggggttggaacagcctagaagccccgggatccttctccatgaggccccagggaccatgtttcttctcctctatcctcccttctccccttccttcttttctgtcttcacatgttgttgagctctctctgtgcccggcctgactgtggcccaccctcacagggcttggggctgggcctgcacacatccttaatcctcgctgccctgctgcctgtgtgcctgaagccacatgctgcagccccaagaatgtttctgttgccttcagcctccctcctttttgttgatccatacactgttaagccaccagggagacccccagaatcccagcaccacgaggatcttggggctggcttcccatgccgaggtgactcaggcagcagtgtggggaagtggctaagaccccggactgtgtgctgctctctgagttccaatcccagctctggtctttcctggtcatgtggcatcagtatgtcatttaactctctgttcctcagtttcctcctacgtaaaatggaactaggagccagccgtgttgggttgttatgagggttaaatgaggtagatcctgttattcccatttttcaggtgagattctcttttttttttttttttttttttttgagacagagtcttgcttcgttgcccaggctggagtgcagtgacatgatctcggctcactgcaacctccacctcccgggtttaagcaattctcatgccccagcctcccaagtagctgggattataggtgcacaccaccacacccagttaatttttttgtacttttagtagagaccggggtttcaccatgttggccgggctggtctcaaactcctgacctcaggcattccactcgcctcggcctcccaaagtgctgggattacaggcatgagccacggcgcccggcctcaggtgagattcttgaggctgggagcggttaaaggttcacccacggcactctgctagtgaggcggaccggcctgagagccagacccggaccggccacctccttaaccagtaggcggtactgccttccattccttactgggggaggtgagaatcctccctcaagcctccctcagggccacttgtgtccttgctgatgatgccaggcagtggctaaggatgtggtttcagagttcctgtctgagcccttctcccaggggcccttcaaaggaacccaaatctctaccaagaaatctcagggggaaaccgaagcctccacggcctctccaccctaccccacctccacttcttgcctaagacgttccaggctgtaaatatttctccagctccgaggctcctctgagaaggcccagtgttaatttgttaaatccacatcgaggtcccaaggacccgttgtttgtttttgcgatcctgttggcagagatcacgttgggggtggtgaggagggctgcttatttgctcagaataaatgctaattaataaaagttatttatttgggttggagctcacctcagcccgggggtcaggcgcaaactgactatttgaagcaaaaacaaatagagtgtgtctctcaacagcttgagaaaggcaggaacgaagaggctgagtttatttgtcttaggaagaatctgcagttaattccctccagactatttagacccttaaattacacggaataagaaaaaccataggcacaggggagggcggtgggaacacttgatcatttggctgagagcagagtttttaaatgcctttggcccccagtcagccaactaaatggtacgtgtgaaataatttaatggcagaaaaccgtgcaccagtcattttttcactgtaatgtaatcggggacgatgtcgttttggttttaaggaggagacagcgcgagacaggcctcccccatctgagctcgtttctctcctctgggatccaggccccctacaaaagcagctaaacagcctggtcaaagggaggcggtttcatgctttgtttcagtctcagggaaaagcagaacttttcctgaacaaaaagagactctgggcacggccctccttggagagtgcagacgcagggtttgctgaccggaggagagggcccccgtgaaaaggcagggacctgacgccagtggcctgaggcttagagagtatttattttattgatttcctaaatgctttaagcccaagcacggagtccccagaggaacacacacgcccaccacaatgcatttctcaggaggtgattcaggaacttagggcaacaaatatccggcacatccgctcggaggcggaggcgagcgccagagcccccggctaagtccagagctgtgggttcgagttctggtccgcggggaggtgctgcctgggtcctcctccccgtccgcgttccttcccagcctcagcccacggcaggggtgcagccccatctttctgctgtaggctgggctacagggacgaaaggatcatggagaaaggtccttgtcttctcatacagagctggctgcacaaaagcaatcatgttaaggggagtgaacatttattgagcaattactatgtccttggcactgagctacactcaactcctcacagcagcttggtgtgtccttcagcaaggtgctatcccacaccctcccaggggtgagggcttcctttaggacgaagaggtgacgtgaggctggaggcctcccaccatggcatctcctgaccccgcccacccatgggatcagagagctgggactgagcgtgtgacaggccccctacgctgctgagcctgggagcgaggtagaagagggaggaggccccgtgaagaggggttcgcagccttggcttggccaggcctcccagcagacatcgatttcttccttttttttctttcttttttttttttagacggaatttcactcttgttgcccagactggagtgcaatggcgtgatctcagctcactgcaacctccgcctgccgggttcaagtgattctcctgcctcggcctcctgagtagctggaattacaggtgcccgccaccatgcctggctaatttatttatttatttatttatttttagtagagatggggtttcaccatgttggccaggctagtcttgatctcctgacctcaggtgttccgcctgcctcgacctcccaaagtgctgggattataggcatgagccactgcacctggccaacagacatcgatttcaatcccagatgtacgacgttgggcaagccactctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtaggagaatcgcttgaacccaggagccggagttgcagtgagccgagatcgtgccactgtactccagcctataatcccagctgctctggaggctgaggtagcagaatcgcttgaacccaggaggcagaggttgcagtgagccgagatcgcaccactgcactccagcctgggggacagagcgatactctgtctcaaaaaaaaaaaaaaaaagtaataaaataaaataaaatggcacagtgcctcctagggtggatgcaggggacggtgggtggccacacgtggagcacttggcaccactcctgtcccaaccggctctggctgagcgcatcccatcacagctgccttggcacgaccctgggcagagctgacttgggaagcagtgaggacgccagccagtgttgggggcggtctggggctggctggggtgggggtaaatgcctctgcatgaggattttggctccatgtcgccacacagcttaactggcatgaaagtggagctgtttcttcgggcgcttactcggcaaggcgaaggctgcaaaatggttttcatttaaacacccccaggtttgaattgctcagaaacttcccgaaaatgtctccttttttggctgaaatgcctcctgtgttgggtgtgtgcccaagaggaactgcctgaaggggggtggaaatgacccctgcaatgactggctttccagaaacttccatccctgctttcaggctattgatcaccacccagttttcagcgcaagggctcttgtttcggtttaaagtttcttcctcatcgaggtggtgggggtggaaagacattcacaggcagcagacattctcatccatcctcgcctttgcttgaggagtgaagagtgaagcggtcccggcaatgagaccagctccacagggccaccacgtgctccctccccactgcccccacagcccccgcctggtcccgtatgtttgcaagtatttcccaaagggggaaacttctgaacataacctcctagtcatccctctaaaccagggtttctcaacctcagtgccattgacattttggacaagataattcattgacgtgggggcctgtcctgtgtcttgaaagatatttagcaaggccaagcatggtggctcgtgcctgtaatcccagtactttgggaggctgaggcaggagaattgaggtcaggagtttaagaccagtcttggcaacatagtaagacctcatctctacattaaaataaaaatcagctgggcatggtggcaggcacctgtagtcccagctacttgggaggctgaggtgggggaattgcttgagcccaggaggtcgaggctgcagtgtgttacgattgcgccactgcactccagcttgggcaacagagtgagaccctgtctcaaaaaataaaaaagatatttagcagcactcctggcctctttaccattagatcctagtagcaccccttccccagtcctaacgatcaaaaatgtctcacaggggcaaaattgccctcggttgagaagcagtggtccaaacccagcttcagggacatctttctcacacacacacacacacacacacacacacacacacacacactcatttacagtctcatggagcaatttaaccttacatcaaatcagttggttgctcaagagtcagtaaaccctcctaacctgggaactgattaaaagcagatattcagcagtacccatcactgggcctggcatgttctagaagctcagtaacagttcactgaacaaatgcccagtactgtgcaaagaacatcgggtgtaaaatgggaacatgtaactggggaaacaaaaatacaaggtatggactaaaatccaaagctcttctgttggccaaactgtaggcaaaacacgtcgccccaaacccggccggtgggaatgcaaaataagaccagttatacgagggaatttggccacatctagcattcactcattggcccagaaattccacttctaggaatctgtcctaaatatacactggcaaaaatagaaaatcatatttgcatgaggttatgcattgtggcattcttctagttccaagagattggaaaccctccaaatgcccatcaatagggctctggttgaataaacacagcagagtcacatggtagactgctatgcagctgtgaaaaggaacatgaagggctccggtgtgctgaatgggggaatccctgggaaatatcgttaggtggggcaaaaagtgaacagtacatactatgctttctttctttttttttttttttttgagacaagagtctcactctgtcgcccaggctggagtgcagtggtacggtaccggctcatagcaacctccaccccacaggttcaagtgattctcctgcctcagcctccagagtagctgggattacaggcatgcaccaccacacttggctaatttttgtatttttagtagagactgggttttgccatgttgcccaggctggtcttgaactcctgacctcaggtgatccacctgcctcggcctcccaaagtgctgggattacaggcatgagccaccgtgcctggccgctatgctttcttttgatagaagaaagggagaaaatattacacatattttgttatatttgcaaaaagcaatgctggagggataaaggaagaactaactcttaaaatggttcctgaaggtaggggagagggaacaagagggaaaatacattttggaaaaacaatcgcaataaagatggttaggtttgtttcactaagatggaaaggtatccagaatattattaaataaaaagaggtaagttgaagccccagtgtgtgcttgtcaatttttaattttatttttaaattttatttatttatttatttatttttgagacagagtattgctctgtcacccaggctggagtgcagtggcataatcttggctcactgcaacctcagcctcctgggtttaagcgattcttgtgcctcagcctctggagtaactgggattccagacacttgtgaccatgcctggctaatttcttttgtctttgtctttgttttgttttgtttttagtagagatggggtttcaccatattgcccaggctggtgtcaaaatcctggcctcaagtaatccacctgcctcagcgtcccaaagtgatgggannnnnnnnnnnnnnnnnnnnttgcagtgagccaagtatcatgccactgtactccagcctggaggacagaacaagactccgcctcaaaaaaaaaaaaaaaagaaaaagaaaaaagaaagaaaatgtggggagtgggataggggaggggagagtattttgttttactttatacccatctgtgttgtttgaatctgttactgtgacaagcagtgtgattacttggttattaaaatacacatttttaatgagaaaaaatcagatacaaaagaagtgctgaaccggcagcattagttgattctaagtgctggagggaagggggtttggttccatgtggactcaggtgatcagggagggccccctggaggagtggacaataggctgagccctagaggatgaagggtcagaggtgcccttggataaagtttaaatgtggaaatagtagctggacgcccccccaccccctcccccaaggtacaggctgggcccagaggttgccactccaggacctccccagggttctgctgggccctccttaccagagctgctagttctgtaccacaggccagcaccaccctcggtcaggtcccctgctgggatcctccaccgcccctgctgggccttggctggacaccctccctcactctctaactgattggagaactcttggggatccttcaaaccctttgcaagctccacctctcctgaggggcctccccggccagctcctcatccccaccagagctgagcatcctcccgtgccctggcccacacctgccctgacccaccccacggccccaccaaagcttattcggggcctgcctcccctgccgatggatccctctggttcgtctctccccggcccccagtacagcctctggcctagtaggccctctggaaaggaaggctgctctcaacagctgcctgattggctaaaaaggagaagatgaggactctcgtacccgattggtgggttcagatccttccaccaacaatgactccactgggaccttgaacttgggcccgagaccatagcctctctgactcttcctccttaggaatgatgaggatcacgacatctgtctttagggctcctgggagcttcctagaatctgtgggtcctgagccttgactcccactgctctttatgacatattaattattattattattacatgtcagcaacaggtgtccatgcagaatgtgccatgccccacagcctgggccgggtgctggggacactcaggtgtctcctgagccctccttgagcaggtcacttgtccctggtggaagggacacctgtccccagggctcttgccgtggtcccatctcagttggctcagactggggtttccacagggcaggggtgtggctgcttttgttctccgttatctccccggagtctagcactgggcctgccacacaggtgctcagtaaatacgtgttgaagagtgaatggatgggtggatgccagaaggaaggaatgagggagtgaattaaagggacgcattcctggcggcggcactaaagcactcagagcaaactgcagagttgggggctgaactgtgactgtagccactggccgtcctgctgaccatcccgcccccccaacctccgcaggtgagtgtcccagcccggggcgcggtagcgccgccaagcggaagaagaagcagcggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtgagcgctcagtcccgggcctcccgtgggagcgtgcgcgtgggagcgcacagccactgttcacccgggattacacagttgcccaggaggggtgtttgagcaggagcatctgaggccaggaggacgggggttcagatcccagccctgccacttactggctgtgtgcccttgagcaagtgacttaagctgtctgtgctgcaggcacctgcctacctggaaaatgaggatcacgtaggtctttgctataggggtccttcgaggattagagttaaaattttcataaagcggccaggcacagtggcttatgcctataatcccagcactttgagaggccgaggtgggtggatcacttgaggctaggaatttgagaccagcctggccaacataatgaaaccccatctttactaaaagtacaaaaattatccgggcgtgctggcgcgcgcctgtaatcccagctgcttgggtggctgaggcaggagaatcgcttgaactcgggaggtagaggttgcagtaagctgagattgcgccactgcactccagcctgggtgacagagtgagaccctgtctcaataaataaacaaacaaacaaacaaataaaaataaattttcgtaaagcgcttagaacaatgcctggcaccaagggttctgataaagaagtccttttccagtttcaagttcttaactctgtgccagcactgagccgagtgctcagcaagcgcctctccccgcgagtcctcagcaagcgcctctccccgcgagtcctcagcaagcgcctctccccgcgagtgctcagcaagcccctctccccgcgagtgctcagcaagagcctctccccccgagtgctcagcaagcgcctctccccccgagtgctcagcaagcgcctttccccgcgagtgctcagcaagcacctcgctcccagtggccgagtgcctctccattcgttctcattctccaacacattctccattcattctccattcattggtgttctcaatctccaacacatacccagcagcaggcgtcatttgtcatccccattctacagatgaaaaaactgagggtcagagaggtgacgctgccagccctgggctggtgacagagcaggcacacacccaggtccagaaggacttgggtcccccctgcccatgctgcaccctgctcaccctcccacccacaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtccagattatctctcctggacagcctcgtccccctacaggtgagagcgggaacacctttgggccaggaaggggcagctcgaggaatcccagagggcttttccggcctggactcctctgagggtctggagagagcttgaatggtgtccacgcgcccctgggatctggggtacaccaagtgatgtgtggcgagtgtgcctgtgagtgggtgttcacgagcacctgcacgtgcatgttgtaagagttggcatgtgtgtgtgtgtcaacgtacatgtgggcacacatgactgtgagtgtgcatgcacatgcctgcgtatgcaaaggagcgtgcaagcatgcgtgtccacaggggtgtgagtgtgtgcgtgaacacctggagccgggagaaaacaggcctatctggagggggagcaaagtacaggcatcaccctgagggagtagaaaacctgcaggaagattcctaggctgtcacgggggccccagcgccctgtgtccaccctccagacgagaaactgacgctgggagggctgaggaaatggtctccctggcctgcgggcatggctggggcccagagccaagttctggggcagttttgtctggatcaaagctggaaagactctgacatggtcggcaggaggtgctcgagagtcgggccaccataccccacagctccagaggcgccgtctgctccttgggctgtgagggtggctctgctggagccatggtcatgtggggggacagggatttcgtgggtccgcttgagggttcttagtcctcaccgccctcctaacttccctccctattcatcgttacagggggcaggaaaaccaaggggcatccttatttatttatgtatttatttttgagacagagtctcgctctgtcacccaggctggagtgcagtggtgcaatctcggctcactgcaacctccgcctcccaggctcaagcaattctcctgcctcagcctcttgggtagctgggattacaaacgcccgtcaccacgccaagctaattgtttgtatttttagtagagacagggtttcaacatgttggccaggctggtctcgaactcctgatctcaggtgatccgtccacttcggcctcccaaagtgttgggattacaggcgtgagccaccacgcttggccccaaggggcatccttaaatccaggtgcctgttcattctgcctccatcctgctgagagccaggcccagggtacgcatggaggggggcatggaccaacccaggccctgctgtcaggaagctcatggctcatatggaggctcctgtgtcccagcactgagctggggggacttctgactcctgcccaaaccctacagctccaaatcacccccagtcctgggtgaaggctgcccaggagagcaagctaaggaggggggtggcaggaccagaggctggggtcgagcactgatacccagaagccaaccgcacccatgtgacctgtgtctcatgtcgcccccagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggcccctgcagccgggcccagctcttctgtccttggccaccagagactgcagcccacaacccttggaggggttgggccggaaggtggaagagcctgccaaggacctcatttagtttgtgtattaaaaccaaaaagcttttgtctttaagaaataaaaccatttttttaagccccaaaaggttgcaggaaggtgggtaagggccgcaaacaatgttggtggctgagatgagagctgggaccccacagggctggatggccttcctgggcccttttctggcctgcagcaggcatggagaccgcctcggcctggctcagaccagcagccatgggaggcccactgccctcatatctgtactgttcccgggaatgaagtcctctgtcaccctgcagggcccccagaaatgggggctgggggggtgggagaggaggacagaaacccaccctagaccccatctcccatcttgagtcccaaggggacacccagatgtttgggcagagccttgctgtgtgaacctgggcagggatcgtctccccatcctattgcggggcaggatgggtgatcatggattcctagactggccagagggtgtgtgggacagatggaaggacattcagtcccttgcttctgggcacacagaaggcgtgggatctctccggccatttaaccatgaaggggctgaggaaatggcccagaaaacaggtgcagactgtaggtcccggccaggctcccaggacagctgaggccagcagaagactcaagtccctcaacccacccatttgcagccagtaactgagggtgccaccagccagtgacaccacttacgagggatctgcagaaaacaggggtgagggatggtctgaggccagtccctctacctgtccccacgcccaccagggaagtcaggagagcctttctgctcaaagtcaccccagtccagcccccgggaggtaggacaacactcccccatcccagagggcacaaagacggtcagccctgggcaatggtggtgggaaccctggcccttggggtggcggggtggcagatggcacagcaaggaatctcgatggagtcaatgagctgggccagttctccagtatcccgccctgcccatgcagggtcaccatgcccctaaagtgccagccatggggctccacacatgagtagtctgcacggggacaacctactttctttttctttctttctttctttctttctttctttctttatctatctattctatttttttgagacggagtgttgctctgtcgcacaggctagagtgcagcagcacgatctcagctcactgcaacctccgcctccaggggttcaagcaattctcctgcctcagcctcccaagtagctgggattacaggcgtccgctgctacgcccagctaattttttgtatttttagtagagatggggtttcgccatgttggccaggctggtcttgaactcctgacctcaggtgatccacccacctcagcctccaaaagtactaggattacaggcgtgagccactgtgcctggcccccactttagttagaaggtacagcagctacacttgtgaataaagtgaggaccatctcccacctgcccccaatacacccctgaatactcttccccatactccatccggatttccaccacagaacgtggccccttcagatgtgcaaacacacctggggaagagtgaccgcccggtcgctgtgtgacttcttccttcggtggctggacggcttcctccctggccgcagcagggcctctgaccagcaggagagcctggggcaccagtgggggctggggtggaggggagggggagttctgctgaggtctacagctgctcagccccacctgactgtgagggccaggcctgtgccctggactgggggaggagggggagtcagatttgtgttttctggctcagtttggcctctgcctcgggtaagtgctttctggacctccatttgccattcttgcactgagaaaatattatgaaacgcaaggttcctggccgcagaggctgcgccatgctatgaggaggcaaagacaaaggaataattacagcaccactaaggctatgagggggtgctgcaggggcccagggagcacagacggggccccaaaccttgttgaaggcatctgggcaggcttcctggaggaggtatgcctgag

SEQ ID NO: 12775 - DNA, 152798 bp, Human
cctaagcagctgggatcacaggtgcctgccaccacgcccggctaatttttgtgtttttagtagagacagggtttcaccatgttggccaggctgatcttgaatgcctgacctcaagtgatccacctgcctcggcctcccaaagtgttaggattacaggcatgagccaccgtgcctggcctaatttttgaaacagagtctcactctgtcacccaggctggagtgcagtggctgaatcttggctcactgcagcctccacctcctgggttccagtgattctcatgcgtcagccttctgagtagctgggattacaggcatgcaccaccacacccggctaatttttgtatttttagtgaccaggtttcgctgtgttggccatgctggtcttgaactcctgacctcaagcaatccacccaccttggcctcccaaagtgctgggattacaggcatgagccactgagcccagccaaaagcgtcttattaatgcagagctagccaagcagtaggactggagttattactcaaataaatctccccaagaactcagaggctagggtttttatggataatttggtgggcaagggcccagggaatgggtactgctgattggttggagatgaaatcacaggggtgtggcaaacggtccttatgcactgagtcggtctctgagtgggggccacaggatgggctgagtcatgagtcacacaggtccaggtgagtcagtcggttgcccgaatgcgaaagtctgaaaaacatctccaaagaccaatctcagtttccacaatagagatgctatctataggaggaagtggggaactcacaaatcttgtgatctctcgccacatgactcctgagcagtcagattataaaaacgatgcgtaggttttagcagcgtccaggcccctcccataatcctaatctcacggcctttcgttagttttacaaaggtggttttggtctcttgtataaaaagcaggttaggtttaaggagtaactattatcatccttgtttcaaagttgaactataaactaaattcctcccccggttagcttggcctatgccccggaatgagtgaagacagccagcgcgtgaggctggaagcaagatggagtcagccacgctaaacttctgtcactgtcctaatctttgcaaaggcagtttggccaggaggctgtggggagaccttgtgggttttgccaggacctgggagattctcgatctatgtttggctgtccttctaagccagaagctccctggggttggggcctgcctggggtgagtccctccctccctgccatgcccagtctagccaaggtctagttcagggatcagggcaccacgtgggggaaggactgtgttccttgtgctgaattaggatttatggctttggggccggatgggaggcgtgcgcactgattcagtaggagcgctgctgtggtgtgtgtgtggttggtgggagcggggcgggcggggggcgggggggctggttggggggacaggggtaaaagcctatcagagggaggtcccatcagacaagatgggaccaagagtccagttggctctgctgcgactttcggcctgtcactgccttcctgcacatctcaggggtgggagggggacaaaggctgtaagagtaagaggtacctggcccaagccttaggactagaacccgggccaggcgggagtgaccagccgggacactcagggcctccgcgcgttccagctgggtgaccttgaccctccaacttcagccccctgcgcccggctgctctcccagtggtggtggggagcggtgggggtagacgggggcgcgcccaggcttttctaatccggcgctggtgggggagaaccgagggcgccaccgcccctccccgcaggtccggggccgaggggtgcggcgcgctctccccaccgcggtgcccaggtccccgggacgcaggggcgctgggtagcaaggggggtgcgcaggggcgcggggcgcggggcgggctaatcccgtatgtaaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggtaggagaaacttttgcggggggcgggcaccgaggcccttctccccttctcccccacccccgcccccgatcccctccgcctccgggggggggggtccccgcccctccccctctcaaggtgttacaggagctggggccggcttttgggtgcccggggaggcacgtgactgggattataattcgggcccggggggaggggagggacggccgccccccacctgcccgggaggggccgggagctgggagctgtcaccccctccctccttgccaccggctcttctggaggtggggggcgtcccgggccggcgcccgcaggctgctgcagttggcgaatgaggtcagtcgcgctgcccgcggtggcgggcgccggggtgggagcagagggggctgggaaggccgcggtccccgcctttccccccctccaccttctcccggtctgggccagcccctggcccgcgcccccaactcccaggcggagtccagtccagccaggattgccccagcagggtggttcctgtagtggatcccccgccccggccccggggagggggctggcctgtgtggtggtggccgctgaatcccgggtggaggggactcagaaggtggcagtggggggaccacaaagggttcagaggagtaagttggggatactcggtctgtgggtggtctctgagttcctgcagatgggtggagaggacagaggaggggccacagggtgctgaacacccacccgccccatcctaagtaccctgggcatgatgggcttgacacctctcctgggctcctcacccctggccagcagccagggagtgagaccctgcctcgcctggcgtgggcccagggaagggggccgctgtgccgctgagagttcgttccaccctcctggcagtgctggagggggctggagctctggcgtctggcctagtgaccctacctcccaggaccaaggtcctgcggtgggagtctcctgtgtccccatcccagctgaagcgagggtgctgggacataggggtctcgctgcagggcctgtgaggggagcactgactcttggatggagaatgtgccaaggggtaccccgggatggccctgggcctggcgggtgggagtggagggcaggcccccgcagtttttggagaagtgggcatttgctggggtttctcttagaagaggagaggggtgtctagaagccaccctggcgcgccgctgccatggtcggcctctgtgtgtctggctgccccgtggccaggactgttgactccttggcactggcccggggccttgggacttggaaggtgccccaagcagctcatttatttcagcagtgtcattccagaggggaagggcaccagcatcgattatttattctaagcaggaggaggtggctggaggctggtggctgctggcagggaggggctaggtataaggtagttaggtggccgtcatgaaccgccctatttggggcccaggagggtgtgagatagactctgacctcttctgagcaggcatctgcggaccaagggacaggcttggccccaaggtgacagggtatcggaacccccatcctgcctctggggtgtgggaggctcaagtccacacctcgttcttccacagcctgttctgagggtgacctagaaattggcagttctaactcagagggtcccacaggaccccacagaggaaactaggaaggaagggttgaaactccgcagccactcagagcctgcactcttaaaatgttcgagaacttaaggccgatggttgtaaaactgggtcttgaagacagctttgtagggggcacgctaaacctacttaaaaggactgttctctcgatgttgggagaagggtcatttatttgcagtatgctaatcacaaataatttttatctgttcattgaaggcagcctcccaggagcccggctagccttctgatgaggtggtagtcgtcagcacttggtgtttggcaatagtctgagtggcagctgtaatctagggtcttggaggtagctgtttttgcagcctgcttgactccagaggccaggccatccacggtttggtgacagcttggttgttggacctggggtcttgtggatggtgggtgatggcttgggacattcacgtcctaagcatgaccttggaaccatagactgcagctcccagatgattctcattcagggtctagtctctgaccactcactgcttcctcagccgactcataaatcctgtagtctggccgggcgcagtggctcacgcctgtaatcccagcactttgggaggccgaggtgggtggatcacgaggtcaggagttcaagaccagcctggccaacatggtgaaaccccatctctactaaaaatacaaaaaattagccaggcgtggtggcaggcatctgtaatcccagctgctcgggaggctgaggcaggagaatcgcttgaacccgggaggtggaggttgcagtgagccaagaccgcaccactgtactccagcctgggcaacagagcaagactccatctaaaaaaaaaaaaagaaaaaattctgtagtcttgccgttttcctgaatggcctggcttcctcctacccctggcctctgcacacacagttcctcttctctcgaaggttcttcttggcctttcccctgaggaggctggggggcttcctttattagccctgcctggctagggtagggggtcaggattatagaatttgcctcttttcctctccttcaggacttggcttggctgtggtatctttgggctgaagacttcctcgtcctcagggctggccatggttccacctttatatccccatgatgtcctctcttttttttctttttttctttttttgagacagtcttgctctgtgcccaggctggggtgcagtagtgtgatcacagctcactgcagcctcgaactcctggactcaagccaccctcccaccccagcctcacaagtagctgggaccgcagacaagggccactacacctggttaattttttattgtttgtagagatggggtcttgctatgttgcccaggctggtttcgaactcctgggcatgaggagtcctcccaccttggcctctcaaagtgctgggatgacaggagtgaaccaccgcgcctagccaacatcctttccttcctttgtcccaacattgatcttactcagatgtttacatctctctccccaattgcactagggacaggaagggatggaggcttgctcctcaaatacttgttaaatggctacatgtttgaatgaatgaatgaatgaaatcctgctcttgagccttgacctaaatggctaagcagactctctcctatttttcttaaatgctcatctctggggcaagttccccaccctggtaggagtcccagggtctctccctgaacttcctggggccccctctctccccactaccccagcctgtgtcttctcccaaccttaaccctgggggctttgctccccaatgtcatcctctctgtatctctcagttctctgactctcgccgtttgtaagtatctctctctcagatgcgtggcagccagggtcacagccaggttctttgggacaagccaggggtgtatgcccagctccatggggcctgcagaggcttcaggggacacccatggaagaagacctgcagggccaatttataaacagaggagcagagcaggacccagggcttggaatccatgctgagttacgtttttgtttttttttttttttttttgagagggagtctcactttgtcgcccaggctggcatgcagtggcgccatctcggctcactgcaacctctgcctcctgggttcaagcgattctcctgcctcaagtagccgggattacaggcatgctctaccacgcccggctaatttttgtatttttagtagagatggggtttcatcatgttggccagtctggtctagaactcctgacctcaagtgatctgcccgcctctgcctcccaaagtgctgggattgcaggcatgagacactgcgcccggtcctgagttcagttttgattggggggcttccgggataatatggggccgctaggacagggacccttagtgtgactggaagggaatttcctgaaggaattcatagcagaggtggagtggtgggaaggatggtttctgggggagaaggagatgcgtgaacctggccagaagacagtgtgttgtgacagatgattgctggtgagggggtaacagtctccaaggtgtagatgttgggggctccagatacggcaggaggggcctggcctctcggaatcccctcagccccatctcatagaaacatgtgctttctacccaggctccatactccggaagggaggcaggaccctgtcactttcttggcctactttggaagttctcagtcaggtatctccaggtgtggcagaggggctttggcctgtagggggtgtggtaatgtgggttttggaggcagaaagcttttcaggaaagccccctggtccatcacccccctttctttttttttttttgagatggagtcttgctttgttgcccacgctggagtgcagtggcacgatcccaactcactgcaacttccacctcccgggttcaagtgattctcgtgcctcagcctcccgagtagctgggattacagatgtacaccaccacacctggctaatttttgtatttttagtagagacggggtttcaccatgttcgccaggctggtcttgaacccctgacctcaagtgattggccctccttggcctcccaaagtgctgggattacaggttgtgagcccccaggcccggcctcatcatcacttcttcacccaccctattttggtagctctctctccactcgtcctgtggaactgatccattctcggtcccattcccttctctctgggccaatctgcacctaggtttgtggcttcatgagtatggagggtcgtgcagaaaggggccaggtctgtaggaacctgggttcatgccctggaaatttgcccatttaagataagttagggccgggtgcggtggctcatgcctgtaatccccagcactttgcacttcgggagaccgaggcgggcggatcacctgaggtcaggagtttgactagcctggccaacacggtgaaaccccatctctactaaaaatacaaaaattagccaggcgtagtggcgggcgcctgtaatcccaactgctcgggaggctgaggcaagagaattgcttgaacctaagaggtgaaggttgccgtgagctgagatcgtaccattgcactccagcctgggcgacaagagtgaaactctgtctcaaaaaaaaaaagataagataggtgtcctgaataagataggtgaaatgggtgaggatgtactttatcttacacggtcttagggagtgtctcaggcggtgaacagaactctctcgcccctgagctggggcctggctgacccagagctatttgtgtgcccacctgtcaccctctttcaggaccacctgcttcaggttgccagatttagcaaataaaaataaggatgcccagctaaaattggatttcagacaagcaaggactaatgcaatatttgggatgaacttctagctaaaagttacctgttgttgatctgtagttcagactgaactggaggtcttgcattttatctgccaaccctacaactgctgcctctggggcggtgagatggatggggtttggggaggggccagaggtgtgtgtggctgaccctggagttgggatcagggctcagtggaggccccggggatgatctggagcgagtttgaatcgagtggagctgattcactgaatcttggcttttttttttttaatttgtattgaaatgaggtctcactctgtcacccaggctggagtgcagtggcacaatctcggctcactgcagcttctccctccccggctcaagcgatccttctggctcagtctcccaagtaggtgggaccacaggcacacgccaccgtgcccggctaattttttgtatttttggtggagatggggtttcgccatgttgcccagttcctgagttcaagtgatctcaaagtgctggaattacagaagtgagccactgtacccagccagcagggtcctttttcatttttattttattctattttttgagacagtgtctcactctgtttcccaggctggagtgcagtggcgtgatcctacctcactgcaacctccaactcctgggctcaatgtgatcctcccacctcagcctctgcacctagctaattaaaaaaaaatttttttttttttagagatggggtcttgcgatgttgcccaggctggtctcaagctcctggcctcaagcgatcctcccacctcagcttcccaaagtgctgggattacaggcagtatccttctaatgtccttggtcaggcctcctccagcctgtggctcgagggtctagatctcctactggcctgggtggcatggagggtgtagtctaggtggcctgaggggtgcccagggatccccagtttgggaagtccttgtcttcagggatttctggccaatgtggtccgtatatttagagatgctgggaggagggggtgggaaattgctggaaacaccctattatacaccaagtaagattttcatgtaggattggcaaggcctgagtgctgggaaagtgtctgcaatggctacctttcaaagctgggagaccccgccacgggggcggttgtggacttgaggggctgaccccacagcacggaggctgctgggaattcctgcacctttgccatgctgccacctgaggcaggttcccagcacctgagctgcagcctctggagtgggggaaatggggggaaagtaaggggccggggtcatggggtccacgtccaccttccgcccgcctgggcagttttcttggatgtaaaagggagatggctctccccaacctgcctgggtcccagtgtggtgctgtagtccaagggacttggtgtgaccccgtggggatgccacagcatgggtgtgtgggacccccgggggcaggtctgtggtggagacagggtgggagggcctggcttgagggcttgcggtcctgggcacttgaggatgcagaagaggctgcatggttggggagggtaggtaagcagggggcagcttagccctttcccctcctgttccctgtgacagaggggagaccctccaggctgtttgtgtcttagatggttggccgagggtaggcctctttgctggctggggtctagcagggtctcaaggtgcattttctggctactggcagaaccaccatcaaagcaagtccgtatcttttcgtctatccatctgttgttacgccagccagtgaggaccttgcagaggcgtcaggcctgagggagtctcattaggtcctggtccccagcccccggctggcacatgagaagggcccactttatattatattttatttatttatttaagatggagtctcactctgtcacccaggctggagtgcagtggcgcgatctcggctcgctgcaacctctgcctcccgggttcaagcaattctcttgcctcagcctcctgagtagctgggattatgggtgcatgccacctcgcccagccaatttttgtatttttagtagagatggggttttgccatcttagccaggctggttttgaactcctgatctcaagtgatctgtccaccttgacttcccggagtgctgggattacaggcgtgagccactgtgtccggccccactttatattttattaaaaatatcgttgaggagtgaaggctatgctataccaggaacttgcctggctcacacccttatgtcgtccaacccccgtcaagacatagaacagcgctttgggaggctgaggcgggaggatggcttgaggccaggagtttgagactagcctagacaacatagtgaaacctccatctctacaagaagtacaaaaattagccaggcgaggtggctcatgcctgtagccccagctactcaggaggctgcggcgggaggatcacttgaggccaagaatttgagaccagcctgggcaacatagcaagaccccgtctcttaaaaaaaaaattagccgggtgtggtgatgtgtgcctgtagccccagctacttgggaggctaaggcaggaggattgcttgaccccaggagttagaacaatcctgtaacccctaaaagtttttgaagcccgtttgttcatccttgtctcttgtcctgaccccagcaaccactgatctgtcttctgtatatggttttccatttgtacaatgtcacataaatggaatcctacagtccacagcctctgaatctggcttcacacagcataatgcatttacggcattgctgggtacacgggtagctggtcccttctggtccctgagtagtgttccatggtgtggatatgccacatacctctagccactctcctctctagggaaatctagcaaaccggcttggccggccctgcatcagctcgggaccccccagaagaaggtggttcctctttctcattttcacaaaggcaccatctggctggcggggggcctgtggcctgcaccccatcactacccaccccccacatcaagagctgaccccaagccgggggagctgctcatctccgccctcagagctggaatttcatcttctgtttctggtgactcatactgtgagccccgcgatgaaattacacctgcctgccgctgccctccgggcctctggccccatgcgatcctcccgccgccatccaggtgggctctggagtaattgaggctatggggccaggacagctggaggttgagggcggtgccagggaggggagctgtctgtgccctggggtgtcttgcccatcatcttatgtatccccaccctgtgggagtctggggttcctggtggtgcgtctctggtcttcactcctgcagctgttttgcttggggtagaagtttcatgtttgcctgaaataagagcaggacttctgagggtagggaaggaaggtggtgaagccactgttgcaggcaggagcaggagttaggatcaaacggaacagggctggccgagtgatgtcacatctctgggctttggtttgttcatctgttcttattattattttgagacagggtctcgttctgtcacccaggctggagtgcagtggtgcaatcatagcttgctgcagtcttgaactcctaggctcaagtgattctcccacttcagcctcctaagtagctgggcttggaggcacttgccactacacccagctaatttttttattttgtagagatgggggtctcgccatgtcgcccaggctggtcttgaactcctgtgttcaagtgatcccgcaacctcagcttcccaagtgctgggattagaggggtgagccactgcgtcctgcctgttcatctttaagtgggagaacagaacactaggtttgcagggctgtgagactcagctgagggtaatgtgagtgtgtggattaccacagagccctggagggccccaggggccaccaaggagcgggtggtggggacatgtgaggctcaagcctcctgtgcccctttgggccagagtaggaccactgttgttttttgtttttttttttttgagacagagtctcactctgtcgcccaggctggagtgcagtggcgtgatcacggctcactacaacctccgcctcccgggttcagttgattctcctgcctcagcttctcgagtagctgggatcacaggtgcgtgccaccacacccgactaatttttgtatttttagtagaggcggagtttcaccatgttgtccaggctggtttcgaactcctgacctcaaatgatccacccatcttggcctcccagagtgctggaattacaggtgtgagccaccgcgccctgccctaggaccacttttaccagagttacctgttagagctctaaatacagttctggttgctaaatgtttggaatccactgctgcctgaggtcagccctgtgtgaacagtggctattctggtgaatgtttttgtggctagagcctagattatggtggtttacggactccagcctgtcacttgcctgaggctgagcctcagtttgaccctctagaaaatggaaccacagcaagtacctccacaggtttgccaggtgggcatgaatgaagcaggggagcccagcaagagtttgtcagtttcccattggcaaatccatgagtttcccagggctctcggcttcctaaggagatggagcttcctgggtgatcacatgtcttgcgtgggtgtcttgagagatttggggggtttttactttgtttttgttgttgttatttgtttgtttttgaaacagagtctccttctgtcacccaggctggagtgtagtggtgtgatcacggctcatggcagcccccctcctcctgggttcaggcacttctcccgcctcagcctcccaaatagctgggattacaggcacctgccaccacacccggctaatttttgtgtttttagtagagacggggtttcgccatgttggccaggctggtctcgaacccctgacctcgagtgatccacctgcctcagcctcccaaagtgctgggattacagacatgagcacaagccaccgcgcccagctggtttttactttgttatttaatttgttatttgtgaaatcgttgtggcccctctctaatgaaggttgccccaagtacctttcccctgtaccccacccttgcctcccacccctaccgggttccccaaagtcctcaaaggctggaccctggggccagcactcggtgggtagcctggaaagaggttagccctgtgcaggaaggaaggcccttgggtgctcctgggtggctccttgcagcagacaagacccaccgcccacccacctggctccagggtggtcctggcagctccaaggggtcttgtgactctctcagtctgatgtttctctcatgtttatccaggagctggtttttcaggcatggccgcttcttgcagtgaggccaggtggggagaggcagggctttggggaaggaggtggttacctctgctcccagggcacaccctggctgccagctgtgggtgcagccctctgggcaggtgggcaaaccacatcctccctctttgatcctggtccacctccccacctgccccgggccaccagctccctgagatattctcttctcagcatatccaaaggagagatgctcttggtggccctgggtcagaggccagggctccctcacttcacagcagggtgcagtggaaccatcagggtctttgaagccagacacacctaggttcaaatcccagcctgactgctgagctgctgtgtgaccacaggcaagtgactgtacctctctgagcctcatctgaaaaaacaaggatagttttcttatatagtattgccaggttcttgggaaaatcagtgtattcagttgcggggagctagctgccatctcagtgaagaacactttgtcagcttgtcacgtgatgaccccagaagctggccctgtgggagccccactcccccagacagtgaaccttggaccccatcattccaagatctgttcttattttctgcctgtctgggacacaccccctctgtccgtggggtgtggggtgtggggtgtggcatgcctcaatttatttattttttttgagacagagtcttcctctgttgcccaggctggagtgcagtggcaggatctcggctcactgcaacctctacctcctgggttcaagtgagtctcctgcctcagcctcccgagtagctgggatcacgggcgcccgccaccatgcctggctaattttttgtatttttagtagagacagggtttcaccatgttgcccaggctggtcttgaactcctggcctcaagtgatccacccgccttggcctcccaatgtgttgggattataggcatgagccactgcacccggacagcatgcctcggtttctgcttctgcaaactgggaaaacctcaaaggtagaactggttggtccccttggcctgccgaccccttagcccctcaaggtcacagtcagccatcccgcttgttagaggccaggccctgttctggggcgggggatacctgtggctgcttaggggacgggagacaatgccactcccaggtgtgtttgatggcagcctgcagaagtggctttctgcatggccctggaggacggtgatttggacagaagcgtagggccagagacaggacgtgacggtggggctgctgcattggctccaggtaaagatctgtatctgatggcctcactcccaggcagctcaggggttcccgtggctcctggaaaagctacagactaggcatggccaggccctgcctgtgtctctctgtgccagccacgatgagcctcatcgtttctaaaacgtactgtgctccgtctcgcttcctggaacgctgctgcctctcccctagagcgtgcgtaatgctccccggctgtgtccctgggctgatttctcgttgcaggtcttagctgggttgtcactcctctctgcaaagcttccctgacctcatctccctctccaggtcacgttaggtgcctcttgtctgtgtccccagccacagcccgcatcacaaacaagactataattgccctcgtgcttgtctgtcaccttcacagacagagtgtgacttccagtgggtcacggccccatcatcatgttgtcctccgcatccctgaccttagcaccctgcctgttgcggagtgggcatcctgtgcaaccttgtcaagtgaattagaagcaagctcggggtgggggcccatgaagggtgggggcctcctccaccctttttctttctttttttttttttttggagacagggtctcgctccattgcccaggctggagtgcagtggcatgatctcggctcactgcaacctccgcctcatgggttaaagcaattctgccttagccctccccagtagctgggaccacatgcacctgccaacacacccggctagtttttgtatttttagtagagatggggtttcatcatgttggccaggctggtctcaaactcctgacctcaagtgatccacccgcctcagcctcccaaaatgctgggattacaggggtgagcccccatgcccggcccctctccatccttcaatcccagctctcgttggcgctcctctacccatcccaggagctgcttctgccggcctggctgtggcgttcagaggcatctggagggcagtggcgatggcagtgggggcagcttgtctctctgagccgagtacagcccaatttggagcgtttccctccaggaaaggcagctgatgtgtgcagacagcacaagtgtggagtgccagaacagttaatcctctgggctatttatttatttatttattttgttttgttgttgagatagagtcttgctctgtcgcccaggctggagtgcagtggcgtgatcttggctcactgcaacctccacctcccaggttcaagcgatttgcctgcctcagcttcccgagtagctgggattacaggcatgcactaccacacctagctaatttttgtattttattttgtatttaattttttatttttattttttgagtcagaatctcgctctgtcacccaggctggagtgcagtggtttgatctcgactcactgcaacctctgactcctggtttcaagcgattctcctgcctcagtctcctgagtagctgggattacaggcgcccgccactgctcccggctaatttttgtatttttagtagagacggggtttcaccatgttggaccagactggtcttgaactcctgtcctcaggtgatccgcctctgggctatttagacacacatgcttgtgtgcatgcatgggtgtgtatatgcacatgtatgtgacattcctgaggccaccggcggtgacgaggcctgattacttgacgttctgctgaatcctgactactagcctggagctttactccccagtgtacacagctccccgagtcctggttagtggtaaagaggggactgtcccctgtcatttagggctgcatttggctacaggtaattaaacacccaactgtaaatatagcaaatatctaaatattaagccaggtcaggtgcagcagctcaggcatgtaattttagcacttcggaaggccgagatgggcagattgcttgagcttaggagtttgagaccggcctgggcaacgtagtgagaccctgttctctacaaaacataaaaataattaaaaaaaaaaaaaaaacccagccaggccgcagtggctcactcctgtaatcccagcactttgggaggctgagacgcgcagatcacaaggtcaggagttcaagaccagcctggccaacatggtgaaaccccatctctactaaaaatacaaaaaattagccgggcgtggtggcacgtgcctgtaatcccagctacttgggaggctgagacaggagaatcacttgaacctcggaggcagaggttgcagtgagccaagactgtgctactgcactccagcctggcgacagagcagcgagactccatctccaaaaaaaaaaaaaactgtgtgtgtgtgtgtgtgtgtgtgtgtgtgtgtgtgtgtgtgtgtgtagcctggcagactttagatattaaacctgacagttaaacaaaaaggagtttatttattcctcataagaaaatatggaagggccgggcgcggtggctcacgcctgtaatcccagcactttgggaggccaaggcaggcagatcatgaggtcaggagagcgagaccatcctggctaacatggtgaaaccccgtctctactaaaaatacaaaaaaattagccgggcgtgatggtgggcgcctgtagtcccagctactcgggaggctgaggcaggagaatgacgtgaacccgggaggtggagcttgcagtgaaccgagatcgagccactgcactccagcctggacgacagagcgagactccatctcaaaaaaaaaaaaatatggaaggtatttggaggataggatgggtacttatgagtaggtatttggaggctgggatgggtacctgtgagtaggtatttggaggctggggtaggagcgtggtgatgcttttcagggttcagtgatgtctccagagacttgattctgttcttctctaccatgttggattttctttttttttgtaagtttattttaaaactattcctttaaagtgtataattcagtgttttttttaaaatatattcacagagttgtgcagtattcatcactgtctaatttcagagcatttttatcatcctaagaatctccccccattaagcagtcagccctcattccctcctcccccatcccctggcaaccactaatttactttccatctctgtagatttgcctattctgggcgtttcttgtagatggaatcatgtaatatgtggtctttcgagtctggccttttctcagtgagtataatgtgttcaaggttcatccacattgtagcgtgagtcaatgtgcctttctttttatggccaaataatattccatttaatggatagatcatatttatctgttcatcagttatggacatatggggtgtttctactttttattattttattttattttgagacagggtcttgctctgtcacccaggctggagtgctttggtgggatcatggctcactgcagcctcaaactcctgggttcaagggatcctcctgcctcagcctcccaagtagctgggactgcaggcaccaagccaccacccctgactaatttttaaatatttttttggtagagacggcatatgtattagcaaggccctgtctctaccaaaaaagataaaaattatcatattctttattatgatatcattataccataaaattcaccattttatttatttagtgtttttagagatagggttggccaggctctgttggccaggctggagtgcagcggtgcagtcttggctcactgcaacctccatttcccaggctccagctattctcctgcctcagcctcccgagtagctgggactacaggtgtatgccaccatgcctggctaatttttgtatctcttgtagctgtgttgcccaggctggtcttgaacccctggactcaaacaatccacccacttcagcctctcaaagtgctgagatagataagcataagccaccacacacggccaaattcaccattttaaaatacgctatgcaatatttttagtatcatcatgaagttgtgtgaccatcgccaccatctaagtccgttcattttcgtcactctgaaaagaagcctgttacctcattagcagtctctccattccccagcaccccccactccagcccctggtaattgctaatggttgtctctctgggtttttgatagcttatttataacattcagccttcacctaccatatgactaggtatttacctatgagaaatgaaagctcaaattcacataaaaacctaaagaggaatatgtatagtggctttattcataattgccccaaactggaaacaattcagatgtcagactgcccagtgaataaacaaactggaacatccatactgtggaatattagttagcagtgaaaaaggatgaatgatggataccacaccaccacggggaaacctcacgagcattgtgctaagggaaggaagcagactggaaaggccgcttccaacctagttctgttcatatgtggggttttttttttcgagacggagccttgctctcttgcccaggctggagtgcaatggcgtgatctcggctcactgcaacctccgcctccctggttcaagcaattctcctgcttcagcctcccaagtagctgggacaacaggcgtgccaccacacctggttaattttttttgtatttttagtagagatgggatttcgccatgctggccaggctggtcttaaactcctgacctcaggtgatctgcccgcctcagcctcccaaagtgctgggattacaggcgtgagccaccgtgcccggcctctggttctagtcatatgatgttctggaaaatgcaggattagggacagggtttgcctgggagtgggagagtttttggggagatggaactgaaatgcgttttgattacggtggcagtcacctgactgtttgcatttgtgaaaactcatagaaatatggccagaggctcatgcctgtaatcccagcactttggaagactgaggcaggaggatcgcttgaggtcaggaatctgagaccagcttagacagccaaaaaaattagccgggtgtggtggcacacagctgtagttccagctactcaagaggctgagccgggagaattgcttgaggctgggagttcaagcctgcggtgagctataattgtgccactgcactctagcctgggtgacagagcgagaccccatctctacaaaaagatttaaaaattagccaggcaccgtggcttgcacttgtattcccagctactcaggaggctgaggtgggagggtggtttgagcccagaagtttgagaccaaactatgtttactgggtaacatagcaagacccctgtctctatctttttgaaatatttaaaaaaaaaaaaaaaaacaaaaaaaaaaacaaaaaaaacggccgggtgcggtggctgacgtctgtaatcccaacactttgggaggccaaggcgggcagatcatgaggtcaggagattgagaccatcctggccaatgtggtgaaactctgtctctactaaaattacaaaaattagccaggcatggtggtgggtgcctgtaatcccagctgctcaggaggctgaggcaggagaattgcttgaatccgggaggcggagtctgcagtgagccgagatggcgccactgctctccagcctaggcgacagaatgagactctgtctcaacaacaaacaaacaaacaaacaaaacagaacactcatagaactgtatgtcagaaagaatgaattttattgcatgtatattacactccaggtaaaaaggggcctggcctggaactggcctttccagagtaactccacttggagttcaccatctcatttgttctagttggtgccaccatcccttctaccaatggtgagttttggtctgtcaagttggccaacctgagttgtgcatagggccggggccagatgctgcagtggggcccccctctttccccttccttggacatcctaacccctcttggggtttcccgagcttcttggatggagggagccatagaatgttagaactggagggaacctcagaatatactggcctcttctctttttcagatggggaaactgaggcccagggctgggaagacacttgactaaggttctagagttacgaggatcaagatctaaaaccacatctggccgggcacagtggctcacgcctgtaatcccagcactttgggaggccgaggcaggaggatcacttgaggtcgggagttcgagagcagcctgggcaacgtggtgaaaccccatctctattaaaaatacaaaaaaaaatttagccaggcatggcggggggtgcctgtaatcccagctacttgtgaggctgagacatgagaactgcttcaacccgggaggcggagattgcagtgagccgagatcgcaccactgccctccagcctgggcaacaagagcgaaactctgcctcagtaaataaataaataaataatcaatcaatcaatccacatccatgactcttggtctgggcctccttgccctcctgcagatgcctctggagcctcccttgtctcctgctcctggttcgggaggctggacaggcccaagctggccccacagctggtgggaggctttgctgcagcgtaccctggacagggcagagttgggtagggaagggagagtggtcagagcatctgcaacaccgcagcggaggagaggagagagtgcggtgaaggctggcaagtggttgattatggggagctgtgagaatggttgatggccccccagggacagacaggagaacagagcactggtttctgctctttggagctcctgacatcacctggagtaacccccaagcctcatgatgtgttcaggtagatcccagcaaatgcagaattggggtcagcctggttgggatgacaaccagaagagcttcctaagggaaggaccccaggagaacctggtgggggcaggggagagatcttggccggtgtcccttcccaagggaggaacccagtctcagggacgtagtcccgccccctggtttattctggtattgctgtgtccaccagcctggggctgccaagagctctggaaacttctgtgaggttgggcgtggaggttgcatggtggcagctcagggcttttttttttttttgagagagggtcttcctctgtcgcccaagctggagtacagtggaacagtcatagctcactgcagcctcaaactcttggcttcaagtaatcctctcactttggcctcccaaaatgttgggattacaggcatgagccactgcgcacggctttggggattcttattggctgtgaaccccgtgattcattgctcccattttcttggtttagtgcccactcctgcagatgaggggaggcagactgaacctcctggagtctggggtctgggtggtgagcctgcccacttccaggaactgtccataacccacccaccatcctggacagcccgcaaccttggtagcacaggacacttgcccactgccctatttttggctcagaaaacgatatcttcagctgggtgcagtggctcacgccgagctgggcggatcacctgaggtcaggagttcgagaccagcctgaccaacttgatgaaaccccgtctgtactaaaaatacaaaaattaaggctgggcgcggtggctcacacctgtaatcccagcactttgggaggccgaggcgggtggatcacctgaggtcaggagttcgagaccaggctggccaacgtggcgaaaccccatctctactaaaaatacaaaaaaaaaaaacaaaaaaattaactgggcatgctgatgggcacctgtaatcctatctatttgggaggctgaggcaggagaattgcttgaacccgggaggtgagttcaaccactgagccgaggtcgtgccactgcactccagcctgggcaatgaagtgagactctgtctcaaaagaaaacgatattttcttacctatggggtcccctctggttttcaggactcacaatgcctgcaggaagcccacctcaggtctcactgtagcccccctggtggggaaacccctctgcctctagcagggcaggcagaaaagatgtgtttggaataaataatgagcctatgggagagccactcccatcttggtgcaaatatttgtgtgtgaatcactcatctggacagtgggactggattgtggttgacagtgagccatgcctggggggctgtgcaggggacattgtaggggtgcagggccatgtttactccagatcccagcagacttcactttgaagctggcccctgactctttgtgctgtgtgaccttgggcgagttgctcagcctttctgagcctctacatcctcatctgtaaaatggggagagtactgttgtgtttgtagtgttgctgaggtgggttgcgagatgcccatcagcagcacagctcctgccactgatggctgcaacgcaactgtgatttctcagaaatgtcatcccaggcccagctagccctgaggcccaggtggggttttgagggaaagggatctggctgggagcagtggctcgggcctgtaatcccaacactttgggaggttgaggcgggaagactgcttgagtccaggagtttgagaccagccttggcaacatagcaaaactccatctctacaaaaaaaataaaataaaataaaattagccaggtatggtggtgtgtgcctgtagtcccagatactcaggaaggatttgggacgatcacttgaggctaagagtttgagaccagccagggcaacatagcaagactccatctctacaaaaaataaaataagtagctggacacgatggcacacaccttaagtcccagctacttgggagtctgaggcagaaggatcacttgaacccaggagttggaggctgcagtgagctatgatcacgccattgcgatcataggctgggtgacagagcaagagaccctgtctcttaaaaaaagaaagaaagaaaagaaaaatgatactcaacccttgtccattgggcctgactctcacctcccacctctactttgtgaggaagggacagggtgttattatgtcttcattggagggtactggggcccagagaggggaaggaagttctccagcatcacacagccactcgaggctgagcctccactagacccagacctcctggggcctggcctcatgtgcgttcctgagactacagggttttggtgaggggctgccctgccatctgttgctgtaccctagggaggggagggtgtggcccgggctggactcctccaagttgctctgtccctgggttttggaaggggaggggccgcttcatgaaattgcaccacctggccaaggctcgggcaagcccaggttggatgcaggtggccaggcttttctgacaggtgagggcagaagtggaagtaatgcaggtgttcagagaaagggccggatgtgtgtgcatgcgcacacccagctacaaaacaaggggtgccattcctcagggaccaggccattaacgtgagccacccgtctgatgcgtagtcacccgccggggtgacgggggacttcctggactctgcggcctgatcctgcctgtctggtgacattcctgatctggagtacacattgggcctgcagtgggtgctttggtgtttgtggaatgaatgaatgggctggcggcacccactgatgagcatctgccaagatgtctgtgtgcgtggaggtggcaggtgtggtccaggtacccgataacggatagacacctgtacaaaacagcctcttctccaatgcctggtggtggtgagggatgggggtgtggctattttgcagttggatggtgtggacacttacaagtcaactaatcccgatgctctggactcctgtctgtaaaatgggatggcgtaggtgtgggctggtggtgcctggtgggtcccgcccaagccccagagaaggggctgatggcagctagttgttatttttattactaaatcatggctcagcccagcctggcctggcaagcccaagttcctggtggatgtctgcctcttccacgcccgcttggaagccttctgaacctccttttttttttttttttttttttcttttgagacggagtctcactctgtcgcccaggctggagtgcagcggtgcgatctcggctcactgcaacctctgcctcccgggttcaagcgattctcctgcctcagcctcccaagtagctgggatacaggtgcacgccaccaggctcggctaatttttttatttttagtagagatggggtttcactgtgttggccaggctgatctcaaactcctgaccttaagtgatccgcctgcctctgaacctcccagatttcatcggttccccaccgtactctcctgcctctagcctttgcccaagctgaccttggccccagtcttccccactgaacagccacccagcctttggggccagtgctcctgggccgatgccagccatccatcctggatgtgcccacgcctggtcactccccacatgaggagctgatgatctttggtcaccgtttataaactttagcttctctttcctcacccaggagctccagggcaaggagtgggcctgattcacccccgttcagggactgggtcctaacaggtgtggtgaaaatgagcacttagtcagcgtcccacagcatctaaaagacgggaacaagggctgaggatgtgggtaggcccaagactggaaatagggaagcctctggaatggggactagaagatgaaagggctctggaagatggggcatccaagtgtttaaagcaagaacggggctgggcgtggtggatcgcgcctgtaatcccagcactttgggaggctgaggagggaggatcacttgaggccaggagtttgagaccagcctggccaacatggtgaaaccccatctctactaaaaatacaaaaattagccacacatgccagtgcgcacctgtaatccccgctactcaagaggctgagtcaggagaatcacttgaacctgagagacagaggttgcagtgagctaagatcgcaccagtgcactccagcctgggcgacagttttttttttgtgtccaaaaaaaaaaagaggtgcggggagggccagagggcatttggggtgggacggggcagggcagggctgggtgactggaatggggtgactataatgaatgctttggagtaggtcagggcaggtggggaggccagatgccaggggagggagggggcatggggatccttccatctggggccaaggatggcaaggccctcagacaacttctagcccaggttctccattgacagatggagaaactgaggcccagggaggggcagtgctagtgctgaggttttacatagcaggtgggctgttccccagcccactgcagggcatagcctgccctgggacacctgtcctcacccgttggctcagtggttgcaggggcatgggtgggtagaggtcggggagtgagccggctcaggcgggcagggctgggggccccgtgagccagcgccccaggattagatcacccacgagtaatgggcttttttccgtccagccttttcccgacaagaaaaggcctgatgttcctcatccgtgttgttctgagaaggcatgtttatgtctggcaagcgaagggttcttgggagacaggatcccagggcccccctgcactgcctggccccaggggttggcaccgccccagagctggtttcctcccactgtctcctgacacccagcccccacgcttttcagatgcctgcctgagaacaaataaatacttctgcaccatgcacatgagctcagataagcctccggggctcagccagaactgggggcaccaaatgcccgggttccctgacccctagctgggtgccaagcctgcatttcccacccagcactccccaaccgccccttgcgtggagggacagagatatactgtgagcaacacgggacctgatgtcaggggtggacagcagctcggcgggtgatgtcagcttgagcaatcgtccccgtcatcactgctgttaagtgagcgggcacttggtgtccccaggcccagcgccaggccctgttcacacattctcacgtggggctctcacagagctgagagcagtagaattaccatcacccttttgctcagtggggagaggaaagtttgagcattgtgtgtgtgtgtgtgtgtttagagacagggtcttgctctgtcacccaggctggagtgcagtggtgcgatcatagctcactgtagcctagaactcttgggctcaagcgagcctcccacctcatcctcctgagtagctgggattacaggcacatgccaccacgcccaactaatttttatgcttttagtagagatggggtttcaccatgttggccaggctggtctcaaactcctggcctcaagtgaaccacccacctcagcctcccaaagtgctgggattataggcatgagccaccagccccacctttttttttgagatagggtcttgctgtattgtccaggctggagtgcagtagcgtgatcatggctcactgcaacctctgcctcctgggcccaagcaaccctcccaccccagcctctggagtagctgggactacaggcacatgctatcacactaggctaattaaaaaaaaaaaaattatagagatggggtctcactatgttgcccaggctggtctcaaactcctgggatcagaaacctggtggtcattccaggtgcctcccttgggaccccccgtcgccagctcctggtcccaaagctctgccccgtcctccatcccctgctgctgtctgcttcatgcctggctgtctctggcctgggctgtcgcagagacttggcaactcctggctccccaactccaagcatgacccgacagttcctccgccgtagcttcctgggatccccctcactgcccacgtctcacccccgccccacaccctgcagcgaggctgaccttccgaggtccttggcctcaccccaatggccacgctggtctctgcccaccacttcctgccctgccctgcacactccagccatgcagagctggatttgttccccacccacccacccactcccacagcctctggccccgctcaggcccgaccaggacacgtgggcggcccaggctggcggttgggtttcctgggcagccagtaatttggcactccttcaaacaggtctttatttattcagcatttatttctaggggaggtgggtgctgcggtggggcagggaaggcgcctcccttgtagaagagcagggcctgggcacagtgcctgtctcccctcctcacctgcaaacgccaactcccctgggagggtcccggcagctcaggtgtcacctcctccaggaagccccaccctgactgcctcacccgccgtcctgggcttcttccatgccacttatttttatctttcactgaagcataatttacttccagtaaagtacatgagtacatgaatcttttttttttttttttttttttggagacagagtcctgctctgtcatctaggctggagtggcgtggtcttggctcattgcaacgtccccatcctgggttcaaacaattctcctgtctcagcctcctgagtggcttataggcgcgtccaccatgcccagctaatttttgtatttttagtagagacggggttttgccatgttggccaggctggtctcaaactcctgacctcaagtgatctgcccgcctcggcctccctaagtgctgggattacagtcgtgagccatcgcacccagcccaagtacataaatcttaagcatcccgtgtgatgaattttcccccgacttgtatactcatgtaaccatcactcagctcaaatccttgcactgtgttttaatcttttttttttttcccagtagtctatttttttggtcattttccctgccagcctgggaatccttcaagggcaggagcacctgctgttgggccctgtgcggtgtgggacacagtgtgagagagtattggtgcctgtgagctggtggctgtgtccccacccctgtgattgtccccacgtgtgtgtgtgacggaggctgtggccgtgggaacatgtggatctgtgagcctggccaggggccccagtgcaggggcaagcgccccctcctccactggaagagagccttgtccgatcccccagccaagggcctttgcagggagccgtggccctgctggagagtccccgccggctgacagcccggagattagtctccaaggccacaacgccagttgccataggcacgcaggcccgcgtcaggactgcgatttctcatcctggtcacgcaggcaggcggccgcccctgcccgcctgccaggatccaggctcaggctttaaataacaagggtggaaacctgaaccgcggagccgtctgcccggcggatcctggcctcccctcctggtagagcaggcatggggcggcctggaccccgcatactgccggcggcggcggagtccctccgtgcccgccccgggggacgggagagaaatggagaaacctgagtttgggggctctctttgagtgctcctagtacctgatgcacagcccgagctgagaggagacagccccttttcctaaatcccgtcctccacgtggaggaaggacgccctaccttccagaagcctagatgaagggcagatggggcttcgcatggccaggcctcagatcggcttcccccagcccctccagggaagaggcaggaggctccctcacttccccttggaaggcagcatgaatccctgtacttcctggactgcccctttgcccccgcctggggccaactttcctgtcatggggtggagcagctgtgttggatggttggttttgctttttgttttgctctattttttatttaaaaggaaaatttttttagaaatgaggtcttgctctatcgcccaggctggagtgcagtggcgcaatcccagttcgatgcattcttgaactcctgggctcaagccatcctcccacctcagctttctgagtagctgtgacgacaggcgcgtgccaccacgcccggctcatattttaaattttttgttagagatggggtcttgcgatgttgcccaggctggtctcaaactcttggcctcaggcaatcctcctgcttctctggctcccagagtgttgggattacaggagtgagccaccacgcccagcctgcttttgtttttaaaggatgaggtttctgttgtttctttccaaattgtaaaagtaatacttaccttaggtgacttagaaaatacagaaaagtagagggaagcaaagtcaggcatggatcccaccctgagatgcacggtctggagtttgcatcccgggctgcactgtgtatgcccctgaggtcatcctgtccagtgttggaatcagcctctgctgggcatcaggttgcctgcacctactccttgtttatatgtgggtgtgtgtatctgtggatgtaccaagtgaaagctttggggaaacatctttgcatgtaaatctttgcatttgggataattaactcaggattaatttatagaattataagtcctggagcgaagggtgggaacagagttaaaattgaacttcctgaaacacgtcacagcgtcaccaaatcgcttggctgggaggactgtgtgcacccagggcccttctgtggggtgggccaggatttagtgtgaaactcatggctgctaggctgggaagagctcgaccacaggtgtggggttttgtctccagtgacattcccagctggctcttgcagcccctgccctagtgacagcatggggtgagggggccagaggaggctggaggtggagccctgcctctaggcggaactgtaccatctgtagttgcagggcaggattaaaaagggacagttttgctgtttgtttgtttgtttttttctgtcatctgactgggtgtcccaatacctgatgtctcctaaaactttttttttttttttttttttttgagacgggcctccttctgtatcccaggctggagtgcagtgatgcaatctcggctcactgcagcctcaacctcatgggatcaagtgatcctcctgccttagcctcccgagtagctgggacgacaggcatgcgccaccacacatggctaaattttaaattttttgtagagtcagggtctctctgtgttgtccaggctggtctcaaatttctgggctcaagtggtcctcctgcctcagcctcccaaagtgctgggattacgggtgcgagccactgtttctggccttatgcacacttttcattgagaacaaagttatttgttgtaagagaaacaccttgataactgttcacacactaaactacccaggtaaccagcacccagatcaagaaacagcattgacaagcccctctcacccccttccagttactaccactctccctgacccaccacgataaccgccgttccatctcctggcttcagaatgtggcctccttttgaaccttacataaatggaattctaccatgtgacctcagattctttcatcatccttgcgagattccaccgtggtgttgcgtgtctttgtggtttgctcatacgtctgatgccttttccaatagacggggcacccaggaggagtcagtggaaacacatgtaccgtggaaacagatcaggtcttgcgctgaaattcggatacctctgaattactgcccatcgtcaaagaaataaagtttatttccctaaaggatgttttgtggtgaataggaaagaatttgcaatcagcgtagctgttaagcccacaggagagcaagttgtattatgttgtgagcctgggttgggtgtgcagagatctggggttcagtctgacgcctctgggccgtggtttccctagatggacatgcaggtggttagatgaggggcccatctagctcagtgctgtgatgctaagcatatacttctcagtgctaagaggttgttttccaaagtgtttgaagtttgctcttaagatcttatttaggccggtcacagtggctcattcctgtaatcccagcactttgggagactgaggcaggattgcttgagcccaagaatttgagcccagcctgggcaacatagcaaggccccatctctaaaaaaaaaaaaattttttttttaattagctgggcatggtggcatgtgtctgcagttccagctacttgcgaggctgagggaaagaatcgcttgagcccaggaatttgaggctgcaatgagctatgattgcagcactgcactccaggctgggtggcagaacaagactgtctctacaaaaaaaatttttaaaaatcaggcatggcagcatgcacctgtaaccccagctacttgggaggctgaggcaggcggatggctggagtccaggaatttgaggctgcagtgagccatgatcgtgccactgcattccagcctgggtgacagagcgagactccatctttacaaaacatttttaaaaaaattagcagggagctactcgggaggctgaggccggcagatggcttgagtccaggagtttgagggtgcagtgagccataatcacgccattgcattccagcctaggtggcagagcaagactctgtctctttaaaaaaaaaaaaatcttatttaccaacttggctcatttctaagtggagcaaaaatgcagtgtctcacttctgctctgcctgaattacctccaggccagatttcttggtggaaggaaggagccgtgtagatacagccagagtctcccaggtgcaaagaccctctgagaggccttgataagtgggcagcttccactgagcagcccccagagatggagactcagtgcccacacagcagcttgttcttccattctgggacagttcttcccattaggaatgttcccttgtgttggctgaaagcctgtgtccctaaattctctgtcagcgtaacggcaatgaacctggacttgggtcttcaggaaccaaagccatggagtcaaggatttggagagatggtatattcatcaccgggcctaacatgatggtctttttttatttttaaattgagacagggtctcactctgtcacccaggctggagtgcagtagtgtgacctcagctcactgcaacctctacctcccaggctcaagtgatcctcctgtctcagcctcccaaagtactgagattacaggcatgagccaccacacccggccatccttctttttttttttttttttttgaattggagtctcactctttcacccacccaggctggagcgaagtggtgcgatcttggcttactgcaacctccaccctccgggttcaagcaattctcctgcctcagcctcccgagtagctgtgattacaggcacctgccaccacagccagctaatttttgtatttttagtagagacgagatttcaccatgttggccaggctggtctcaaactcctgacgtcaggtgatccacccgcctcagcctcccaaatgttaggattacagtcatgagccactgcacccagcctgtctttcctttttaaggctcagtaatattccattgtatggatagactgtggttttttatccattcatcatcggacgctgggacggtttctgccttttggctattgtgaatactgatcctatgaacatggctgtacagatgtgtctttgagactattactgttttattaacaacattgctgtaatgagggatctcaaatctggagtggatctgagaaatcgcctctttcaaccccttatccaatgcttgagtccttccttccagaatcccactgagacttcttctggcctcagatgcgtgggtgggagacatgccacctcccgacacctctgaccaagggcccggagctgggtggcttagggtgcaggaaagaggcttgtgagtgggatcatgccagagggatgtgcatcaaggcatcctctagctacagatgccccaggggaggcagcagtggggctgctgcaggagaaacctggaatggatgtttggacacactttcctcaatggccaggattgatggacagtggaattcatcagacgagtcttggagactgaggcctttaaaaatagatgcagctggctgggtgcggtggctcacgcctgtaatcccagcactttgagaggccgaggcgggcggatcacgaggtcaggagatcgagaccatcctggctaacacggtgaaaccccgtctctactaaaaacacaaaaaattagctgggcgtggtggcggacgcctgtagtcccagctactcgggaggctgaggcaggagaatggtgtgaacccaggaggcggagcttgcagtgagccgagatagtgccactgcagtctggcctgggtaaaagagcaagactccatctcaaagaaaaaaaaaaaatagatgcagctgggagcagtggctcacacctataatcccggcactttgagaggccgaggcaggtggatcacttgagggcaggagtttgagaccagcctgggcaacatagcaagactctgtctctactaaaaattttttaaaaaattagccgggtatggtggcgcaatcatgtagtcccaggtactcgtgagcctgaggcaggagaattgcttgagtccaggaaggtggggctgcagtgagctatgatcgtgcctctgcactccagcctcggtgacagagtgagaccctgtctttaaaaaaaaagaagaagaaagaaaagaaaatgcctcccatggaatctgtttctttttttttttgagatggagtcttgccctgtcacccaggctggagtacggtggcatgatcttggctcactgcaacctccgcctcccaggttcaagcagttctcctgcctcagcctcctgagtagctgggattataggtgcccaacaccacgcccagctaatttttgtatttttagtagagatgtggtttcaccatgttggccaggctggtctcgaactcttgacctcaagtgatccgcccacaccgccgtggagtctatttctgttaggaatgtgtttgttgcaagcaacctgagaaacagaggcttaggagagaggggtgtctcgtgtaacaggaggcatgggtgggtggtccagccgcaggcagctgctcaggcacatctgaggggcctgcgccatctctctctctctcctctggctgagggctttggtcatcctggcctaaagtggatgtcagccaccaggcagggcatagggagtaagggattgagccccccattgcctgcttccagggaaactctgctcttttgtttgggaatgcctcactggttagactgtgtcttgtggtcatctctggctgcaagagagtataggaatgggaggattttgtgttgtggcccctacagaagaggagagcaagggagaagttggttatatggggattgaggtaccagccacacagcatctgtctgcctcacaatcccagcacgttcagctgggcatggtggctcatgcctatagtcccagctactcaggaagctgaggcaggaggattgcttgagcctaggagttcaggaccagcctgagcaacatagcaagaccatgtctctacaaaaaaaaaaaatgaaaaaaaatagccaagcgtggttgtgtgctcctgtaatcccagctactcaggacactgagggtggcgtggggaagatcccttgagcccaggagtttgaaaccagcctggacaacatagcaagaccctgtctctaaaaacaaagaaatgagacgcattagacaaaagttcccaaaagttggactcagtgatgtagatgagagaattacaagataacttttcttttcttttttccttttgagatggagtctctgtcacccaggtgggagtgcagtggcgcgatcttggctcactgcaacctccgcctcccaggttcacatgattctccctgcctcagcctcccaagtagctagaattacaggcacccaacaccatgcagggctaatttttgtattttaatagagatgaggtttcgccatgttggccaggctggtcttgaactccggacctcaggttatcgaccgcctcggcctcccaaagtgctgggattacaggcgtgagccactgcacctggccagggtaacttctctctttgtctctattccctttctgaatatgaaagctttccagttctacttgatatcgtaagaaatactaagtcacccaaagtgtaacacctgttttttgcagtctcctatctaagaactaaccagacccgactctgcttagcttctgagatcagatgagatcaggctctttcagggtggtggggccgtagactgtttttgcaatctctaggaaattttttttaaagccagagaaagataaattatccacattacttaaacaatttttaaaaatatacaagaaagcctagcttatttaaagcccaaaacactgtaattccattggtaacaaagatgttaaacatttaaaatgtgattaaatctaaaattggtggcttctgaataaactgtagttttgaatttgatacagcaaatctgtggcaatgttgaacaaaacaacttatacataatgcatttttatattttaaactaacaaagatgcttcagaaatatagaggacatttttaaaagaattacttatattttaatcttttcaaattttccattttgtttccatcacttccatttttttcagaatattgtgcctcctcaaacatcatggtaagagggtggtgggactagagatggagccctcagcataaaaaataaagttagccgggtgcagtggctcacactcataatctagcactttgggagcccaaggtgagaagatcacttgaggccaggagttcaagatcagcctgggcaacacagtgagaccctatctctaaaaagtaaaaataaaaacttagctgggtgtggcgacacacgctgtggtcccagctactcaggaggctgaggcgggaggatcgcttgagcccaggagttggaggctgcagtgagctatgatcacacccacttcactccagcctagagacagagtgagaccctgtgtcaaaataaagaattgtagcacactcagaatcttcaaatcttgctctgggtatcaaaatcggatgtaggctcttcagctgcagttggaaaggaaattgtaaaatagacctgtagtcaaaaacaaatgggtgactttacaactggtaaagactgacttaagtaggatgtttttagctgcaaatgaaagaaacctctggctgggcacggtggctcacgcctgtaatcccatcactttgggaggccaaggcaggaggattgcttgagaccaggagttcagaaccagcctgggcaacatagtgagaccctgtctctaacaagattttttaagtgagccaggtgtggtggcaggcgcccgtagtcccagctacttgggaggctgaggctggaggattgcttgagtctaggagagatcaagatcgaggctgcagttagctatgattgcatcactgcactccagcctgggtgacagaagaaaaaaagagagagagagagaagaaaagaaactctagtcctgggggggtaaaaaaggaaagaagaaaagaaacctctactaagagtgccttaagaaatatggacttttgcctgggcgcggtggttcattcctgtaatcccagcactttgggaggccaaggtggcggatcacctgaggtcaggagttcaagaccagcctggccaacataacaaaaccccgtctctactaacaatacaaaaattagccgggtgtggtggtgggttcctgtaatcccagctactcaggaggctgaggcaggagaatcatttgaacccaggaggcagaagttgcagtgagccaagatcgtgccactgcactccagcctgggcaacagggtaagactccatctcaaaaagaaaaaaaaagacttttactgtttcacccaaagcttagagatggcagatctggggtcatacaggaccaagttcttccacgagttcaccctgccatcctcagataccctcacctcccgggctgattcttttcatgtctctagttggctgtcatggtcgggggtgtcacatgcaggagaaggaggacatccctggtttcagtccctttttttatttgagacggagtcttgctctgttgcccaggctggagtgcaatggtgtgatctcagctcactgcaacctccgcctcccgggttcaagcgattctcctgcctcagcctcccaagtagctgggattacaggcatgtaccaccacacctggctaatttttgtatttttagtagagacggggtttcgccatgttggccaggctggtctcaaactcctgacctcaggtgatctgcccaccttggcctcccaaagtgctgagatgacaggtgtgagccaccactcctggcctggtttcagttcctttctaagggcaaggacagctctcctagaagtccctcatgtctcagtggccagaattgggttctggcctctccttacacctgtcccagctaggggaaaaggagtgccttgctctgagccttggagaatcaccaaagttcctcccagggactgggagggcccagctgccccaagcactggttgttgggacaacccagcaaagtttgtcccatctttagataccaggacacaacggggggattctgttagcagggagtggggcagaggacttggaggacagcttttggggtcagatccaggactggaactcagattttttttgtgtgtgtgtgtgacagagtctagctctgtcccctgggttggactgcagtgctgcagtcatagctcattgcagccttgacctcccgtgtcaagctatcctcctgcctcagcaccccgagtagctgggacaacaggcacgcaccaccacacctggctaacttttttgtttttttgtagagatggggtctcactgtgctgcccaggctgatcttgaactcctgggcttgatcctcctgccttagcctcccaaagcactgggattacaggcgtgagccactgcgcccagtgagaccccaggtgtcttaaccatgaccccagactgccttctactgcactgcggctgggtgtaagaccccctcccgctgcccagcccagagcctggcctgagcagatacgaatggaaggccagggctgtgactggcagtgttcttcccggctacagtgacagtggtggtgggggagggcaggaatccaggacccccaggccactctacccccactggggagcctctgggactagagagggagtattcagagggaggctgaggctgctggggagaaaggataccccccccccgcccgccttccagaaggggagaaatttcttttttgtttgttctctcaagcttctttttcaagaaacaagcatatggcagcggatggtgcgggggccgtgtttgggtggggtgtgtgcctgcctttgccttttacgtggttgggtgtatttttttttttctccatcagctccaacgccccagctggtccatagggcagtgagacttgaatcacagagacgcttctctggtgtccagaaaaatccggctctttctagtggcgcttccaagggggaagagattggagagctctccagcaaacccaggcctgagctttgcagaggtctgagctgaggactgagtgtccaaggggctgaggatgtggactgtctttgtgaggtggggtacagccagtgaaggagccagtgttaatttcctgaagctgctgtaacacgggccacacagacttcgtgccttaaagcaacagaaatttcaggccgagtgcggtggctcatgcctgtaatcccagcactttggaaggctaaagtgggcagatcatgaggtcaggagttcaagaccattctggccaacatggtgaaaccccatctctactaaaaatacaaaaattagatgggcgtggtggcaggcacctgtaatcccagctactcaggaggctgaggcacgagaatcgcctgaaccctggaggtggaggttgcagtgagctgagatcccactgctgcactccagcctgggtgacagagtgagggagaaaaaaaaattctttttttttttttttttttttttactttgaggttcttgggtacaagtgtgcaggtttgtgacataggtaaacttgtgtcatgggggtttgttgtacagattcttttttcacccaggtattaagcccagtacccaatagttatttcttatgatcttctccctcctcccaccctccaccttctgaaaggccccagtgtgtgttgcccccctctctgtgtccatgtgttctcattgttcagctcccacttataagtgagaacatgcagtatttggttttctgttcttgtgttagtttgctaaggataatggcctccagctccatccatgtccctgcaaagaacatgatcttgttcttttttgtggctgcatagtattccatggtgtatacctaccacattttctttacccagtctatcattgatgggcatttaggttgattccatgtttttgctgttgtgaatagtgctgcagtaaacatacgtgtgcatgtgtctttattgtagaatgatttctattcctttgggtatatacccagtaagggattgccgggtccaatggtatttctgtctttaggtttttgaggaatcaccacactgtcttccacaatggctgaactaatttacaacagtgtataagtgttcctttttctccacaacctcaccaacatctgttattttcttgttcgtttgtttttgtttttgtttttgttttgagacggagtcttactctgttgtccagactggaatgcagtggtgcaatctcagctcactgcaacctctacttcctgggttcaagcaattctcctgcctcagcctcccgagtagctgggattacaggcacacactaccattcccggctaattttttttttttttttttgagacagagtctcactctgtcgcccaggctggagttcagtggcgtgatctcggctcaccgcaagctctgcctcccgggttcacgccattctcctccctcagcctcccgagtagctgggactacaggtgcctgccaccacgcctggctaattttttgtatttttagtggaaactgagtttcaccatgttagccaggatggtcttgatctcctgacctcatgatctgcccaccttggcctccaaaagtgctgggattactggtgtgagccaccacgcctggcccagcatctgtcattttttgactttaataatagccattctgactggtgtgagatgatatctcattgtggttgtgatttgcatttcactcatgatcaatgatgttgattgagtcttttttcataagattgttggctgcatgtacatctccttttgaaaagtgtctgttcatgtcctttgcccatgtttttatgagaacaagagaaatttctattctcacagttctggaggccaaaggtccaaaatcattaccactgggccaaaatcaaggtgccgacagtgccatgctccctccagaggctctcggggggaatctgttcctggcctcttctagctcctgggggctgccagcactcctgggcttgtggccgcatcactccagtcttcaaggccagcatcttccaatctctctctacttcgtcttcacttggacttctcttctatatggatgtccagtcttcctctaccctatttttaaaaaatgtttgtagagctggggtcttgctgtgttgctcaggctagtctcaaactcttagcctcaagtggtcctcctgacttgaagtgatcctgctgccttggcctcccaaagcactgagattacaggaatgagccactgtgcctggcatgacctcttcttcttcttctttttttttttttttttgagataggggtctcactgtcttgctcaggctggagggcagtgacgtgatctcagctcacagcatccttgacctcctgggctcaggggatcctcccatctcagcctcccgagtaactgggactataggcatgctccaccacacccagctaatttttttttattttttgtagagatggggtctcactatgtttcccaggctggtctcaaactcctgggctcaagcaatcctcctgccttggcccccaaagtgctgggcttacaggtatgagctaccgcgcccggccatgacctcttcttataaggatgcatgtgatggcatttagagcctacccggctaagccagaataatcccctacctcaagatccttaatcacatctgcaaagtgattttgccatataaggtaacacaggctctggggattaggacatggctgtcttttggaggtcatttttttgagcctatctcgggtctctaagggcaaactccagcagccattctagtagacaggttctcctgtgatagatgccggccaggtaaaggagacaaatggaagatcccagctgacccacctcggctctgtcccctctgaggggaccttattctcatttatgtggactccctaagccatatatctaggctggagtgcagtggtgtgatcttggctcactgcagccttgacctcctgggctcaggggatcctcccatctcagcctcccaagcagctgggactacaggcatgcaccaccacacccagctgatttttttattttttgttgagatggggtcttgccatattacccaggctggtcttgaactcctgaactcaagccgtgtccactctcccaaacagctgccccctcttggggggtacagcagcgtcagcctggtgtgccctcagggtgtatccgttatttatcttggactgcataaaccaatagcccaacattagcagtgtcaaacaacagtcatttcttcttttactcttcacattgtgagagttgtctgagctcagccagatgggtcttactcaatctctcctacaattgcagtcaaaaggttgccggtgggagttggaggctgcagtgagctacgatcgcaccacggcactccagcctgggcaacagagcaagatcccgtttctaaataaaaagttagcagggcttgaggtcattttgaagatgtttcacttgctggcccggggcctgagccgaggaacagctggggccccttgggcttctctgctgccccccggcccctccagcacggtggcctcaggatagtcgggcttcccacgtgtcagctcagagtccagggcaagggtctgagagtgagtgagtggctgggggaagtctagcgcctttggggacctggctgcagaggtcacgtgttggcgctgcccacacattctgttggttcaaagtgggtctttattcaaatcacattcaagaggagagaattagatgacaccacttgttgggagaagtattaagaacttatttatttatttttttcactttgggaggccgaggtgggaagatcctttgagcccaggagttcgagaccagcctgggcaatatagggaaactcccatttctatttaaaaaaaacaaaaaaccaaaaaacttatttatttattttttagagacagggttctcactctgtcactcaggctggagagcagtggtgtgatcacagttcactgtagcctccacttcctgggctcaagtggtcctcttgcctcagcctccccagtagctgggactacaggtatgcactaccatgcctagctaattttaaattttttttgtagagatggggggtctcactatgttacccagtctggtcttgaactcctggcctcaagcaatccttctgcctcagcctctcaaagtgctggattacaggcatgagccaccacacctggcctaagaatgtattgtcagatttaaaaccattgcaggaggatggaccagagaagagggccctggggccccagaatgggggtttatctgccagctggattccaggggtctgagtacccaggtgtctggggtgggagagtgggtgcaggctccaggtgggcgtgtcccctttgggaagggcgggacagggccctccagagcccaggcccaggctctgggctgaggctaggacagtctcagagcatttcccgctggacagccccagaatctgactgcagtctgtgccaagagcacttcggcgttctgctccactcctgccagccccaccacggacgtcacaccccatcgggctcccttgtgccttagtgcctttgcctgagctgtcccctctgtctggactgccccatccctcaccattcaccttcttcatggctcatgattcttccaaacttgcatcaacggcccctctcttcggaggcctttccaggccttgttatgtgtagcaggcccgggcacacacagatgaaagcaatcagccctgttctccaggagccagtgcatgggggctctgacacctccacatcctggaggaggagggaaggaggggctgagggagcccaaccgaggggcacaacaggaggtgttgacgagcccacaagagctaagagggagccagcagcggggaagggcatttcttaaaaagggcacagcaggtgcaaaggcctgagcgagagtgcaaggcccacccaggggcctgcagactggagtgtggggctctggagggaagacaggttcagcttgatctgtgatgtgactcctgatgggacagtgagcctttggagggtgaggtcatgccctgcgcgtctctgtgtcccagcacgactgtggctggggccagccaccttctctgtgaaggttttcactgcattcagactgtgctgggactggccccaggaggacttggactagcgtgtgtgtgagtgagtgtgcatgtgtgcacacatgtgtctgtatgtgtggacatgcatgtgagtttgcatgcatgtgtgtgcatatgtgtgtatgcatgtgtgagtgtgcatgcatatgtgagtgcattgtgtgcacaagtacgtgtatgtgtgtatgcatgtgagtggctatgcgtgcgtatgtgtatggggtgtctgcatgtgggtgtgcatgcgtgtgtgggtgtctgcatatgtgtgtatgcatgtgagtgggtatgcgtgtgtatgtgggtgtgcatgtgtgtgggggtgggggtgtgcatgggggtgtgcatgtatgtgcatgtgtgtgtgggtgcatgtgtgtgtgcatatatgtgtgtgatatatgtgggtgtgtgtgcatgtgggtgtcaatgtgtgtgcatgtgtgtatgcatttgagtgtgggtgtgcatgtgtgttcatgtgggtgtgcacgtatgtgtgtgtgtgtgtgttcatgtgggtgtgcgtgtgtgggtgtgcatgtatgtgtgggtgtgtgcgtttggggggtgtacatgtgtgggtgtgcatgtgtgtgggtgggtgtgggtgtgcatgtatgtgggtgtgcgtgtgggtgtgcatgtatgtgtgcgtgtgggtgtgtgtgtgagtgtgcatgcatgtgtgtgttgacttgctagtgctcacacttacctctggggcagagatgtgcttgttaggtgccccctccctctctccactccattccagcaaaggtcactgagtgtcctctctagtcttaggaacgacactcgacagtggacaatgagaacaaccaaacacttcctctcttcccccctccccccattttgaaaaattctattaaggccaggcatggtggcttatgcctataatcccagcaggttgggaggctgaggtgggaggattgtttgaggccaggtgttcaaggccagcctgggcaacatagcaagaccccatctctacaaaaaaatttaaaattagccaggcatggcggtgcacacctgtagtcccagctgcttggaaggctgaggtgggaagatggcttgaacccaggaatttgaggctgcagtgagctatgatcacaccactgcaatccagcctgggcaacagagtgagactctttctaaataaaataaaataaaatataaaaacagaactactatacaattcaacagttccacctctgggtatataccccaaatcattgaaaacaggtttaccaagtgatttgcatactcatgttaatagcagcattatttgcaagagcggaaacgtggagtgcagttgcacagtcacacctcactgcagccccaacctccgcaggctcaagccatcctcccgcctcagcttcccaagtagctgggactacaggtgtgcaccaccacacccagctaatttttgtattttctgtagagatggaatcttgccaggctggtctcaaactcctgagctcaagcaatcctcctgcctcagcctcccaaagtgctgggattacaggcctgagctactggacctggctggtagtcctatttttaattttttgaggaaccgccatgctgttttccacagtgcctgtaccattttgcatccctaccagcagcacacagggttccaatttccccacgttctcaccagctcttgtttttttcctgtgtgtggttttgtttgttttgtttgtttttgttttagacagagtttcactcttgttgccccgcctggagtgcaatggcatgatgtcagctcactgcaacctccgcctcctgggttcaagcaattctcctgcctcagcctcccaagtagctgggattacaggcatgtgccaccatgcccggctaatttttgtaattttagtggagatgggtttcaccatgttggtcaggctggtctcgaactcctgaccttagatgatccgcctgccttggcctcccaaagtgctgggattacaggcatgagccaccgcgccccgctttcttgtgttttttatagtaggtatcctggtgggtgtgaggtggagtttagatttgcattttgctaatctttagtgatgttggacatcttttcatctgttttatggccatttgtatatcttcttaggggaaaggtttactcaagtcatttgcctattttttaattggattattattattaatggagatgatgtctcgctctgttgcccaggctggtctcgagctcctggcctcaagttatcctctcaccttggcctcccaaagtgctgggattacaggcatgaaccactgcatccagtcttagttgttgagttttaggaggtgtctgcatatcctggatattaatcccttaccgatatactatttacaaatattttcacccattctgtggtttgcctttttattccattgattctgtccaaaacttctctttactcatagagcaaaggttgtatatctctaaaccaagcttcttcccttgcttctctctgtggaaacaacagggtattatccttccactcctgtacccagagaactcctattcactcttgaaaacccacctcaacagtcatcaactcagggaagccttatttgtcaggcccctcctcccccaaaactaagtaaataaaacatttaaataaaacataggtaacccctttccccattgtcaagctctgtgcctgcgcgagcttctctgcttgtccttctttcgtggtcctgtagttcttttttttttttttaaataagatggactctcactctttcacccaggctggagtgcagtggcaagatctcagctcactgcaacctccaactcccaggttctagcaattctcctgcctcggcctccctagtagctgggactataggcgtgtaccaccacccccagctaattttttgtatttttagtagagatggggtttcaccatgttggccaggctggtctcaaactcctgacctcaagtgatcctcccacctctgcctcccaaagtgctgggattacaggcatgagccatcgcacccagcctggtcctgtaattctctctggacacactggccctgtgagctggaggagggcaggcggagcctggcacagagcagcctcttggtaggtgttgagtgaatgagtaggggtggtgaggggaggccacggaaggcacccaggctgtgttcctcccactcccagccttgccacgacctaccaggtctccagctcctgctgagctcttgcagggtggcccctccccacttacagctcactgccttggactaggtcccagccaatggcccggcggaggtgtcctcactgttcttacccagtatgacctaggcgggagccaataagcacagggaatgagtatcaccctgagggttcaaaagtgtgcaaggaagggaggaagggaaggaaggaaggaaggaagagaagggagtgggggagggagagagagaaggaaggaaggaaagaaggaaggaaggaagggagcaatgaatgaatgcatacatcaaggaatgaatgaatgcatatacacaaaggaatgaatgcacacaccaaggaatggatgaatgaatgcacacactaaagaataaatgaatgcacacaaaggaattaatgaatgtacacaaaggaatgcatgcacacaccaaggaatgaatgaatgcacacaccaagaaatgaatgaatgaatgcacacatgaatgaatgcatacacacaaaggaattaatgcacacaccaagggatgaatgaatgcatacaccaaggaatgaatgagtgttcacaccaaggaatgagtgagtgaatgaatgcacacgaaagaaagaatgaatgtgcacaccaagtaattagtgaatgaatgaatgcacacaaaggaatgaatgagtgaatgtacacaccaaggaattagtcaatgaatgcacacacacaggaatgagtgaatgaatacacacaaaggaatgaatgtacacatcaaggaattagtgaatgaatgcacacacagaggaatgagtgaatgaacctgccacttgtggagagtgaaaaaagcctgagagatccccagatgagggagcccccatgtgtgcccctgccgttgagaggcctggacatgctggtgcatggtgtaagggcttgggcttgggctgagctggctcacaggcgacccatcaagtgtcacaaatgaccttgaaccgctgccacaaatgaccttgagcagcacgcttcccctcccgagccttagcctccccagatgtaacatggattagaagaaccacctcatggtgcttttctgaaaatttggtaggcctaacgtggtggctctcgcctgtaatcctagcactttgggagggaggccaaggtgggtggatcgcttgggctcgggagtttgagaccagcctgggaaacatagtgagaccctatctgttttgttaaaaaaaaaaaaaaagaaaaaaaatttggtggggtgatgggtgtgccagttggagagctgtgacatttgtttttttggttcaaccccaagccagtgcagacaagtgaccctccccagccagcgggccaggcctctcagtgtcaccctggctgaggttgttcgtgtatgtgtgtgtgtgtgtgtccctttctttactgtcctcattctttgcatcacgtgtgtggtcttttctgtctcatacacgcacacccgtcgcatttgcatgctctgacacacagacacacattgatgcttccttttttaaattttttatttttggaggcagggtcttgctctgtcgcccaggctggagtgcaacggcatgatcacagttctctgtagcctcgaactcctgggctcaagtgatcctcctgcctcagcctcctgagtagctgggaccacaggtgtggaccaccacacctggctaattttttttatttttgtagaggtggggtcttgctatgttgcccaggctggtacactcctgcttctttatgtatgtatgtatttattctctttttagaaaattatttcattgaatcgtcctttaagcacacacttttctgaagctctggggacacttggggagaagaggaggggagggttctagctgtcctgtagggccacattggtcctgggtgcaggacaagcccaggcaggagaaacggaccctgctgaggggtctcctctttgcctcttccctgggtcccagctgggtggtctcgcctgttcactgccgggcagggttgggcagtgcagagccgagcccaccgctgtgtcatcattccacgggggaaggggcttgaaggctgcgttgtggggtgatgggaacccggatttagttggtatgacccgagctcaggtttcagctttgcgacatccttgtggtggggtcttcaggtgggaattcctcctctgtaaaatgagagcttgtgagaattaaactggtcccggcatttgggaaacagccctgtgactccttccgtctcttccctccggagggggcggtccttgagctctactgagcccatgccagcgagagtcgtcatggccgagcccctgggccagattccaagttccatgccaccttggcacttacttttttggctccagtcctctttggctgtcccctctgtgaagggcatctaaggtggtggatgggggaggggagtttgtttgtttgtttgttttggttttttcttttttcgaaaaggagtctcactctgtcacccacactggagtgcagtggcgtgatctctgctcactgcaacctcgacctcctgggttcgagcgattctcctgtctcagccacctgagtagctgggactacaggcacctaccacagtgcctggctaatttttaaatttttagtagaggtggggtttcaccatattggccaagctggtcttgaactcttgacctcaagtgatccacccaccttagcctcccaaaatgctgggattacaggtgtgagctaccgcgcctggcctttgttgttgttttgagacagggtcttgctctgtctcccaggctgcagtacagtggcacaatcatagctcactacagcctcaaactcctggctcaagtgatcctcccgtctcagcctcccaagtagctggcgccacaggcatacacccggctaatttctgtattttttgtagagacaggattttgccatgtttcccaggctggtcttgaacttctggcctcaagccatcctcccaccttggcctcccagagtgctggaattataggcgtgagccaccatgcccggccagaaaggggagtttatttaaatgggccgagccaggagctttgtcttagccttgttcttctgtctacatgcccttttcccacctcccactaggctgcacttcactggggtaaatcggtcagaaccagctagtgggaacaacctgtaacacctgtttccagacatccaggctttgggctgcagaataggctcgcacctgttagctcactctctgctagcctcctaactggccctgagcgccaggtgcagggtgtttgggattggaaatcacagctggatttctgttagttcactgtcaccctggccccagggctggctagaaagtgggcgctctgggccggacttctatgggggtcccccagcctggaggcagccctgccttgagtcagggcagcactgattcagacgtggccacgagtgcttggctaatttttggctcagggtccgggcaggcctccagctcttggcggccggcaaatctgctgctgtctgggcaaggagtccctggcaagacggggcaggtggcaggcaggcagggaagctgagcttcttggagtctggaatagggaacatccctagaagatgacccaggccctgcacctggctgggtgtaagagtcccctgtgaacttaaaaatacagtgtccagggctgggcgcggtggctcacgcctgtaatcccagcagtctgggaggccgaggcgggcggatcacctgaggtcaggcgttcgagaccagcctgaccaacatggtgaaaccctgtctctactaataatacaaaaattagccgggtgtggtggtgcacgcttgtaatcgcagctacttgggaggctaagtcaggagaatcacttgaacctgggaggtggaggttgcaatgaactgaaatcatgccactgcactccagtctgggcaatagagtgagactccatctcaaaaaaaaaaaaatacagtgtccagggccccgctgcccagggagcggtcacctctgatgaggtagggcacaggagcccgggcactgaacagcaggtgttggcagcagctgagctaccagccgtccttgcttcacaggtgggcggagcaaaatcgggagctgggtgatgggacagatgtgacagtcgctcttctactattctcggactgtaacctgggatcttcccagtggacttccctccacccatcccagctctgccttttgggggcttcatgtctttctcattattattattactttaatatttcagcttttaggccgggctgtaatcccagcactttgggaggccaaggtgggcagatcacttgaggtcaggagttcgagaccagtctggccaacatggggaaaccccgtctctactaaaaatacaaacattagccaggcgtggtggtgggcacctgtaatcccagctacgggggaggctgaggcaggagaatcacttggacatgggaggcggaggccgcagtgagccgagatcacaccactgtactccaatctgggggacagtgagactgtctcaaaaataataataattttaacttttattttagattctcagggtacatgtgcaggtttgttacaaaggtatattgtacgatgctgagatttgggatacaagtgatctcgtcacccaggcagtgagcatagcacccaataagtcgtttttcagcccctccttttcccctctctccctgcttttggaggcctcagcgtctgtcattcccatctttatgtctgtgagtacccaacgtttagctccccttataagtgagaacatttgatatttggttttctgtttctatgttaatttgcgtaggataatgatgtccagctacttccatgttgccgcaaaggacatgattttgttcttttttatggctgcataatattccatggtgtgcatgtaccacattttctttatccattctaccgctgatggacacatgggttgattccatgtctttgctattgtgaatactgctgctctgaacagatgcgtctctcaccttattaagggaagttgactttttgaacccaaaggatggacatttgggatatttctcttccttgcgagtgtctgcgttttgggctgctgagagaggcgtctgggctcctgttcccattgctccctgcgttgcagtgtgaccaaccatcctaggtggcctaggactgaggggtttcccaggagacggaactttctgtgtaaacccaggaatgtcgagttgggcccagttggctgtgtgtcagctctgcgtgtgagcagctggtctgttccctgcatccctgtgaatgtgagaagcgtggtcttcctaccgcatggtgacagcaaggacaccagcaaggctggagacagacagccttcttccccgctgtgcactggctgaggcctggagctagtgcctttcttgtctctaagatagagtgatgctggaagaaggatagtagctcatgcgggccaatgctgccatcagaatttttacttttttttttttttttttttttaatggagtgttgctctgttgcccaggctggaatgcagtggcgccatctcggctcactgcaacctccaccgccggggttccagcgattctcctgcctcagactcccaagtagctgggattacaggcgcccgccaccacgccaggctaatttttgtatttttagtagagacggggtttcaccatgttgtccaggccggtctcaaactcctgacctcaagtgatctgcctgcttcaccctctcaaagcgctgggattacagacatgagccactgcgcctggccctgctatcagaatttttattttttatttaaaagacagggtcttgctgtgtcacccaggctggagtgcagtgttgccatcatagctcactacagcctcgagctccttgtctcaagcagtcctcccgcctcggcctcccaaagtgctgggactataagcatgaaccaccgcacccggcctctgccttcattttctgtttagaaccattcccactttacaaatgaaaaatctcgggctttcaggactcacccgaggtgctcctagcagacgtgggcctgggtctcatcttcccccgcttctcctgctgcattcttgctccaggcacgtggaacctgcctctccctccatctgaggccctttgcagggagtggctgtctctctccatgctccccaagtgcacccacctgggctgtggctcgggacagggggtcctacaagcccggatgaccgagacaaggagctggggatggcccacagcccagcccctcttccctctctgtgtccctccctcctggagtccctggttccttcctaaacggattagagcctttaccggaaggagccggccgctgtctggggcagccggggggccagggctagatggctgtctggtgcctcctgctttgccctgattcgatttgggcctcagcagctgggaggctggcagccctaaggcctttctgggaatggttcaagggacgggcttgcaggggatggcttgggggagggggacaccttccagcccccaggcaggcagacctctcagctggatcttttatgaagtctggtcgcatgcaagaccctcaagcgggcttcctgccacggaacatccccagccgtggccactggccacctcgtggttcatcagcgggtgtcatccaaggcctgtgtcccatccatggcctgtcatcccctccgcatcccttaatacagcagatttcaaacttctataaaattgcaacccagaagaagaaatgtcttttataaacatttagcagcaaactcaacatacattttggccaaacgcccaccggccagttgtttaaatcaatatttatccacagccaaaaagcagaggagagccagaactgaggccagagccgagctctgatgcatctctcatttctcgggatgtttctgtccctgtggttggacacctctggccttgtgaagtgtgatgcactgtcacatctcctgttctgtgtcattggccaatgatcatatatcatgacctgctggaaggcctgtctgtggctgggaccacacgccttgggccttatgcacactgggcactggtcgggatcctggggtgcaacagtggcaggcagacctggtttctgccctcaaagagcttacagatggcaggggcacccatggcggcagaagacaccccaggcctggtgccctttgtggtgccagccccatggtcctcctgcctgggccttccctaccccattgggtgcagaaactccctgtctgcaggtaggagacagagggtaggttttcaggctcccttgggaactgcagccctgctctctgccatcaacacccagcaggggccacacagagagcaccgggactgagcccatagaggggaaccgagaggcccctgcctctagtctctgccttctttgcttggattggtgcagggacagctgccttgagggcaggccctggcactggggcagcctgtgggtgccccctgggtcaagaaggagaggggcagggtagaaccaggagccaaaggaggctgatctttgcatctcatgggtgcccagctggacactgtcatacccaggaagcctgtgccatgccatggggacccacaactgggggccctggacttgagggggaggatgcagctctgtcccccaggaaccccattgcaacaggacacagtcctgccctggggagcccctgacctgagacaaagcagcctcggccctgctgtatctttccatacccctgatgccaagtctcctggctaggagggaaactgaggctggaaggcctcggcgggggtggcattggcctcgggagcatgtggcttgatgcagaaatgtgacggcagagctcagaggcatgcggaagggaggggaggacatcaccggctcctgacccagctgggcttcaggttgggggtacaggaggtgggcaagcaggttggacaattaaaagcttcgatgaggctgggtgagtggcttatgcctgtatttccaacactttgggaggctgaggtgggcagatcacctgaggccaggagttcaagaccagcctggccaacatggtgaaaccccatctctactaaaaatacaaaaattagccagacgtgtggtggcacctgtaatcccagctacccgggaggctgaggcaggagaatcactcgaacccaggaaggggaggttgcagtgagccaagattgcaccactgcactatagcctgggcaacagagtgagactctgtctcgaaataaaattaaatttaaaatttaaaaaagcttcaaggacaaccagcagatgatggcaggaccaggaagggtgcttcaggcagcgggaactgaacctgcacagactagggaagcatgaacatcggtacatctgggagtggcacagcttagagggcctggagcatggagtgtgagggggaactggagtgagggacaggagaccaggtaactagaataccaggctgaggagttgagagctaatatgggcagtagggagccatggagggtgtgtgagcgagggagggctgtggccagaattgcacacgccgggagaggtggcagttggggcctgtccaacagactggtcctggtgctgggctcagcttgggtgtgcagacttaggagggtgtgccacaaggtgtgagttatcctgccacctgtgcccaggcctgtgcaggctctaatcccatcacacataaagcccttgggcccagggaaggtcagccctggatacagaggcggtcttgggagtccgggggtcaggtggattggggtgggcagccaccatatgagacaagccccctgccttgtgcccaccaccactgcctcctccctccccacaggcgaccatggccttgctgggtaagcgctgtgacgtccccaccaacggctgcggacccgaccgctggaactccgcgttcacccgcaaagacgagatcatcaccagcctcgtgtctgccttagactccatggtgagtgtccccacccacccaagaggaggggacagggtgagcgtccccacctgccttgtagctcaagtcctacctcagctactcgaaggagctttcactgacctgaacctcagtttatctgactgcagctagggccacgatgcctgcatcaagggtgtgagatgtgagacttcagcgagatccagtacataaaaatctagccctggggccgggcacagtggctcatgcctgtaatcctagcactttgggaggccggggtcggtggatcactaggtcagtggttcgagactagcctggccaacatggtgaaaccccatctctactaaagatacaaaaaattagctgggcgtggtggcatgcgcctgtaatcccagctacttgggaggctgaggcaggagaattgcttgaacctgggaggtggaggttgcagtgagccgaggtcgtgccattgtactccagcctgggtgacagggcaagactccgtcttaaaaaaaaaaaaaaaaaaatctagccctggaataaacactggctctccgccctcgtccccttgtcccttcacccctcttgccattcccactttgtccctgggatgaaccacatgcctatctcctagcaggtgacctgggggataatgtgtggggagccattcactagaaagatgtaatccccaacgttaaagcaagagttctaactgcatctcgggcaggaagagagaaaccgagctttgtataatacatcactcccctggcgctattgcctacatacctagacctataacaatttatcccaaatgaggacatcataataccattttcctctagccttttcctggggggaagttctgtgatggaagtgttaaaaaaaaaaatctggcccagcacggtggctcacgcaagtaatcccagcacttttaggggccgaggcgggtggatcatttggggtcaggagttcgagaccagcctggccaacatggcaaaatcccatctctagtaaaaatataaaaattagctgggcctggtggcacatgcctgtaatcccagctactcgggaggctgaggcaggagaatcacttgaaccctggaagtggaggttgcagtgagaagagatagcaccactgcactcccgcctgggcaacagagggggactccgtctcaaaaaaaaataaataaaaataaaaaaattagactggcatggtggcacattcctgtaatcctgcctactcaggagggatgaggcaggagaattgcttgaacctgggaggcagaggttgcagcgaaccgagatcgtgccactgcacttcagcctgggcaacagaggagactctctcaattaaaaaaatttttttaaataaaaataaaattaaaaatctgtctaacatcagttagctgcgctcctgcattttaggatgatgaagcacagagagggtagtaccttgcccaaagtcacacagcatgaccagttttgttttgttttgttttgttttgtttttgagacggagtttcgctctgtcgccaggctggagtgcagtggtgtgatctcgactcactgcaacctccgcctcccaggttcaagcaattctcctgcctcagcctccccagtagctgggactacaggcccccaccaccacacgtggccagataatttttgtacttttagtagagaccgggtttcaccatgttggccaggatggtcacaatctcttgacctcgtgatccgcccacctcagcctctcaaagtgctgggattacaggcgtgagccactgcgcctggcccagcaagaccagtttttagagcgaacttctgggtacaaagtctccccgaaaaataaaggacctccttcaagctgttcctgctgtaggtggctcaagggctgcttaagtggtgtttggggcagcggtgggagacacccctggaaaaggggctgggtgccacactctctccatgatgacccctcccctatgcagagtgactttcatgaggagggggccccaggagctcagccctgtgtcccaaagtactgtgagcttggcattgatggaggtgtggctgatgtgggcagtgatgggcgatgccatggccactagtgacatgtggctatttgcaatttttttttttttttttggagatagggttttgctctgtcacccaggctggagtgcaatggcgcgatcttggctcactgcaacctccgcctcctgggctcaagtgattctcctgcctcagcctctggagtagctgggattacaggtgtgcgccaccacacctggctaatttttttgtatttttagtagagacggggtttcaccatgttggccaggctggtctcaaactcctgacctcaggtgatccacctgcctcagcctcccaaagtgctgggattacaggtgtgagccactgcccctgattcatttaaattcgaattcgttaaaacgaaataaacaactcagttgttcagttgcaccagcctcattttacgtgctcagtagtcagaagtggctggtgtctatggattggacagtgcagaggtagaatgttttcatagtcatagaaagttacactgggttggccaggcgcaatggctcacgcatataatcccagcaccctgagaggctgagtggggcagatcacttgaggccaggagtttgagaccagcctggccaacatggtgaaactccatctctactgaaaatacaaaaattagccaggcatggtgatgcatgcctgtggtcctagctattcgggaggccgaggcaggagaatcgcctgagcctgggaggcagaggttacagtgagccgaggtcgtgccactgcactccagcctaggtgacagagcaagactttgtctcaaaaaaaaaaaaaaaaagttctacttggcagcagtggtctagtgagtgtttcagagcctccttggaggagcacatgaccctatagttatcctagcagtgcgaacaagacaggctcccccgtccctgggccttttaagggtttcctgagggaccctatgggtgacaatgatatttgcttagcagtaacttaagtccagcctcctccaaatgctagggtcttttggtgacctgtagggagggtgggctgaagggatgtgccttcgtcacccgcccccaatctcatcctcttccccaccagctctgggtgcctttaggtgggtgagttttctgccatggtctcggcgtcttcagctgagcggtgactgtgggatgaagcagctctttcagctgtgatggatgagaaacagctggatttatttgttttattttttgttaatagtctacagtgttcccgcgcagaaagggaacagcaagcttttgttttcatcttagaagaaaatgaatgccctgtgttttaattttccagtagggaccctggaggacaggcttcctggccccacgccgcgtgcaccttcctaaccagagcgactccaggctggggctggcacaataggcaagattatggcccagagaggttacctgtcccaggccacgcagcacagaactgcgtttggaagccagactttatagctgccagcactacctgactcagatgaaaaccagcatttattagacacaactgcctgccacaggcttcacagtcagggttttcctggtggggtaggtcagagacctgagatgctggtggtcttggttgtagggaccccctacattaaggcctctgggctatggggctgcagacctcgactctggggccatgaggatagccagctgcctgtatacccatatagggtgtcccagtttagagatctttttcctccaaccattgaatccccatacccaagcccagtggcactgtggaactgggctgcttgtccccaattctatagacgtggaaactggccacgcagagtggctcacgcctgtaatcccagcactttgggaggctgagacgggcagatcacctgaggtcaggagtttgagaccagcctggccaacatggtgaaaccccatctctacttataatacaaaaattagcaaggcgtggtggcgggcgcctgtagtcccagctactcgggaggctgaggcaggagaatcgcttgaacctgggaggcagaggttgcagtgaaccaagattgtgccactgcactccagcctgggcgacagagtgagactgtgtctcaaaaaacaaaacaaaacagatgtggaaactggagcccagaggagggacgtgacttgctcaagtcccacagcagaagtggccgaggtgggattgcagccccagtctgtccagtccccgcctgtcctgcagttcttcccacctcctcctcatccaggacttgagaggggccaagaaaacccagcacggcattgtccctggggctggggctaaggggggcctaccccaaggaggaggaccttggagggaggagcagaggacacttgtcctcctccaccccccatcgccaatgcctgcagggccatttcattcagtcccactacagaatctgagaccaagaacagtagaggggccgtctgtccctggagctgctgctggggtctcaggcagctgggagctcacatcccacccccgaagtggatactagaggtgttcggagtatggggagcccttccgctcacacagcctgcccttcccacagtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgtgagtaccccagggctccggagggccgggcccgccatttcccgagggcaggcgctctagcccatctctgggtccccaaccctgtctagccagggtggcggtgtgtggggagtgaacctaacaagctaggttgtctgagattcccgatgtggtgttattgaggcagcccctgagttgatagagactggctgggtgaaccccagggtaggccagagccagccacttccatctgccttttccagatggggacaccaaggccaaggctgctgctcagttcttcctcttaactatgtattcctgaacacaaggaccaaatgcacttatgccaacacaattttttttttctttaaatgagacagagtcttgccctgtcacccaggctggagtgcagtggcacaattttggctcactgcaacctctgcctcccaggttcaagtgattctcctgcctcagcttcccgagcagctgggattacaggcacctaccaccacgcccaactaattttgtatttttagtagagacggggtttcaccttgttggccaggctggtctcgaactcctgacctcaggtgacccgcccacctcagcctcccaaagtgctgggattacagatgtgagccgccatgcctggccatgttccaataagatttattgaatgcctgctgtacatagcatcttttctgatgctaactcacctaccctgacatcaacctgagggggcaggcactgtcatggctatagtcagggttaacatcttaggccaggtgcagtggctcatgtctgtagtcctagcacttcgggaggctgaaatgggaggatcacttgagcccaggagttggagaccaggctgggcaacatagcaaggcctctgtctctacaaaaaatttaaaaattaaccaggcttgatggtgtacacctgtagtcccagctgcttgagaggctgaggcaggaggatcacttgagcctgggagttcaagactacagtgagctacgatggcacccctgcactccagcctgggtgacagtgagtccccatctcaaaagaaccatggtatagcatgaggttaagagaacgggccgcctgggtccacaactgctgtgcctcaacccactcatctgtgaaaggggaggacgggtgggtctgagggttaaacgaattggtaccttgcaagcacttagggcagtgtctggcacttggttcacactcagtagacaccagctgttgttactattattagtattcacctcacacccctaagatcagctgtttcagggaagggcatcccccagcgctgggcctagcattactggggtgcagccgcatccccagccagccccccacccccctcagccctcagagcctagaccttctccagggccaggatgggggactgggccgggtagaatggacagcagcaggtcgtgtggcaccccagccgcccagagcctgaggcggtgcacctgccttctagagccacgcagagccgctatttatagcaccaggaactcggctggtttatttcaagctccgcagatcccagaggagaataggctccaagctgggagggggccgcaggcccctcctctcatctcctttccaatgcagcttctagaacattccccaaggatccaccaacactctccggtccccaccctggcccagcctggcatgaacctgctgtttgcaacccacggcctccttggagcaggggttggggggtgcctcccaaccctctgccggagggttttctctccctccggcagagcagaaaacggtggcatagattggtcaagacagtgttcgtgtcagagcacagaaaggcatggatggggccgggcatggtagctcacacctgtaatcccagcactttggtcaggagttcgagaccagcctggccaacatggtgagaccccatctctactaaaaatacaaaaattagctgggtaaggtggcaggcgcctataatcccagctactcgggaggctgaggcaggagaatcacttgaaccctggaggtggaggttgtagtgagccaagcttgtgccactgcactccagcctgggcaacagagcgagactctgtctcaaaaaaaaaaaaaaaaaaaaaaatagaaagacacagatggaacattcatcgaacctcagttctgagctggaatagctggcctcccgtgaacattcacagactgaggctcagagagagaagggactaacccaaggtcacacagcaaattagaggtgaccagaggtgaggcccagccctgggaactctgagatgaccagccctggccctcagtggggtggttggaatagggcttgctcactcattaattcttcattcattcattcacttgtgtatcacattgtgtgccagtctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagtaagatccttcctcattccatttgggggccccagggagggtgggagcctcggtccccacccagcagagggggccccctcctgtcccactatgggccctgggcaaagccggaccccaaggcatggggctactggctaccccagcccttcctcatctctgcattcccagacacagaagttctgctccagccgttttccaaacctccacccctactgtccctgccctggctcaagtcactgccacctctcgcctagaaatagccccaggcttgccacggtctccctgcttccagaccagctctctacacctgccctgcaaccaagggtatcttctcaaagcacaagtctgatcattaatgaagctcttctctccacagccttcgggggctccccatcaccctgagcatggcacaggggcccacacacccatcctcatcccctccacaccttcttctcccactaggtgacagggccctactgacctctctacagaaccacttccagttctccagcactcgctggtgcatttcacatgccctggacttcgcgctgttacatcttttgagactgcctttcccctcctgtgtctggcagacacctgcgtggcactgaggctctgctcctggaagccccctcacagtgggtttaggcccctctcttggcacccacagtgccctgtcccctctccagcccaagagctctccagagtcaggggctgtgtctgccctttctagctgtctccagcctacagttcagagcccagcaacagcaggtgcttggagaatgtttgttgaatgactaagtgaaggctgattgctcagccatgtctttcctgcaggaagaggagacctggcctcccttgggaagcgtcaggttgcagagggcctcagggccccagtggtggtcttcacacgccctgggaaacatcgggcaggtccctttggtgctcagggtcccacctcattcatttctgatttggctttatcccttctcctactgtagcctttggttttatggagcaaaggtctgtgaggaaacttctgctgttcttatgtcagaaggaggggtacccagaggccctgggtggtcacactggccaccctgggatgggggacttgccacgcatggttggctgtgcctctgtcgacacttttgccagctgcagggccccgcgcccctgcccgccttgccctggccccccttgtccactttgggcagaattcaaggaggctatgagaggatgggcctctttctggctcagggtgggggctgtagcatggaggtgacaacagatatcccagtgcccagtcctcagtccccagcctgcctcccctcctctgtgcccccgagcccccatctttgttcctgcgtcttctcagtctgtctctttctcctctctcctgtctttgttgttgttgttgttgttgttgttgttgttgttgttttgagatgaagtttcactctgttgcccaggctggagtgcaatggcatgatctcggctcattacaacctccccctcctgggttcaagcaattctcctgcctcagcctcctgagtagctgggattacaggcacctgccaccacacctggataatttttatatttttagtagagacggggtttcaccatgttggccaggctggtctcaaactcctgacctcaagtgatccacctgcctcggtaatcccaaagtgctgggattacaggcgtgagccaccacgcccagcctctcccatctttttctcaatcccctatttttgctccctctccacttcctcttcttcttactttctctcccccctctcggtctctctcccttcctccctacacctttttttttttttttttttttttgagatggattctcgttctgttacccaggctggagtgcagcggctcactgcaacccacctcccgggttcaagcgattctcctgcctcagcctcccaagtagctgggattacaggcatgcaccaccacacccagctaatttttgtatttttagtagagacggggtttcatcatgttggccaggctggtctcgaactcctggcctcaagtgatcctccctcctcagcctcccaaaatgctgggatgacaggcgtgagccaccacgcccagcccttatagctttttccttgcagcctggctcatgcaagtccccacttctccgtctcttctgccctcttttctcctaccggattgtctgcctctgctctgtcctctgggcccttgagtccccgatttcccctccagccaggtgcccagagtggagaggggcttggtcggggagggcagcagggaacctgcttggtgggggagccccagccccccagatgcagacaattgggccttgtccacaccacccacccccagcctgcaggcggttattctgcacaaagtctgcagttatgaggggtccatgggaaccccgcaccaaggggagccactcagcactgcccccactctggggcacagcagccccgaccccagcctggctgccctctcataccaggcccctctcctggactctcccctacaggcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggtgagtgaggtagccggcccggggctgggctggggctgggccagggccgggtcagggccgggggctggaggccacttagccagaggggaagggacttgagatgcccgtgggggaccctggtggtgaaagctcccagtctgatggtggaggtgaagtgaaagcgaagtcatagaacaggatctgagccaggtcattaagccttgaagtcttcccagggaagttgcattgcagagagacttgaagagacatgacttgggacaaaatagcaccaaagtggtcgggtacagtagctcatgcctgtaatctcagcactttgggaggctgaggtgggaggatcacttgaggccaggagttcaagaccagcctgggcaacataccaagaccctgtctctgccaaaaaataaaaataaaaaaaattacccaggtgtggtggtgcacacctgtcatctcagctgttcaggaggctgaggcaggaggcttgcttgagcccaggagtttgaggatgcagtgagctgtgattgcgtcactgcactccagcatgggcaacagagcaagaccccatctcttaaaaaaaaaatatggcattttaggtgtcagaaacgggagaaccatgtcctgtgcttgctcaggttgtaaatctggggttaattagggatccaggggagattaggttgttgaggctggtctgaggcagtaccagttgtcaggagagccaagaaggcagcctgagggcttaaggttgaacccatctctgctaagtgccccaggcaatgcagaggcaggaaggggaggggtgcagcaggagacaggaggcaatcaaccgcacctggcgggatctgaacagtggattggagcagaggggcagggcccaggtcctccggtggcctagctctgtggccctgggcacaccattcccacctccgagcctgcatccccacttgtgaagtggaagagcagctcctgtcctgccctcctcatggggctgttatgttctgcagagggcagggatgcggggttttcgggggaagagctgcaatgtgtgaaacagatgtacaaagctgtccatgtgtcctctcctttactcaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggtaacattgctgctgggatctccaagtctagggggtgggacagaggtcactcatgcaggggacagcctcccagggcaggtcaggatgcctgggccctcttaggttggaaggagccatgtctgggcatgggagtgggactggacagatggtgtcctggctgagacccccttggaccttgggtctctgctcagccatctgtgaatgatgtccttggccttggactaagaggacgcctgcgaggactccctgggtcccagctactcgggaggctgaggcaggaggatcacctgagcccaggagtttgaggctgcattgagctatgattgcacacctctgcactccagcctgggtgacagcacagctctgtctcaaaaaaaaaaaaaaaaaaaaaaaaaaaaaagcaccagcgatatttcaggtgtcaaaggtgggagatccacatcacgtgctataaaggaagtaagcatactagtcatcctcatgcattccatgaggacccattccaactgaatgagcacccactgcatacccagcctgattaagggcactgggggaagtaggtcctggaagtaggtcctggggtgaacaggacaaaaggaacaactgcaggtgaggagcacctggattcatatcctggctcctctacttagtggctaggcatcctggggcaaatctctactctctgagcctcagtttcttcctctataaaatggggatgctagtggtacctgcttcccagaagtgttatcatgattaaatgacagatcggtggcagtagcatctcctgagagagggttagaaatgcatattctcaggcaccactgcagtcttgctgaatctgaagctttggggatgggacccggtagtctttttggataactctgccaagtggttccaatgtgctcaagtttgagagttgctgaattaaagcgctgggtcttgccaggcatacctgtaattccagctctttgggaggctgaggtggaaggattgcttgagcccaggagttcgagaccagcctgggtaacatagcaagatcctatctctaccaaaaaaaaaaaaaaaaaaaaagcgtttgggtctaatgcttggcctgtagtaggtgcttgtaagttatatatactattattattattattattattattattattattattattattattataagggggaaaaaagcccaaatatgtgggctgaccagggcttcgaacttatacatgtaaaacaagtgttcttacctggaaaaggtaacctccgacatccctttcttgttaacctggctttcggctagcagattctggtgcagaatgtcttagacctctggtcaggggccttgccttgagtttgtgatcacaggaatcagttattggatgtccctggcagatgaggctgttaccccagagccagggcctgtgcactggggccagatctggggaaccctcttgggtcccacctggaaccttcttccttctctcccttgtccaggacagaagcccactgggcctggtgggcctctcatccagaacgtccatgcctccaagcgcattctcttctccatcgtccatgacaagtcaggtaggacagcgcccacgaagcaccccggcctgagtgggaatctgaggttggaggtggtgcttattgaaatggaagtgtatctcctgggtctttgtgaaagaaaggaggaacagctctgctcaaggggctgcaagtaaactggggtgtaatagttatctattgctgtgtgataaactaccccaaactaggcatggtgtctcatgcctgtaatcccagcactttgggaggctgaggcaggagggttgcttgaaaccaggagtttgagaccagcctgggcaatgtagcgaaatgctgtctctacaaaaaataagaaaaattagtggatgtggtggtgcctacccgtagtcccagctacttgggagactgtggtgggaggatcacttgagcccaggagttggaggctgcagtgagctgtgatcgcaccactgcactccagcccgggcaacagttagaccctatctctaaaaaaagttgtaacaaaaaataaaataaataaccccaaaatggagcttaaaacatcaagtgtttattacctcacagtttctgggggttgggaattcgggactggccgagttgggcagtgctcggtcagggtctttcatgaggatgcagtcaaaatgttggctggggctgctgtcatccaagagctcaactggggcgggaggagacgcttctgagctcattcacacggctgttcgtaggaggcctcagtcccccaccatgtgggctagccttgacggggctgcttgagcatcctcacaacatggccactggtttcctccagagttattgatccaaaagagaggaacgaggaagccacgtggcttttatgacccatccttagaaattgctgtcatattctatctgttagaagccagaaacatgatccagccttccctctgtgggagaggaattaaactccaccttttaaaggcagtgatatatttaaaaaaaaaaaaaagtggacagatttttaaagtatcacacagaaggcctgagtgtaggaaagtttgggattcagttataccaagaaggaatgcagtaggacttgccagcagttttgctttgagggcctcagcctcacctccaggaaaaggttctgtaagaaaacccagtcctaggccaggtgcggtgactcacacctgtaatcccagtgctttgggaggctaaggtgggaggatggcttgaggccagaagttctagaccagcctgggcaacttagtgagaccccatctctacaaaattttaagaaagaaagaaaacccagtcccctgggatcagaatggaggaccctcccccccaacaacaacccaacctgtcactgccccaaacaaggtccagccctggcagggaggagatgtgaatgtccagatggaacagtatcatgacaggcccatgggccagggacacaagctgggatagaatctcactgggttatcacaagcaagatactcagtttctttgagcctcagttttcctatctgcaaaatgggactaatatctctgtttaaaacttgtcataaggaattaaataggatattattatatatataaagtacttagcacagataagcacttaacaagttaaagttgttacttttactgattataaatgaaccaatgatcacttgttattattcaatcaagacagaggttttgagagagagaccagcagagctgagagtttgggggaagccaacaaggccagtgctgagtgagacctcagatgtaggaggtacaagggttagattctcaagatcaagactcagcccttagccagacatggtggtaggcacctgtagtcgcagccactcaggaggctgaaatgggaggatcgtttgagtccaagagttggaggctgctgtgagctatgatcacaccacagcactccagcctgggcaacagagtgagaccctgtctgtaaaaaagaaaaaaggaaaaaacacagccaggagtgttggctcatacctgtcatcccagctgcctggggggccgaggcagagggatcacgtgagcccaggagttcaaggctacagtgagctatgattgcaccactgcagtccagcctgggcaacagagtgagaccctgtctctatttttttaaaaaaatttaaattaaaaaataaaatactcgacctcaggccggacttggtggctcacacctgtaatcccagcactttgggaggccaaggcgggtggatcacctgaggtcaggagttcgacaccagcctggccaacatggtgaaaccccatctctactaaaaatacaaaaataagccaggtgtggtggcaggtgccctgtaatcccagctacttgggaggctgaggcaggagaatcgcttgaacctgggaggcagaggttgcagtgagctgagaccacgccactgcactccagcctgggtgacagagtgagtcaccatctaaaggaaaaaaaaaaacataagactcgacctctttttctgctgaagggactgctcttccagcctcctgtatgtctggggcaggatgggctcgggatggacaggctgagcctgttctgacaccacacccgtgggagaggccagagacaaatgttagggcaggaacgggcagacgggggaccatcagagcaccctgaattcgtgtatggtccgaggtgggagagggtggaaggactgggggctggggccggcctcgggggctctgggggtgaaagcccggtggtcatggccggtggagggcgtgtgaccgtcccgtggggccctgctcacttgtgcctcctgtgttttgatagagaagtgggacgccttcataaaggaaaccgaggacatcaacacgctccgggagtgtgtgcagatcctgtttaacagcagatatggtgagtgggcggcgcggcccgccgtgtggccccagcagccgtgttgagcatctcattacgtggcaatcactcgtgttccccaacacggcagcgggagccatatgctggctcccgcgcgccggcaccgctaatgtcatccgtcgcgggctcctcctgtctgggtagggggtggttgtgtcaatatttcccttccagattcttcagggggcggaactgatggcaaagccccagacctgggctcagtggcggggagcgggacaggttgggggcagagattacccatctgggggccgggcgcagtggctcatgcctgtcatcccagcactttgggaggccacggtgggaggatcacctgaggccgggagttcaagaccagcctgaccaacacagtgagacctcccatctctacaaaaacaaattttttaactaggctgggtgcagtggctcatgcctgtaatcccagcactttgggaggcagaggcaggcggatcacctgaggtcaggagttcaaggccagcctggccaacatgccagaaccctgtctctactaaaaatacaaaaattaactgggtgtggtaatacacgcctgtaatcccagttactcagatcctgaggcaccagaatcactggaacctaggaggtgcaggttgcagtgagtcgagatcgtggcattgcacttcagcctggtgacacagtgagactctgtctcaaaaaatataaataaatacaaattaaaaattaaaaaattaaccacacacctgtggtcttagctacttgcaggctgaggtgggaggattgcttgagtccagaaggttgaggctacagtgagctacgattgtacccctgcactccagcctgggtgacagagcgagaccctatctctacaaaaaaacaaacaaaacagattgcccatcaggggaactatccataaggcccagaaaaatctctgttggcctcatgtgcaagtcccccacagtaacacaccatttcccacctcccagctttacctgtgctgtgccctctgtctggcacagtcttttcacattttagggacaaattcctaattgttctttgagactcgtcttgggagtcacctcctctaggaagcctttgggtccccagcctgggccaggtaggcctgggtaccctgatggttccctctctgtgacacattgggaacttgacgccccctgcctgccgctgtctccctgagggccaggactgcacccaacccctctctttgtccctagcacccaggacagagtcaggctcatagcagatgtcagcccaccgcactctggaaagaaaacacaagtggtaggcgctgtggctcatgcctgtcatcccagcactttgggaggccgaggcaggtgaatcacttgagctcgagagttcgagaccagcctggccaacatggtgaaaccccgtctctacaaaaatacaaaaattaactgggcgtggcatggtggcatgcacctgtaatcttagctactttgggaggctgaggcagaagaatcacttgaacccgggaggcagaggttgcagtgggccgagatcacgccactgcactccagcctgggtgacagagtgagactttctctcaaaaaaagaaaagaaaatcattaaggaaagaatttaaaaagaaaaaaaaaagaagggaggataattccaaggaagaaacagtctcaataggctgggaagtcaggggtggcttcatggacgaggtgtcttgtgaccacgtctggggcagcctctgcgtgtgggctggaccttccacattgacatggggctgaacaagactctggaggccttagtgaggagcctgggatagccagctacctttgatgtggccaccctggcccagccacgcctcctcactcctcagagctgcaaagggctgtctgcacctgcccctgagtctctccccgccccaggcaggtgtgagccaggcggaggttgggggaggggaaccagggaggagccggctctgcctgccttgggagggttctgcccaggccagtgttctggcctgtcccacgctctggactttccaaaatgccaagccttttccaaatgtcagttcctgagtcacatccaaagagtgttgggtgtggagtggtcaagatcttgttccccataaagccggagctccctctggggagctgcgtgggggagaaggcagctgcccagtactggggaccccacgggtggtggggacggggtctggcagcccaaggcattccactggtcgtgggtgagcaaaccctgctcccagctctaccagccaccaaatctgggtgaattgggccagtgacagtgtgggtggtacaaaggaggaagaaacagaaaaattagaattgggggaaacattaggcttcaggaagtctcgaggacatgtcctctgggatgatgctgggaccaggtgaggggccgaggagggtgcatggtggcactgcatgaaggcagccccttcccaaggggcaacagcagggttcgggggttggccctctgtccactgaatctccccagtgctgaaaagacaagccccaataaaccagatgaaccagacggagacaaattcacaggcactcaaaggaccaattgctcaagggctggggctgggggtggctgctgatgtgggaggtgggggggaagtggggagagatgctttgccagctgttgagatttcgaaggtttcatttgacaacgagctaagtgtgacatctcagtgggatctggatgccaaagccgccaacgcagacctgggccgctgcatcaacaggaaaacagtgtcagaggcacccaagggagggcccaagcagggctggagggaggtccagctctgggctggcacttacaggaacacagacaaagcatagtgtggccagagaagcagggctaggacagggaggggcctgaggaacagccaggagatatgggagcctggagggaggacagtgtatcgaggccccgtccatggtcatacggggaggcaagagtgaagtggatactcaggtcaggggaagggtgacccatgaaagtacttgcttaaggccaggagcggtggctcatgcctgtaatcttagcactttgggaagctgaggcaagaggatcacttgagcccaggagttcaagatcagtctgggcaacatagcaagaccccgtctcttcaaaaaataaaaaagtaaatagctgggcatggtaacacatgcctgtagtcctagctactcaaaaggctgaggtaggaggatgactttagccagaagtcgaggctgcagtgagcaatgattatgccactgcacttcagcctgggctgttagcaagaccctgtctctgaaaaagaaagaaagaaagtaccagcttgtattaggaacatagtaggtgcttaaaaagtatttggtgtggggccggggactgtggttcactcctttaatcccagcactttgggaggccaaggcaggcggatcacctgaggtcaggagttcaaaaccagcctggccaacatggtgaaaccctgactctactaaaaatacaaaaattagctgggcgtggtggcacacgcctgtaatcccagctactcgggaggctgaggcaggagaattgcttgaacccagtcagggagtttgcagtgagccaagattgtgccgctgcactccagcctgggcaacagagcaagactccatcagggaaaaaaaaaaagtatttgatgaatgaattaatgaaaacgtgtagctggggtcgaagtgaatgactgaaatggcacaagtctgggaaaacagagcaagtagcctgggcatgagcctggattctgtctgcttggctgttggcagagccgtcagcttctggggtgtgttttgtttatggcgctggtgaatgaagggcgtgccaagctcctccctggaagaaggcacacacctgtgctcacctgtgcaactactcgcctgccaggagctaatctcaagcttgggcacttcctttagccatttgtatattcactatgcagaaagcacttagtgtgtgcccagccccattgaggtcgcagtggcaaggcagaaaacaaaacccctactctttttcagacagtctcgctctgtcacccaggctggagtgtagtggtgcaatcacagctcactgcatcttcgaactcctggactcaagcgatcctccagcatcagcctgccaagtagctgggactacaggcccaagcccggctaattttttgtatttttatagagatggcttcttactgtgttgcccaggctggtcttgaactcctgggctcaagcatttcccaacaactgtagccttccaaagtgctgggatgacaggcatgagccactgcacctggccaaaacccctgttcttatgcagcttcctttctagacagtacacatagagatgagtgtggatgtagtgtcaggtgatgaccagtggatgacagacacagcaggggagggaatgagggatggaggaggctgtgttaggctgccaaagtgctatttgagcaaacacctgaaaggagggagggagggagggagggaaggaaagatgggtggatggatggatggatggatggatggatggatggatggatggatggatgaatggatggatgggcagatggatatacagccgggtgggtgggtgggtggatggatggatggatggatggatggatggatggatggatgaaaggatggatggatgaatgggcagatggatggatggatggatggatggatggatggatggatggatggatggatggacggacaaccgggtggatgggtggatggatggatggatggatggatggatggatggatggatggatagacggatggatggatggatggatagacggactgatggatggatgtttatggatttctaggagaaagggatctgagcagacagaagagcaggtacaaaggcattgaaccgagtgtatgctcctggcctgtaggggaagcaccaagggggcggcaggggtagggggagcacacagaggcatgaagggggcagatgaggccagaggtgatgaagtcacatacgtaggactttggctgtcaccaaatgagatgggagccactggacattttttatttttattttttgagacagggtctcactctgttgcccaggctggagtgcagtggcatgatcttggctcactgcagcttcgaactcctaggctcaagtgattctcccacctcagcctcccgagtagctgggaccacaggcgtgcaccaccacacctagctttttgtattttactttctgcagagatggggtcttgctgtgttgtccaggctggtcttgaactcctgggctcaagccatctgtccacctcagcctcccggagtgctggaattacaggcatgagtcaccgcacccagcccagccaatttcctaacagaaaagtgatatgattttgacatttctgcaggatccctctggccgctacatggccagagtggagtggggacggtgggaggtgatggggaccgcagctcccgggtcctgtgtgtccagcagcctgtctaacactcagccttgctgtttggttgtctttccagcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggtgcgggtggggctgggcgcagtggctcatgcctgtaatcccagcactttgggaggccaaggcaggcagatcgcttgaggccaggagttcgagaccagcctggtcaacatggcaaaaccccgtctctattaacaatacaaaaattagccaggtgtggtggtgggtgcctgtaatcccagctacttgggacgctgaggcaggagaatctcttgaacccgggaggcagaggttgcaatgagccaagatcatgccactgcactccagcctgggtgacaaagtgagactctgtctcaaaaaagagaggtgcgggtgggcgtaggggtctggccttctgctccgggcttggcttgggctccgggttttggggcatgtgggctaagcaggggcctggggaggcaatgatggggcaggggcagaatgaatgggttctctaacttaacacagagaataagacgagtctgagagagaattctgttatagctccttgtgtagctgtgtggcctattccttctgggccttttgaggattgaatggaaaatgcaggcacggtgtctggcctaatcaggcactttgtaatttttttttttttttttttttgaatagagatgggatcttgctatattgcccaggcctgcatagcctgagtgtcagagcaaggccctgtttcttaaaaaaaaaaaaaaaaaaaaaaaggcggcaggggtggggggaagggacaatgatggcccccccgacccaagttttcctaacataaaatgaaaaagtggatgaaacacacctgacatgtagcagatgtttaataagcatgaggtgttttttcattgtccttatttcccttgtgaattaaaacatcattaagtgcatcggtgcacctgaagacatttccgacctgggcgtccttgggcaagttacttaaccactctgtgcctcatttacataaaccaggcctgataccagcccaggcaacatggcgagaccccatctctgcaaaatatttaaaaagttagccaggcatggtggcaggtacctgtagtcccagctacttggaggctgagatgggaggatcacttgaccacaggagttcgagactgcagtgagctatgatcgtgccactgcactccagcctgggtgacagagtgacaccccatctcaaaaaataaaaaataggccaggcatggtggcctggattacgcctgtaatcccagcactttgggaggccaggatgagtggatcacctgaggtcaagagtttgagaccagcccggccaacatggtgaaactccgtctctactaaacatacaaaaattagccaggtgtggtggcgcacgcctgtagtcccagctactcgggaggctgaggcatgagaatggcttgaattcgggcgacagagattgcagtgagccaagatggcacaactgcactccagcctgggtgacagcgagaatccatctctaaataaataaattaaacatagaataaccaggcctgataattgtccatgcctcatagtgttgatcggagagtaaattaccagatgtggatgaaatgcttagaacagtggctacagcttcagagcctccaagtacacttttttctattacacaccccagcctcatcatttaaccatctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaaagtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggttctagctaagccagaacttaggaggagaaagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataataaaactgcaggctgggcacagtggcttacacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggagtggggcctccagcgtgaaaacagaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcatttttttttttttttttttcagatggagtctcactctattgcccaggctggagtgcagtggtgctatgtcggctcactgaaacctccgcctctcaggttcaagcaattctcctgcctccgcctcccaagtagctgggattacaggcatgcaccaccacacctggctagtttttgtatttttagtagagacggggtttcaccatgttggccaggctggtctcaaactcctgacctcaggtgatccacctgcctgggcttcccaaagtactgggattataggcttgagccaccacgcccggctggttccatgcatcttacctggatgacttgggtccctaaatgggcccctgggtgcccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacaaggccaggcacagtggctcttgtctgtaatcccagcgctctgggaggctgaggcaggaggatcacttgaggtcaggagttcaatgtggacaacacagtaagaccctgtctctacaaaaaaatttaaaacttagctggcattggtggcgcatgcctatagtcccagctacttgggaggttgaggtaggaggatcgcttgaacccaggagttcaagtctgcagtgagctatgattgcaccactgcactccagcctgggtgatagagcaagaccccaactcaaaaaaaaaaaaaaggatcccacggttcaccttgtgctgccacgatcggttggcagctctgctctgtgccgtcctgtgcctgtcactgagtaagatgcaggagaagttgggcaaaagccctcaggataaacgaataagtcattcagagtaggtgctggtgggaaatgggcttgagtcactcacctggggccagaagaggcccccagggagttgtgagcagattagaccctccaagaccgccccaggggttggcccatgctttccctaactgtgcaaaaatggtttgggataggctgggtgccgtgggtcacgcctgtaatcccagcactttgggaggctgaggcaggtggatcacctcaagtcaggagttcgagaccagcctggccaacatggtgaaaccccatctctactaaaaatacagaaattagctgggtgtggttgcacacgcctgtaatcccagctactcaggaggctgagggaggagaatcccttgaacccgggaggcggaggttcatggggaacccagcaggaaattagaatagaaccaaaaacgccagtcatgggaggcagagctgggggagcgaggctgacaatgactcctgttttcacgctgagagaccccactcccctgctgagatcgcgccactgcactccagcctgggcgacagagcaagactccatctcaaaaaaaaagttaattaattaattagattaaagtacaacaattagcagggcatggtggtgcacgtctgtagtcccagctactcaggaggctgaggcagaagaatcgcttgaaccctggaggcggaggttgccgtgagccaagatcgcaccactgcactccagcctgggcgacaaagtgagactctgtctccaaaaataaaaataaaaataaacggtttgggatgttctgaggttccagacatgccctctcctgcctgcatgtctgccggatgcccaggtctgtagctgtgcatgtgtcactcagtgaccatcaccaaaggggactggaggcatctccccgagccctgggagagtcctccagcctgcactgttctcatgcctgtctctcttctctccccaggatgtttgatgagcgaattttcacaggtatgtggggaccatctagtccattctgaagtttccggattggttccccaacagaacccgagctgccaccaccctggacttggtcctcctgagcgcctcccctcaggcagggagggaggctgggctgtggtttctgtgtcctgggacagaaatgggtcccaggcttctaggtgctgacagactgtcaggacaacccctcccagcttcaaatgccctggacagagagtactaaagctggacgctaaccggtgccaggttggtgaacctgagcctgtgccaggctctctttgaagctgccagcatattttattttaatctgattccaacaatcctatgaaggtggctccactccactactctcacgtgcagacagaggaacggaagcccagctggtgagcacgggtccctgctgcatgcccagcagtgtgactccagagcccatgcagtggcccgtgggccagcacacctgtcccaggaggaagatgcgggctcttcccggggtagcaaaagcatcacggttcttggggtgatcctggcaccccagttccggtcccgcctcccaccagctgtgtgactttgggcaaggtcttgtgggcttcagtgtccacgtctgtgagatgaggataagggcgccttcctctgggctcctggcacgatgacatgagagcctggtcttgtgatgcagccatggggaagccccggcccttttctgagggctcagcccccatagtgtgttggagggcaggagaaccatctctggttgctgcctcccattcctcctgccccttgctctcccaaatctctggccacctctggcactagggctgctgttcctccttctggcgtcagagtctctccccaggacccgttcctggctgttggctggacgtggcgcccacaaggacaggcagaggccaggccctatccccgggattcccccagcttcacacacagacctttacccaggggctctgcagcaagaggaggccagagggccttcaccctgacctccctgactctccccacagggaacaagtttaccaaagacaccacgaagctggagccagccagcccgccagaggacacctctgcagaggtctctagggccaccgtccttgaccttgctgggaatgctcggtgaggccccgcccctggccccggaggcccgcggccagccctgctctgggctgaggcagtgttacctgcaagggggtacccagggcggctcccaccacaccaccacccctcgaaggtgcaaagggagggcaagggaaaacagactccacctacttccctctgcctagagaactctcacatagagaactctcccgcccccaacatctagccagatgtcacctctctcagaagcctctaaatgcccacactaggccaggtgcggtggctcacacctgtaatcccagcactttgggaggccgaggcgggcggatctcttgaggtcaggagttcgagaccagcctgggcaacatggtgaaactcccatctctactaaaaacaaaattagccgggtgtggtggtgcgcatgtgtaatcccagctactcgggaggctgaggcaagagaatggcttgaacctgggagggagaggttgcagtgagctgagattgcactactgtactccagtctgggtgacagagcaagactctatctcaaaataaatacatgcccacaccaggccggacttggtggctcactcctgtaatcccagcgctttgggaggctgaggtgggtggatctcttgatcccaggagtttgagaccagcttgggcaacatagtgagacccttgtctctacaaaaaataaaaagttagctgggcgtggtggctggtacctgtggtcccagctacttgggaggctgagatgggaggattgcttgagcctgggaggtaaaggctgcagtgagctatgatcgcaccactgcactccagcctgggcaacagagtaaagaccttgtttcaaaaatacaaacatgcagctgggcatgatggctcacgcctgtaatcccagcactttgcgaggctgagccaggcagatcacctgaggtcaggagttcgaaaccaacctggccaacatggcaaaaccccgtctctactaaaaatacaaaaaaaattagccaggcgcagcggcgcatgcctgtagtcccagccactcgggaggttgaggcaggagaatcgcttgaaccctggaagcggaggttgcagtgagccaagattgtgccactgcactccagcctgggcaacagaacaagactccgtctcaaaaaaaaaaaacaaaaaaaacatggatgcatgtatacatacctactacatgcatacatacctactacatgcatacacacctacctacatgcatacatacataccaacaccaggtctgatgcctgtcctgagtgcccaccagaccctgcccccagcactcagcttggctaccatccaccaacaccccccaagcacattctgacctcttaggggcaggggtgggccgtttatcccagaatccccacatcatatcaggcctctccctgcagttccctgggagggagggaattaaccaaatcatctgtcccagggttcctgccaccttcattccccagccccttccccagatttttaaccctttccaggccctgcaggtctcagtcccccacaagcagtgatcaaacccccagtgtgccaagcctaggatccccagagctcccagatggtgaagaagggggatccccagatggttcaccccaggagagtgagcaggtgcctggctcggccacccctggagattgtggtccctggagacaagacacggggaatctgtcttcctggtggaggtggggagcaccatcctggagggccaggggccgatggggacagggatgccttctgcagtggcgcccgcggtgggccctgactgcctggaggggcaaggctggggcagggtggccctggacttggctgacaggtgtcatttcctgcttcccttcacaggtcagacaagggcagcatgtctgaagactgtgggccaggtgagaaggaacagggcccgctgtgtgtgtggtgggccgggagggcaaccaccagccctacccggcagccttggggaggagctcaactcagcccatgagcctggagtgctaacgagcctcctctgcccacctgcctccactaggcctcgcagagctgaggtgcaaggcatgctgggagcttactggggtcagggacatggagagctgggtgctggcatcaccactgcctcctgtcgatgcccagacccaggctgcaggttcttggaccagcagcctcccctctggggggcctcagtcaccgggtctgtaaatcggagcccctaagcctggcctgagggctcccctgacctccaattccagtttgggcggagccagggggctgacatgacttgtcctaggtagggcctcactaacaagttacagacaccagaatgttctggaaagagtcactctgcccagtcgggatcatgccagacttgacaggattcttcctttcctccttgcaggaacctccggggagctgggcgggctgaggccgatcaaaattgagccagaggatctggacatcattcaggtcaccgtcccaggtaagggacgggcatctgaccaccccctgcagaaatcagggccggaccgttagcctcctgagggtctgccctggtgaagaagtggcctccaggccgctgtttctctctgtggattctgagagccatcggggtactgtgaatgctttttctggccacatctgtcccctgcgttgtgaatcagtgttctcagctctgaccttccagaaggtcccctcaaaacttcacctccctggcttggcttccctgggatttgtgaggctggacagaagaaaaagccatgggtgtgagaggctctgagtttgaccctaccccctgccaagcctcattttccacatcttcagaggagaggatagatttgggcgctggagcctcagtacggggtgactgttagaagccaagagggtgctgggcacagtggctcatgcttgtaatcctggcattttgggtggctgacacgggaggatggcttgaggccaggagttcaagaccagcctgggcagcatagcaacacccacatctccacaaaaaatacaaaacattagccagatgtggtggtgtgtgcctgtcggtgtagcttctcaggaggctagggcaggaggatcacttgagcccaagagttggaggctgcagtgagcagtcatcccaccactgcactccagcctgggcaacagagcgagaccctatctcaaaaaaaaagaaatgactgggcgcagtggctcacgcctataatcccagcactttgggaggccgaggcgggcacatcacctgaggtcaggagttagagaccagcctggccaacatagtgaaaccccatctctactaaaaatacaaaaataagccaggcatggtggctcacgcctgtagtcccagctactcaggaggctgaggcaggagaatcgcttgaacccgggaggcggaggttacagtgagccaagatggcgccactgcactcctgcctggacgacagagtgagactccatctcaaaccaaaaaaaaaaaagagacagaaagaaaaggacccttgtctgtggggagactgggctgggtgggccctgagggactgtgacaggagtatgacaggcagaagatacccgtgtcattcggagttttgtcttcagacccctcgccaacctctgaggaaatgacagactcgatgcctgggcacctgccatcggaggattctggttatgggatggagatgctgacaggtaagaaatggacctgggctggtggtgcttgggactcagctctccagggagcaaagggaaaggggtgggccaggccgtccccaggtgtttcttggtgtcagccgtctgtagtagaggaaacccaatatatgcctgaccctaatccaaggctgggttccttttggaaacctcaagtaggctctatttatttatttagagacggagtttcactcttgttgcccaggctggagtgcagtggcacgatctcggctcaccgcaacctctgcctcccaggttcaagtgattctcctgcctcagcctcctgagtagctggaattacaggcatgtgccaccatgcctagctaattttgtatttttagtagaggcgggctttcgctatgttggtcaggctggtcttgaactcccgacctcaggtgatccacctgcctcagcctcccaaagtgctgggattacaggcgtgagccaccgtgcctggccataggctccatttataacaaggcccagcgtccttcccaggagccacctgttggaattaatttgtccatttatccaacaactatttattgagcatctgttgtgtaccaggtcctgtgtaaggggctggagacaaagcagtgaaccaagcagaagtccccacctcctggggtgcacatcctcatgtgaagagatagatggatagtacgcaaataagtaaaataggcagggtaaggtggctcgtgcctgtaatcccagcactttgggaacccaaggtgaggggattacttgaggctgggagttcaagatcagcctgggcaacatagagagacccatctcttaaattttttgagatggagcctcactctgtcacccagactggagtgcagtggcgcgatctcagctcactgcaacctccacctcccggcttcaagcagttctcctgagtagctgggattacaggcgcccgccaccacgcctggttaatttttttgtatttttagtagagacggggtttcaccatgatggtcaggcaggtctcgaactcctgacctcaaatgatcctcctgcctcagcctcccaaagtgctgggattacaggcgtgagccaccacaccttgcctcaacaaatatttattgagcacctgctatgtactaggtcctgcgtaaggggctggggaaaaagcagtggaccaaacaggtgtccccacctgctggggtacacatcctcgtgcggagagataaacagtaagcaaataagtaaaataggcagggtgaggtggctcacgcctgtaattccagcactttgggaggccaaggcgagggtactgcttgaggccaggagttcgagaccagcctgggcaacatagcaagactccatctctaaaagatttttttttaattgactgacacagtgtctcacagctataatctcaacactttgggaggccaaggcaggaggattgcctcagcccaggagcttgagaccagcctgggcaacatggtgaaaccctatctctacaaaaaatacagaaattagttgggtgtggtggtgcgtgcctgtagttccagctacttgggaggctgaggtaggaggattgattgagcccaggaggttgaggctgtggtgagccgtgatggtgccactgagtaagaccctatcttaaaataaataaataggtcaggtgcattggcttacaactgtaattcaccattttgggaggctgaggcgggcagatcacttgaggtcagagttcaaaaccagcctggccagcatgatgaaacccccttctctactaaaaatacaaaaattagctgggcatggtggcgcatgcctgtagtcccagctactcaggaggctgaagcaggagaatcacttgaacccaggaggcagaggttgcagtgagccaagattttgccattgcactccagcctggacaacagagcgaagctctgcctcaaaataactaaatagatagatagatagatagatagatagataaaaattagacaggaacggtaggacctatgtgtagtcccatctactcaggaggctgaggcaggaggatcctttgagcccaggagttggagcctgcagtgggctatgatggtgccactgcactccagtctgggtgccacagcaagacaccatctcaaaaaaaaaaaacaaaaataggctgggcatgaagaattgcgtaatcctagcactttgggaggccgaggcaggcagatcacctgaggccaggagttcaagatcagcctggccaacctagtgaaaccccatctctgctaaaaagaccaaaaaaaaattagctgggcatggtggcaggcacctgcagtcccagctacttgggacactgaggcaggaaaaccgcttgaaccttgggaggcggagtttgcagccgagatcacgccactgcactccagcctgggcaacagagtgaaattctatctcaaaaacaagcaaacaaaaataggcaacaaggcaggatgcttaggatgtaacactaagcaaaagaggaaaaattgattgtgctttgcttacaactgtgttgcaaacgtaatcactggggacaaacaagggtagagcaaaacagtagcagtgttaggcaaaatgatttgcgttttttattttctaaatcagttatgatgcacttctaatactttggtaatgaagaaaaaaatatgatttgtccagcacaaactgggcatgaccagacttgacagcagtctgtggcgtagctatccagagagtttggttgacgccaagctcaggctgagatgacagcatggcgtggcgcctaaggaattggcacggtgcccagctgggtttgcagtggccttagaaaacaccatagaagcctccatgcagcactcacagccagaggctgggtggcactgcaggggttgggggccttggatgagcacagcatcattgctgtttgtttcacagagcagaacacaggctcagcaaggctcatccacctccccaaggtcacacagccttgggctggaaaacatgtttcccatgcagggttccttcccaggcaccccagtcaaacctgatgaattaagaaaattctggctgggtgtggtggctcacacttataatcccagcactttgggaggccgaggcgggatcacctgagatcaggagttcgagaccagcctgcccaacatggcgaaactccgtctccactaaaaatacaaaattagctgggcatggtggtgcgcacctgttatcccagctatttgggaggctgaagcaggagaatcacttgaacccaggaggcagaggttgcagtgagccaagatcgcaccattgcacttcagcctgggtgacaagagcgaaactctgtctagaaaaagaaaaaaaaagaaaaagaaaattctgatggtagtcacatctgtaatcccagctactcaggaggctgaggcaggagaatcgcttgaacccaggaggtggaggttgcagtgagctgagactgcaccactgcactccagcctgggtgacagagcgagactctgtctcaaaaagcacaaaacaacaacaaaaaaagaaaattctgagatgtccaggaccaccatggattagaggattttgcatttgtgtgctttttctgtttacacatatttgatatgaaacagttaaatgatacagaactgtgtaatacattgagcaggtgcagtggctcatgtctgtaatcctagcactttgggaggccaaggtgggaggatcgcttgagcccaggagttcgagaccagcttggacaacatggcgaaaccctgtctctacaaaaaattttaaaaagtagccagccgtggtggtacatgcctctagttccagctattgaggagactgaggcgggtggatcgtttgatcccaggagtttacaaccagcctggggagcatagcaagaccccatctctacaaaaaaaaaaaaaaaaaaaaaaaacaattagctggatgtggtggtacctacctgtagtcccagctattcaggtggccaaggagggaggatagcttgagcccaagaggttgaggctgtagtgagctgtgattgctccactgcactccatcctgggcaacagagcaagacccaggaaaaagctccagtcacatcctcctcaggcaaccactagtattcctagcatcttccttttgtatgtttttatctatgtgctaattcatgtgatgactattttaaacaaattgtcccttgtattctcacctggaagtttttttgtttgtttgtttgtttgtttttgagacggagtctcactctgttgcccaggctggagtgcaatagcatgacctcgctgcaacctccgcctcctaggttcaggcgattctcctgcctcagcctcccgagtagctgggattacaggcatgcgccaccatgcccagccaatttttgtatttttagtagagacagcatttccccatgttggccaagctggtctcaaactcctggcctcaagtaatccacccatctcagcctcccaaagtgctgggattacaggtgtgagccaccgtgcccagccgaggactttgtcttgttcccacgtgtcctcagtgtctagaacagactagcttgggaggtgcatgcaaaatgatctcagcctgctttcgtgtgaaggccagggtaggcacctgtatggaatcggggtccctgatcccattggagtgggtgccatgcttcagagttggggccccctggcctgccattccccagctatctggcctgacgtcggcagtgcatggcttaggagatgatgaatgtggcttcccggcatcctctgttctcttttagacaaaggtctgagtgaggacgcgcggcccgaggagaggcccgtggagggtgaggccctgtctacccctgacattttacacccacccccaccccatctctcttcccctgccgcccacctccccttggcctctgggtctcttcgttctctccacctcatctctctccagcaccctggtgtgggggtgggaatcctgtgggctgcctgatatgggaggagatttaaggatttgtcttctagaaccaggaagttcctggtcaaaggtgagagcagttcccactgctaaggaaaattgcaagcctttgtttttattacacaccctgctgctttgcgcaaaggttttaagactgggaactgagcctcctctatctgagcaagtagattagaggcctgaaagcacaaaatttgctttgtgtccagcagacacgcccattctcaggaacgtgagaattccctccctgctgagaatggaagtaggacagagagagagggaggccagggtgagggtgggtctgtttcatctctgtagtatcctggaatggaatgagtgagtgtcagaggagagaattgtcacttccccaaacccagcctggcaggaggaaccatgaagtcttaacacagttccgctgccacctggtggcagcctgctcaatttgcaggcttagtgggtacccactagttctatcacatgctacactcagtcacatacctagaaagacccatggtcactcctagtccacagaaccttccaaatcttcattcaggctggcggtgccctagatttgatttcgcaaacaagaatgtgagcccaggaattgtggacctgtctgcgtgtgccatttctgaggaaataagttacccaccgccccagccccagccttcccccattccaagatcccaccacagggccaatgttggtaccagcagagcaggaacatcagccgagaagctgccaccaaccagcctcaacagactgccttttgccttccagacagccacggtgacgtgatccggcccctgcggaagcaggtggagctgctcttcaacacacgatacggtgagcaagaagtgggacagggtctgggggcatcccggcccccctccagccgccctgtttgcagaagggctttggtcgcatccccttgcctgttcccatcccagctgttctctgggcagggacaagggagagagggaagggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctaggtgattccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgaccttaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacaggggttgaggctcctggccctgtggcaccgggtggccctacagcagccatgtctctgcagccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggtaaggcccaaccaggtccatgggagacagcaccggccctgctcagcaccaaggggcaggagcagcaccaaattgccatcaagcaattcttgtgcctcagccacctgaatagctgggaccacaggtgtgaggtgtgtgccaccatgcccagcctttttttttttttttttttttgagacagagtctcactgtctcccaggctggagtacagtgatacgaacttggctcactgcaacctccgctctggcttcaagcgagtctcctgcctcagccccttgagtagctgagactacaggtgcgcgccaccacgcccggctaatttttgtatttttagtggagacagggtttcaccatgttggccaggctggtcttgaactaccaacctcaagtgatccggccacctcagcctcccaaagtgctgggattacaggtgtgagccacggcaccaggcctttcttttctctctctcttttttttttttttttttttttgacagcaaggtgttagatggggtttggctgcagttggcagacatgaggctccccaggcctgccagacccaaagccaccgaactgacccctctcgcagtctcaggagagcagtgttcagtttccccagatgcagaatgggaacgtcccatcagctcacgggttctccaggctggcgtgttggtgtcctgggccgggggctgggagcaatgccctgtcgtcccagaatgggaaggaccagcagtggcttctacaggctgtttctgtttccttgagcgtgttgtgtttttgccaatgagggcccgggacagcacccatggacataccctgtgtgcccagctgggataaaaagtccctttgggcccgggcgcggtggctcacgcctgtaatcccagcactttgggaggctgaggcgggtggatcacgaggtcaggagatcgagaccatcctggctaacacggtgaaaccccgtctctactaaaaaaaaaatacagaaaattagtcaggcatggtggtgggtgcctgtagttccagctactcaggaggctgaggcaggagaatggcatgaacctgggaggtggagcttgcagtgagcggagattgtgccactgcactccagtctgggcaacagagcgagacttcgtctcaaaaaaaaaaaaaagtccctttggagaaggtggtggcagttattgagtaaaaatgtggttgggggatttcaggaacagtggctcatgcctataatcccagcactttgggaagctgaggtgggaggattgcttgagcccaagagttcaagaccagcctgggcaacatggcaagactgtgtcactataatttttttttttaaactctggtgtggcagcacatgcctgtagtctcagctactcaggaggctgaagcagaaggatcacttgaggccaggagttcaagactagcatgggcaacataacaagaccccatctctacaaaaaaattttaaattagctgggcatgatggtgcacacctgtaatctcagctactcaggaggctgaggtgggaggatcacttaagcccaggaggggtttggaggctccagtgagctatgattgcaccactgcactccagcctgggtaacagagcaagactcttcctcaaaaacaaaaaaaaccagggaatgggaggatcatatttccattttgtgtttgttacttctgtgttactgtaatagcacatatttaggcttggtttacagctgggcatgacggctcatgcctgtaatcccagctggcatttgggaggccaaggtaggcagatcacttgaggtcaggagttcgagaccagcctggccaacatggtgagatcccatctctactaaaaatacacagattagccaggtgtggtggctcacacctgtaatcccagctgtaatctccctgtcatcaggagactgaggcacaagaatcacttgaacccgggaggcggaggttgcactgagctgagatcgtaccacgacactccagcctgggcaacagagcaagactctgtctcaaaaaaaaaaaaaaaaataggcttggtttggttgaaagtggcaagaaagaagagactcttaagggtttgttcctccaggagaatagatagttctcaaactgggagactcacagcgtcatttttcatacagtggcgaggagatccgctgggacagggagctctactgcagggcctgctctgtgccaggagggaggctgctgctccatgacacacaaagagcagatagcaaaaagctatgcaacagggctggagagcaagagtcatgattcgtgcagtagaagcaaaggcttcagcaggccaggatgaatgcagccacatgcccggtgtgtctgggcatattaaaaggaagattgagccaggcatggtggctcatgcctgtaatcccagcactttgggaggctgaggtgggcagatcacttgagatcaggactactgaaaatacaaaaattaaggccgggtgcggtggctcacgcctgtaatcccagcactttgaaaggccgagttaggcagatcacctgaggttgggagtttgagaccagtctgaccactatggagaaaccccatctctactaaaaaatacaaaattagccgggcgtggtagcaggtgcctgtaatcccagctactctggaggctgaggcaggagaattggcttgaacccaggaggcagaagttgcagtgagccgagatcacgccgttgcactccagcctgggcaacaagagcaaaactccatctcaaaaaaaaaaattagccaggcatggtggcatgcacctgtaatcccagctactcaagaggcaaagaggagaatcacttgaacccgagaggcagaggttgcagtgagccgagatcgcactcctgcatttcagcctgggggacagtaacactcttgtctcaaaaaaataaaaagggaagatcacatttcaggtggtttaaggataaactcatgatagacatatagcccatcagatgtgtgaaaacagggaaataaagattcacaagagaatatgtgtaattatagtacagtaattggctctactatatacatgtatagtactgtactggttgaaggagggcttctttcaacaaattctcagcctgagcaatgtgtgaaaccccatctctagggaaaaaaaaaaattagccaggcttggtggtgtgcacctgtagtcccagctacttgggaggctgaggtgggaggatcgcttgagccaggaggtcgaggctgcagtgagccctgattgcaccactgcactctagcctgggtgacagagtaagaccctgtctcgaaaattttttttttttaatttttttaaaaatacattccgtccaggcgtgatggctcacgcctgtaatcccaacaccttgggaggcccagataggaggatcgcttgagcccaggaatttgagagcagcctgggcaatgtatcaagaccccatctctacaaaaaattttaaaaattctcacacctgtaatcccagcactttgagaggacaaaacaggagggtcgcttgaggccaggagttcgagaccagtctggtcaacatagcaaccccatctctattttatttttaaaattaaaaaattagccaggtgcagtggtgtgtgtctgtagtcccagatacttgggaggctgaggcggaaggcggaagaatagcttaagcacagagggtccaggctgcagtgagctatgatggcattactgcactccagtctgggtgacagagcaagacctcgtccctttaaaaatacaaagagaggccggggcatggtggctcacatctgtaatcccagcactttgagaggccaaggcagatggatcacttgagttccagagtttgaaatcagcctggccaacatggtgaaacaccatctctactaaaagtaccacaaattagctgggcgtggtggtgcacacctgtagtccgagctcctcgggtggctgaggctcaagaatcacttgaacctgggaggtggaggttgcagtgagctgagatcacatcactgcactccagcctgggcgacagagcgagactccttctcaaaataaataaatatagggtttataaataaataaaacacaaagagacaaacaaactaaaaaaccatcctggatgcctgccaggtcccgggcttgcagcccagcagtaaatgccaccaagtcctgccctggagttgccgatgtcacccagacaaaatcaaaatgtcatgtcaggtagagataactgctgtgacaggatataatgcagagtgagggggagagagggacaggaggaacctggataagaaggtgacattgaagcggtgacccaatgaagggagagggccagccaggtgcataaagagtgtgggagcaggccaggcgtggtggctcacacctgtaatcccagcactttgggaggctgaggcaggcagatcacgaggtcaagagttcgagaccagcctgaccaacatagtgaaaccccgtctctactaaaaatgcaaaaattagccgggtgtggtggcgtgtgcctgtaatcccagctactcgggaggctgaggcaggagaatcacttgaacctgggaggtggaggttgcagtgagccgagattgtgccattgcacttcagcctgggtgacagagggagactctgtctcaaaaaataaataaataaaaataaagactgttgggacagagaaaaagtcatgcaaagtccctgaggcaacaacgtgcttgggtgtttgaaagcttgcaaggtgcccttgcagctggtacagggtgagtgagggaaggatggtgaggttgaggcccaagaggtagcaggggaccaggcgtgtggcccacgcctgtaatcctagcattttgggaggctgaggcaggaggattgcttgagctcaggagtttgtgaccagcctaggcaacatggtgagaccctatctctataaaaaagaaaaataggccaggagaggtggctcacgcctgtaatcccagcactttgtgggggttgaggagggtgtatcacctgaggtcagaagttcgagaccagcctgcccaacatggtgacaccccatttctaaaaattcaaaaattagccaggcatggtgagggggtcctgtaattccagctactcaggagactgaggcaggagaattgcttaaacccaggagacagaggttgcagtgagctgagatcgcgcccctgcactccagcctgggcgacaagagcaaaactctctctcaaaataaataaataaaaaggtagcaggagccagatcacatggattttgggccagcttaaagagtttgaattttattttattttttaaaaagtcttaagagacagtgtctcattctggtttgtttttatttttgtttttgctttctatgcctattccctcaaaccataaactaggggcacccgggcagcttgaggtcaggtgccaattcaacagcaagtcctcatgaatgacattttttatggctttgtgcagagacaccttgtgctcatgagcattggttttttgttttttgtgggttggtttttttgttgttgtttgtttgttttctattttttgagacagagtctcactcactctattgcccaggctggagtgcagtggcaccatctcagcttactgcaacctccgcctcccgggttccagcgattccccggcctcagcctcctgagtagctgggataacaggcgcatgtcactacacctggctaaattttgtatttttagtagagacggtgtttcaccatgttggtcaggctggtctcgaactcctaaccttaagtgatccatccaccttgacctcccaaagtgctgggattagaggcgtgagccaccatgcctggccttttgtgggttttttttgagacagagtctcactccaggctggagtacagtggtgctgtctcggctcactgtagcctccaccttccaggtttaaacgattctcctgcctcagcctcccgagtaactgggattacaggcgtgagccaccatgcctggccatgagcatttgttttaagagacaagtctttctttagcccaggctggagtgtagtggcacaatcataactcactgcagccttaaactcctgggctcaagcaatcctgcttcagcctcctgagtagctgggactgcaggggcacgccaccacacctggctaatttttacattttttgtagagaaggggtctcgctatgttgcccaagctggtctccaactcctgggctcaaagcgatgcccctgcctcagcctcccaaagtgctgggattacaggttgagccaccatgcccagccttgagcactttttaaagtcacgatggctttctccacctgtcatttggaaagggagacaggtcagtgcagtggccgacgggagaggccgtctggtgggtttgaggccagctcctcctgttactccctgtggccttggcagccggctgtgctatttaaggggaagcactgtcgctactctggcctgggactcaggggctctgcccagcttctgcctctctaagtttactgctgggaagtcacttcccctttcagaacctgagttctcccataaagaggaggggcctaaatgcagtccgaagccttttctagctcctgagactgtggttcaaggcagggctatgcttcccctcccagccctggccccgtgaccccagctctgtgcctggcactgtacagaagcctaagagatgcccaccgccagagcgggcaccaaatcctcatctactggggaccccaggggtgccctccctgagagtttggcctttgggctcactcccaggcagagactcctcggagttgctgcttgattacccctgtgacagagagctcattacctctccaggcccattacctctccagagagctcattacctctctgctccatggcctaccctgccatcccccgacagcccccttctggccagcatgattttcccagtgtcctctacccaccacaaaccccagccccacaacaggcttgctctaacaggacaagttgtgctgaagatggggccttcagaagcagtgctgtatgacaaagaaggttgactcatgtctggacagggctttctggagtctgtggagctaaagacattagcataatacagagctgggcttggtcactggtgcttccgactgcagtaacacagcagctctcagacgtgagccgtagatctcagacctttccagaagcttggagttcttgcttcgtagtgggccccgactgtttctactcttttctttcattttgagacggagtcttactctgtcacccaggctggagtgcagtggtgctatctcagttcactgcaacctctgcctcctgggttcaagccattcccctccctcagcctcccaagtagctgggattataggcacctgccaccacacctggctaatttttgtatttttagtagagacgggtttcaccatgttggccaggctggtctcagactcctgacctcaagtgatctgccctcctcggcctcccaaaatgctgggattacaggcgtgagctactgcacctgaccttgtttctacactttaaaccagctccacgggaggccacctgaggccacctgctccaatcccaggcagtgacaatcgtgcaatgtccctggagcaggagtgagatatcagatggacctgttcaggactggggggggtctcactcccagctggatccttcaagcccagcgcagccccccagattccacatgtggggcggcagggactccaggcctgaactatgcatagccagaagggtccattgcagggctgtgtagactgaggcccagagaggagggctgagcagtcccagagatgcttggagggacctctgtgatagcctcgcttgtgttttccaggcccgagctgctcactgagggagtcaaagagcccatcatggatagtcaaggtacccagcgcggggtcgggagccatggtgtgggcgggcaagggagggccccaggcctctgccaccagcccctcctcctgctgcctctgtcctgctcccatcctggccctggcattctccccacacccccacattgggtttcccctaacgatgccatcttgggtcccaggaactgcctcctcacttggcttctctccccctgccctgcccccagagagggattccggggaccctctggtggacgagagcctgaagagacagggctttcaaggtaaggttgagctcacggggaggtctgttgtcccagcaccaggacattgacctggtttgggtttggagggccaggctggaagtggggaggagctggcccccaacttcagggcctaagggaccaggcaagccaggttggcagcccaggcccggctgtaccctgccagctctgtgttagagactccaggggagagggggtgcctacaggtggacggtcgggggagcccaggagcctgcctgccccctccctgccccaccccccagaggtagctgacacgcccactcctttttcagcaatcagctgtggtcttagtgctttgaaatcagaataggagccagacgcggcacctcacgcctgtaatctcagcacttgggaaggtcaaggtgggaggatcgcttgaggctgggagctcgagacaagcctggacaacatagaacccgtctctatgtctatttttaagaaaagaaatcagaggccgagtgcagtggctcacgcctgtaatcccagcactttgggcggccgaggcaggtggatcacttgaggccaggagttcaagaccagcctggccaacatggtgaaaccccgtgtctaccaaaaaaatacaagaattagttgggcgaggtggcgtgcacctgtgatcccagctactagggaggctaaggcgggagaatcgcttgaacctgggaggcggagattgcagtgagccgagatcatgccactgcactccagcctgggtgacagagcaagaccctgtctcaaaaaaaaaagaaagagagagagagagagagatggtggtctgggatccctccagcacatgctggcacttgtctttgtttgtttgtttggatggagttttactcttgttgcccaggctggagtgcaatggcgtgatctcagcccactgcaacctccgcttcccgggttcaagcaattctcctgcctcaggctcccaagtagctgggattataggcacgtgccaccacacccggctaatttttgtattttttagtagagacggggtttcaccatgttggacaggctggtctcgagctcctgacctcagatgatctgcccacctcagcctcccaaagtgttgggattacaggcatgaaccactgcacccagctttttttttttttttttttttgagacagagtcttgctctgtcacccaggctggagtgcagtggtgcgatcttggctcactacaacctccacctcccaggttcaaggggttctcttgcctcagcctcccaagtagctgggattacaggtacgcaccaccatgcctggctaatttttgtatttttagtagagatagggtttcaccacattggccaggctggtttccaactcctgccctcaggtgatcctcctgcctcagcttcccaaaatgctggggttacaggcatgagccgccgcgcccggtcacacttgggcgtttttaatgaacactttctgggtgagggtgtcttggtggctcatgcctgtaatcccagcacttttggaggctgaggcaggcagatcacttgagcttgggggttcgaggccagcctgggcaacatggcgaaaccccatctctaccaaaaacacaaaaaagaaattagccaggtgcggtggtgcacgcctgtggtcccagctactcagaaggctgaagcaggagaatcgcctgagcctgggaggtggaggttccattgggagccgccaggcccatcccctgtgtctgtggggactgcccatcctcctccatctgctagatcagctgggcttccattccctcgcttgtctccagccccctagtgacttcatgaagcccccgccccctgcctgccagcccagggcacaggactccgtactctatggtgtccctcccctccggggcttatttattggtttggtggttttcaaatgtcatcaattaacttaatttccaactcatcactgttgtggcaacagtgcatgtccttctgaaaaaaagacatctccatcaacatgtcggtgctgaaggacctgaggggcccactccaaagatcctttaattgccggagaaggagttccccataattagaaaatcatcttccttaaaagtcaccaagtgctttttcactcaacagcccaaacccataatcgttttgcgctttgcagaaaattatgacgcgaggctctcacggatcgacatcgccaacacactaagggagcaggtccaggaccttttcaataagaaatacggtaagcagtgcagaacccccggggagggacacgcagctgctgtgcacagagaagtgggaggcttcccagttccagccgagggcatttctggggaaacaattcacccctttacatgtatttcttgagcatatactacgtgccaggcactgtctcaggcactggggatattgctgtgaataaaacagacacagtccctgtactcatgagccttgcagaccaatgaggtgagatacactttcaagaactacacacagaatttaatagacaagggcccggcacagtggctcctgcctgtaatcccagcacttttggaggctgaggcaggtggatcacttgagctcaggagttcgaggccagcctgggcaacatggcaaaaccccatctctaccaaaaacacaaaaaagaaattagccaggtgcagtggtgcacacctgtggtcccagctactcaggaagctgaagcaggagaatcgcttgagcctgcgagggggaggttgcagtgagctgagatcgcgccattgcattccagcctaggcaacaaaagcgaaactccgtctcaaaaaaaaaaaaaaaaaaatggagcatatgacatgggagcatattggtgtggctttttctttcgtttcttttttttttttttttttttttttttttttgagacagggtctcactctgtcacccatgctggagtacagtggcgtgatcatggttcactacagcctcaaactcctgggctcaagcaatcctcctgcctcagcctcccaagtggctggaactacaccccactgggcactaccatgcccaactagtttttagaaatttttagtaaagacagggtcttgctgtgttgcccaggctgatctcgaactcttagacttaagagatcctcctgccttggttccccaaaatgctgggattacgggcataagccaccatgctggccttttttttatgttctgatcaaacagctcagattgtaatgcctatacctttccacagtgctacactacataagagctttctcgtaccattcactctcctgcacgcatgtctttccatcacatccccgcaatcccatgtacacacaccccacgctgcctctcactcctgacgggcaggaccctgcctctcgcccacaggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggtactcagtgggaagggtgagggtgaagaggcaggactagctcagatgggagcttgcacctgcgaatccttagcctttccctaggtcctgccctcccccctggacaaggtggctctcctggcaccatcctgggtcctgggggtggttggagagggactgcaggccagcccaagtgaagggagcccttcagaagtgggactggtcacccccccatggcaagggcagcctttgagggcatcttcaacctgttcagcaacacccgctcactgcacccccagcccccgggaaaggtattcagcccccatcagagggatttgcccaaggtcccggggccagccagggcaaagcctgcacaaggcccaggtctgcgtcctgcagagtgacactgccaatgccagcaccctgccacattgtctcagtgtcccgcacacacagagccccagggcagcttgttaaaatgcagattctgctgctgtaggtctggggtgctcccaggggagaccgaggccactgaatcccaggggtgtcttcctcatcccccaggccctccccatgacacccctgcctctgtttctcttctaggcctttccaaggactcatcccaaagcctggtaagaggcactggctgtggagggggcactgggaatagggcccgatcgtggtgctggggactggagctaagcctgctgtggggcacaggttctggggtctgggaacagaagccaggcccctgcctttcttttttttttttctgaggcagagtccttctctgtcacccaggctggagtgcagtggcttcatctcggttcactgcaacctccacctcctggattcaagcaattctcctgcctcagactcctgagtagctgggattacaggcaattgtcaccatacctggctattttttgtatttttggtagagacggggtttcaccatgttggccagggctggtctcaaactcctgacctcaagtgatccacccacctcggcctcccaaagcgttgggattacaggcgtgagccactgcgcccggcctaggcctctgcccttctgtttagccaccttacctgggctcctgccccaggtagatggaggaagactaagcttgaatgtggccccagatcctgggacagagaaaggggtggtggcgtcagtgacttctaagttttacccagtctgggttcaggagggaggggccaggccgagtcagtgcacctgctcctcctgataaaggggctctggttgacctcagtgaataggcgaggttggaggtgagtgggttcctaaccgcagaaggaggggtgtctgcatggggaccacaagcatgttggtaagatgtgggtggcgcctaccctgccttaaacagtgcagtgcctctcctgaccctttttaaaaaaatattttatatatataataaaatatatacataataaaaaatatatataataaaaatattatatataattaaaaatatttatataattaaaatattatatataattaaaaatattatatatataataaaaaatattatatagagagagagagagacagagacagaccaagtctcactttgttgcccaggctggaatgcaatggcactatctctgctcactgcaaactccacctcccaggttcaagctattctgcctcagcctaccaagtagctgggattataggtgggcaccaccatgcccggctaatttttgtgtttttagtagagctgggtttcaccatattggctaggctggtctcaaactcctggcctcaagtgatcctcctgcctcagcctcccaaagtgctgggattacaggcatgagccaccacacccgacctcctgaccctttttaaggcacccatccacttctgtctccaccatggactgtgtcctggcctcccaaacccagatttgcaggggctgtccctgcagggtgatcccaaacccagatttgcaggggctgtccctgcggggcgacatgccacttggcaagcactaagggctggccagagcctccagggcgggccaggcacggtggctcacacctgtaatcccagcactttgggaagccaaggcaggaggatcacttgaggtcaggagttcgagatcagcctgaccaacatggtgaaaccccatgtctatttaaaatcccaaaattagccaggtgtggtggcgcacacctgtaatcccagctacttgggaggctgaggcaggagaatcacttgaacccgggaggcagaggttgcagtgagccgagatcgcgcgactgcactccaccttgggcgacgggactagattgtctcaaaaaaaaaaaaaaaaaaagaacttagggtacagtgatgtggcggctgctgacaggccacgggaacccccagaagggggatcaggagggtgaggggtagttggagagggtttcctggagtaaggatggccctgcttgggcctcaggggaagatgggactttgagaggcagagaggagggtgggtttggcggggtgaacggcaggggttggggggtcactggatgccagaagtgtgtttccggagctctcggaggggcagagtggtcagatgatgttggaaaggtggagagagtggaagctgcagcagcacagtgcagtgagtgtggctccagtggacacccggctgagaggtcactgggtttctggccctgcactggtgctttatgcgggtgcctttcacacatattttgggaggtcctgctgggacaaggtggtattctagaggaactagggttacagcagagtgcagacagaggaggcatctcatttagtcttcatagctaggaggttgacgctagagcccaccttacagagggggagactgaggctcggtgtgagtgatgtgttaatactctgtgtcccagggctagcaggtggtcgtggcctcagccctcagggatggacctgccagcccctttccaggcgttggcacccaagccaggtatccaccaggtatccacacttactcatgccactagtcatgctgggctgggaacacgtccaggctcctgggagtctctgagggttcaccagaggtcactgagtgctacttctgcaccagaatgggcttttctcaaactctccctcacacggttcccgaagcctggcctgggccagcaccggcagttccagggtgaatcggagtggaagctggggtctgctgggggaggcaggggaaatagcagaccccttcatctggaggcaggtgtcccagggcaggtggaggggtggcagatagttgcagagaggcgggtggctggggacagtgcccaggagtcagccttcagggtcttaggcagcatgtgggccatgggaaagtgccgcctcattcaagtccctgtacccgcctgactagccatgggaatctgagccttcacttccttaccgccaagatggacaagcacacctgcctcaccatgtgatctgaatatgggaaaagatgggcagtgctaggttagctgggaggactattttccgccaattgccctcttttttttttttttttttttttttttttttgagatggaatttagctcttgttgcccaggctagagtgcaatggtgtgatcctggttcactgtaacctccgcctcccaggttcaaatgattctcctgcctcagcctcctgagtagctgagattataggcgtgtgccacagcatccagctaaatttttgtatttgtaggcaccctaacacaatgaaagtccaggctggttgaccaggctggtctcgaactcctggccagcctcaagtgatccgcccatcttgacctcccaaagtgctgggattacaggcgtgagccaccgcattcagccgcctttctttttgtcctcgtttgcaaatacagaatggaccttagtctgcaaactcagaagtgcgagacatgtatttttatttttctaaaattgaactggactcctaccaaaagcccccaatgcagagtggcagaaactttatctgagtccattttggatcatcatttcccttgagcttgcactagggcctggaaccttctgtgaggcccactcagtagacacttccacaccgcagagagactgagcatgagaaggtccgtgcttgaaaaaggcctaacggtgggatctcggtgcaaagatgggagagtggaaaccgagtggtgaagagatgactgtggcacccagcagggaattcccaggagggtgaggcttcgggaactttccagggggacaaaccctgttaagaatggctctagggcctggtgctgtggctcacgcctgtaattccagcactttgggaggccgaagtaggcagatcacgaggtcaggagttcgagaccagcctggccaacatggtgaaaccccgtctctactaaaaataaaaaattagctgggcatggtggcgggtgcctctaatcccagctactcgggaggctgaggcaggagaatcgcttgaaacttgaaggcggaggttgcagtcagccaagatcacaccattgcactccagcctgggcaacaagagtgaaactccgtctcagaaaaaaaaaaaaagaatggctctaaaccaggaacagtggttcacccctgtaatcctagcactttgggaggccaaggtaggaggatcacttgaggccaagagtttgaggccagcctgggcaacataacaagaccccgtctctacaaaaaaattaaaaattagccaggcacggtggcacgcacctgtagtctcagctactcaggaggccgaagcaggaggatggcttgagcccaggaggtggaggttgcagtgagctgagattgtgcaactgcactccagcctgggtgacagagcatgacgccatctggaaaaaataaaaataaaaagaatggctctgagatttttttaggtcacttattgaaggttcccatggaagcctttcctaacagaaccaccccgagaaggtaaaaattctgaaagagattgtgcttttttgtttttgttttgttttgtttttttgttttaagatggagtttctcttcttgttgcccaggctggagtgcaatggcacaatcttggctcactgcaacctccacctcccgagttcaagcgattcgcctgcctcagcctcctgagtagctggaattacaggtgtgcaccatgacactcggctaatttttgtattttgagtagagacggggtttcaccatgttggccaggctgatctcaaacttctgacctcaggtgatcagcccgcctcagcctcccagagtgttgggattacaggcgtgagccaccgcacctggctgagattgtgcttttttgaagatgaatcagtcattaaattgcaagagccccactgcaccctagagctgtgagcctccccagtgtagggtgagagtacagccactcctggactggttttgttctgggtcaaaagagatgactcaggccagacgtggtggcttatacctataatcccagcattttgggaggccaagatgggaaaatcacttgagcccaggagtttgagaccagcctgggtaacatagcaagatcccatcctgcaaagacatttttttaaattagccagacatggtggggacgaacgactgtattcccagctactcgggaggctgaggcgggaggatccctcgagcctaggagttggaggctgcagggagccataattccagtgtgtgtgacagagcgaggtcttgtctctaaaaaagagagagagagagagataagcccagaatgtctttaatattttcccagctgaggacatcacgtttgccttcagtgcctcagtttccccactaaaatctagaggccctgcctgctctgacatgctgagtggcgggcaggcgtctagcttgagaggaaggcatacttggacttggaccaagcctcagagggcagtgggtgaatttcaggcctcaggtcaagggagctgtgggccaggggtttctgggggccaggggtactagaaagcaccagactgaactggaggggacctggtggggggcctcgggttgcagagggatgggggggactgggtcccccaactcataccagaaggaactccagccctgcccgcaaggggctgagacaacccacgctcgaccctgggggctgaacgccattggtagctggtagctctatactgcccaaccaggccacacccacctgcctgcagcggcactgaattaaattagggagactgccaggcgcggtggctcatgcctgtaatcccagcactttgggaggccaaggtgggtggatcacgtaaagtcaggagttcgagaccagcctgggcaacatggtgaaaccccaactctactaaaaatacaaaaattagccaggcatggtggtgcactcctgtaatcccagctacttaggaggctaaggcaggagaatcacttgaacctgggaggcagaggttgcagtgagccaagatcgcgccattgcactccagcttgggcaacagagcacaacccggtcacaaaaaaagaaagaaaaaagaaaacccaggacagctaacgggggctgttcaggatatgctgggaagaagcggtggtgactaaggcgggagaaaccctctacccaggtagctgctgtaatattccatccgaagaacattctagtaggtcataaaaacctaaagggggtcgggcatggtggctcatgcctataatcccagcgctttgggaggccagtgcaggaggattgcttgaagccaggagttggagatcagcctgggcagcatagtgagaacccatctctacaaaaaaaattttttttaattagctgggcatggtggtgggtggtggcgcttgcctgtagtcctagctacccaggaggctgaggcaggagggtcacttgagcccaggagtttgaggctgcagcgagctatgatcacaaagctcacatcacctcacttcaacctgagtgacagagtaagaccctctctctaaaagacacacaaacacacacacacacacacacacacacacacaccctaaagagaaatgcaaatatatgcccatggtagaaatttggaaaatacagaaatctaacaacccagatggctgttcatttttatgatgatacatttcttccagatttccccccaagcttattaattttacatctcactgttcttctttctataaatttacacatttaaccttaaaacataaacatgttcccatgtctttaaaaagctctgttccctcttcaggctgtatcatggttatgtaactaccctgtcccccagttatggacatttgagcagcccctcacaccacagacacctaacactcacgtcacacttttttttgagacggagtctcgctctgtcccccaggctggactgcagtcgtgtgatctcaactcaccgtaacctccgcctcccgagttcaagcaattttcctgcctcagcctcccaagtagctgggattacaggtgcccgccaccatgccaggctaattttcctattttagtagagacggggttttgccatgttggccaggctggtctcgaactcctgacctcaggcgatccacccgcctcggcttcccaaactgctgggattacaggtgtgagccaccatgcctgaccacgtcatacttacgatttgccggttacaaagcccactcacgttaccacgtcatctccccaagtagctggccttattggaggggactgaggctcagagagattaagcagctttctcaaggtcacacagtagtgtggtagagatttgaacctaagtctttaccattttattatacttcggaacccagggcaggctctaccactagcctagggcttgttgtgtgtccctgaagtgggttgcagccacgccctctttcccaccacccctctggtctcatccacacagggtggctctttgctgtcccctcctggctaccagcagctattacactggtcctgcctgtgtaaacctttaggcttgtagttaatcctttgagttcatttatttgtacaacaaaaatgtatggagggccaggcgcagtggctcacgcctgtaatcctagcactttgggaggctgaggcaggcggatcacaaggtcaggagatcaagaccatcctggccagcatggtgaaaccccgtctctactaaaaatacaaaaattcgctgggcatggtggcgcatgcctgtaatcccagctacttgggagcctgaggcaggagaatcgcttgaacccgggaggcagaggttgcagtgaactgagattgcaccacagcactccaacccggcgacacagcgagaccctgtctcaaaaataaaaaagaaaaaaaaaaggagagagaggtggaaagtccgcaggtgaagcccagggagaaacttactgaagggggtgattggttgcaccagcctctgctgggaggtcagtcctaatgcctgagagtagacggaggtgctaagcaacaggttgcagtgggatggttcagagcaattttgggggaagtggtggggaccagagtggaatagtgggctcaagagacaatgagaaaggcaagtgattgaatctgccaaggaccaagcaccaaagtgccagctcactgccaccctcagtaaagactaacttgccctttcccccaactcccctcccagaagtagcttgctctcctctgcctgccacacatcgggggggtcaggtctaaaaggatcaccttttagagggcaggagagaatgaacaagagttgagagtggaatggctgcagagagggctttcttttttttggtggagggaggggacagagtctcgctctattgcccaggctggagtgcagtggcgtgatctcggctcactgcaacccccgcctcccgggttcaagtgattctcctgcctcagcctcccgagtagctgggattacaggcgcgtgctatcacgcccgactattttttgtattttttagtagagatggggtttcaccatgttggccaagccggtgtcaaactcctgacctcaaatgatccacctgcctcagcctcccaaagtgctgggattacatatatgacccaccacacccagccaagagagggttttagaggtaggaacagcagctgcatgatcttcagcagattcagtagagagggaagtgagctgtgggagaggaaggaggatggggggaatggcaagaaaaggagcaccctgcttagaaagggaacggagctgggtgtggtggctcacgcctgtaatccagcactttgggaggccgaggcagtaggatcacttgagcccaggagtttgagaccagccacataacaagactgcatctctatttaaaaaaaaaaaaaaaaaagaaggagaaagggccgggcgtggtggctcacgcctataatcccagcactttgggaggcccaggcgggcagatcacaaggtcaggagatcaagaccatcctggctaacacagtgaaaccccgtctctactaaaaatacaaaaaattagctgggcgtgatggcgggcacctgtagtcccagctacttgggaggctgagtcaggagaatggcgtgaacccgggaggcggaacttgcagtgagccgagattgtgccactgcactccagcctgtgcgacagagcgagactctgtctcaaaaaaaaagaagaagaagaagaaagagaaagaaacaggatgggtggaagagggttgctgaatgctcatgcaagctcctgtctgcctgctccttctctcagggagggacaggggagggtgatgagtcagtggactaaatgtccccatggggatgaaggacagttggggtcaggtttctagagggagggctggaaggagggaaggagatggccagagaaggatgtgggacacagaggtgccgccatggatcaccaagaggttcaggactggccagagggaggagaagaggtcaaggtacgtgtggggcacttggatgacgcatctgtgcctgcacacagctgaaatccccaggaaataagacgggagcagggtgggtttctgcagccaaggtgagaccaaaatgccagctcactgccaccctcagtaaagactaacttgccctttcccccaactcccctcccagaagtagctcactctcctctgcctgccacacatcggggggtcagggaaagctccccctccctgaggagctggtgttccctaggccaggggccagtccctgcagagattaggagctgggaaatcccctcctcccatcccgcacgtccacgcgtgccagaccctgtgctgtgggcttttcacacacagcctcttagacgcttagcctgtgaggtgggtgctgttgtccttccttcccattttgtaactgagcaaacagcctgaaacagacaaaaatcaggtagttagcatgaggccaaagccactccctggtctatgctgttctgcggcctgagcctggggtggccaggtggggttgtgcagtgagggggggatggagaatagcccccaaaaatgctgccggaatggtaaagggcctagcctgcaaagctagtaacttgagctttattttgtggcactggcggtttttccagtcattgtaatgatacgatcagatttgcgctgtcttcaggttaccatggtaaccatatttccacccaccaagggtggattagagaaggcaaaactagggcagagaagccagggagtgttgagaaggtctgaacccaggcagtgggcagctgggccccacgatggatggggttaggatctagaggcagcagcagggtgtgaagagggcggaaggttccggaagggtgatggtggtgctcgtctctaaggctgggtctgtgggcttgtgagacacatccaggggcccatagtgaaacctgagtggtatttagtgcaggcagggtggcaggcaggctgggggcctctcagaagcgtggagctggcagagagagacctgcccggggcatcggaggaaagggcgactgtgcaggaacagagtagacgaggtgggggaacctttgggtaagaagagctgagtcaggagcattgaggcagcggttttcaaacctcagaagcaacagcagggccgggcgcggtggctcagcctgtaatcccaggactttgggaggctgaggcgggtagatcacctgaggtcgggagttcgaaaccagcctggccaacatggtgagaccctgtctccaccaaaaaatacaaaaattagccaggcatggtggcggacgcctgtaatcccagctactcgggagcttgaggcaggagaatcgcttgaacctgagacgcagaggttgcaatgagctgagatcacaccactgcactccagcctgggtgacagagcaagactctgtctcaaaaaaaaaaaaaaagccagacacagtggctcattgcctgtaatcccagcacttcgggaggccaaggcaggaggattgcttgaagccaggagaccagcctgggcaacatagtgagaccctgtctctacaaaaaatgaaaacattgagccagtgttgtggcacacatctgtagtctcaggtactcgggaggctgaggagggaggatcgcttgagcccaggaagtcaaagctgcagtaagctgtgatcacaccactgcactctagcctgcgagacagaatgagaccttgtctttcaaaaaaaaattctagaattgttcttgaatagcagtggttaacgttttttaaaagctttggaaggtagtgaactccccgtcactggaggcatttaagcagaggttgagctgccactcactagagaggccgcttcctatagggcttgctgcaggagaggagaaagggacaagagagccctgccggttttggaggggctgtggggaggactaaaaccaaggaggggcccctctacccaccaaatccacttctctttgctgccccgccaccagctccccacagctcctccctgcgtatgggcccagccacccttctccagttcccttttgggcaaacacgagggctctccccggacccaggccagcttccgctccttttagttctcctctcaccctgggggtacagcagtccctgccagcttgaggggactgtgggaaggcagcgccccacctctccttccccagagcaggggctccagaccccagggatgtggcagagctgccaacttcctgtgtgactccagcaagtcaggcttgcctacctgggcctcagtttccctacttgtaaaatgagaagaattgcccacgccacgtctgcctcccctggggccaccctggagtgcatgaccaggtgagaaggagggatgggctgtcatgagtgggaggtggtgaggcagagagactggccaggatggagcggggacagcctgggaggcctggctttgcagcatggacagggcccttcaggcctggccctggtaagctcttctgctgacgtccccatagcggaggaacccgtacagccccactggtcggggccaagctcttggcgggctccagttttatctaggacatccccacatcgtctcctctgtaaacgttccactttcatctcagtttaaggaactatgtcaaattacatgctgctagctgggcacagtggctcacgcctgtaatcccagcactttgggaggccaaggcaggagggtcacttgcatccaggagttcgaaaccagcctgggaaacataaagagatcctgtctcgacaaaaaataaaaaattagccaggcatggtggcgtgtgcctatagtcccagctactcaggaggctgaggtgggaggatcccttgaccctgggagttggaggctgtagtgggctatgattttgtcattgtactccagcctgggcaacagagtgagaccttgtctcaaaaaaaaaaaattacatgccaccgaggaagatcattccacttacactcacctctcacccccaccagaattgtttgaggcccattttgagaagctcagctgtgggtgaaatgcctgccaggcacagggctgtgatcccttttcagggggtacaagtggagaaaagccagaagcctcaaatacagtagcaccacttgtcattgtcctctttgatctcctgctaagcctctctcttctgtggggtctcctgtcacccagtgggtgctatggtgggatgggcttcctggagaggatgacctgagccaggcctggatgctagtgtaggactgacctctgcagagggtactggggtggacatggggagggactgaagagcggcaggcacaggaacaggtccctttttgccttctcaggaagaagtaccatcacttctgagctgtgtgatcttggataagttaacctactatctctgatcttggataagttaacttgctatctctgatcttggataagttaacttgctacctgtgatcttggataagttaacttaccatctctgatctagataagtcaacttactatctctgatcttggataagttaacttgcttgtctctgattttagataagttaacttactgtctttgatcttggatgagttaactgtctttgggtctccatttctttgacgtgatacagaacaaggacatcctccatgatcctcccttctgctgcccaagacttgagagtcatttccttgtcgccaatcacacacaggcacacaccctctggcccctgcctccctctctcagccttccccaccccctctctacccttccaactctgtcttgagctcttgaaagctcaaaataaagccaccctttctcaagtttctaaagatatcacaattccagcgccagccacatgtttctccactgaattatctctgcttgtctttgttaattagggttcagtaatgatctcccttctgccttcccagggagagctggcatctgcggggcggggcttggaggcctttgtgggcagacgagacgccctactgccgggcccagagttggcccgacgcctcctttcttctgaagtggcagagtgggccatgaaatgatggcatgttggggagaccctgcccttttctggctggtggggacttagctggggtcattgcaacaccattctgccccccaaccttccacacgtcggggaagggaactccaaggtttttagcctttattagatgggcttccaggctgggtgcggttgcttacacttgtcatcccagcactgtgggaagttgaggcaggcggattgcttgagcaatcctggagttcgagaccagcctgggcaacatggcaaaatcccatcttgacaaaaaatgagccaggcatgagggcacatgcctgtagtcccagctactcaggaggttaaggcaagaggctcacttgagcccaggaggttgaggctgtggtgagccgtgatcgtgccactgcccaccagcctgggcaacagagcaagaccttctctcaaaaaaaaaaaaaacgattaaaatttaaaatagacaggggctttccggacccgaaagggagcagggttgggggcgcctttagagtcttttgcaacatcccagaaagcctcccagaaaccctttccccagcgaagaccacccaagctgacaagagcaaccagcacctttatttgggctggaatgagatcagcaccgaggggtcgccaggcaccttgtgcagaacagaagctgatgcgtgtgtctgagccatagaagtagagcaggggcagggtggtaaccatggctcagcacatgtggtttactgggtgtacccgatccttccagccttgtggggaggggtgtggggacaaaagaggagggaggtggaggttgggggccatgcaggcctagccctctaagaaccttcgtgtcatggagagggctcagcaccacccacagcagacttcgtgtggccccaacagaggccttgggggcgcaggtgcagtcactcatttgtgcacaggcccaggtgtctcactggggccagcactgtgccagatactggtcttttattattatttcattattctttttgtttgtttctgttttgttttgtctttgagacagagttgcgctcttattgcccaggctggagtgcagcagtgcaatctcagctcactgcaacctccgcctcccgggttcaagcaattctcctgccttagcctcctgagcatctgggattacaggcatgcaccaccacaccaagctaatttttttttttttttttttttttgtatttttagtagagactggatttcaccatgttggccaggctggtctcgaactcctgacctcaggtgatccacctgcctcgacctcccaaagtgccgggattactggtgtgagccactgagcccggcctcattattcttatttaatatttttgtaggacagcatcttgcttcattgcccaggctggtctagaactcctggcttcaagggatctcaccgccttggtttcccaaagtgctgggattacaggcgtgagccactacaccgggcctagatactggaatttttttttttttttttttttaaggcagggtctctctctgtcactcaggctggagtgcagtagcacgatcacggctcactgcatcctcgacctccctaagctcaagtgatcctcctgcctcagcctcccaagtagctgggactggaggcgtgcaccaccgtgccaggctaatttttgtatttttttgtagagacggggttttgccatgtttcccaggctggtctggaactcctgggctcaagtaatccacacacctctaacttccaaagtactgggattacagatgtgagccaccgtgcccggcctatgctggacttttaatcaacactgattaaaaaaaaaaaaaaacccggctgagtgcagtggttcacgtctgtaatcccagcacttcgggaggctgaggtgggcggatcacctaaggtcaggagtttgagaccagcctggctaacatggtgaaactccgtttctactaaaaatacaaaaaattagcccagcatcatgacacacacctataatcccagctacttgggaggctgaggcaggagaatcgcttgaacccgggaggtggaagttgcagtgagccgagattgcgccattgcgctccagcttgggcaacaagagcgaaactccgtctcaaaatacaaaaaaacaaaaaaacccagcctcacggagcctacatggtggggcggggggataaacagaaaatctgcaaagcgtaaaccatgggagcaattgtatttatttttaggagattgcaacattatttaggtgatgaccagaaggaggccttagttttaaaggcctgaaggggcagcagggaacagcattgcaggcagagagaacagcagctgcaaagcccctgaggtcacctgccaaggtatcagaggaaggtcaggggaagtgagagatgagatggagatggacagggaagatggtacatggccagataaggattttgacttttgctcagagtgagcttagagtcggtgcagttctgagcagagggtaacaggatccagcttgttttaacagaatccctctggttgctggcttgaggacagacaagggtggagagacataaggaggttgtaataatccaggcgacgcctgtggcggcagtggggtggtgagtcacccactcttaggtgagttggctgaagccaacagaatgtgctgatataagctgtgagaaaatgaggagctgactttgacttcagaggttcaggctgaacttggggaaggacggaggtgctgtgggtggagacagggaagatgcaggagaagctggtggggcaggaggtggcggatcaggcgtgttcaatctggggtctcatccagtcgaagttggaagcaagttggggctcaggggagcagtccaggcttgagatatgatttggggaatcatgaatttataactggtatttcaagccttaaaacaggccgggtccagtggctcacgccagcactctggaaggctgagacagaagggtcacttgagcccaggagttcgagacaagcctgggcaacatagcaagaccccatctctaaaaaaaaaaaaatagctgcacgtagtgcacacctgtggtcccagctactagggaggctgaggtgggaggatgacttgagctcaggaggtcaggctgcagtgagccacgattgtgccactgaactccagcgtgggaaacagagtgagaccctgtctcaaaaaaataaataaattacctaaacgtagtggcttcaaacaacacaaatttattgccttacagttttggagatcagaagtctgaaatgagtcttccaaggctaatgtcaaggtgtcaggggccaggtgcagtggctcacgactgtaatcctagcacttcgggaggctgaggcgggcgaatcacttgagatcaggagttcgagaccagcctggccaacgtggtaaaaccccatctctactaaaaatacaaaaattagccaggtgtggtggtgcgcacttgtaatcccagctactcgggaggctgaggcaagagaatcccttgaacccaggaggcggagtttgcagtgagctgagatcgtgccattgcactccagcctgggctacaagaaaaaaaaaaaaaaaagatgtcagcagggctgatccttctggaggctctaggggaaaatctatttccttgtcttttttttttttttttttttttttttttttttgagacagagtcttcaggctggagtgcagtggcgcgatctcagctcactgcaacctccgccttccaggttcaagcaattctcctgcctcagcttcctgagtagctgggattacaggcatatgccaacatgcccggctaatttttgtatttgtagtagagacagggtttcaccatgttgcccaggctggtctcaaactcctgacctcaagtgatctgcccactttggccttccaaagtgctgggattacaggtgtgagccactgagcacggccccctgttttaaggattaaatgaatgaatccatgcaaagatcaaagagcagtgcctggcacagaagagctcagattctctgagttaccaagtgcccgtgatgggttgggcattttttttatttgtttgtttgttttgagatggagtcttgctctgtcgcccaggctggagtgcagtggcgcaatctcggctcactgcaagctctgcctcctgagttcaagcaattctcctgcctcagcctcctgagtagctgtgactacaagcgtgcaccacctatcccagctaattttttgtatttttagtagagacgggatttcgccatgttggccagactagtcttgaactcctggcctcaagcgatccacccgcctcagcctcccaaagtggtgggattacaggcgtgagccaccgcgcccagctgggttcagtaattcttagcatattgccaattttccctgctttctctctcacacacacgcgcacacacataatttctctttctttttctctatttgaagtaaggtgcaaacatcttgactcttcgtgcctaaatgtttcaatgcacatctcctaagaaaacactgttatcttacatactcacaatagcatcatcgtacttatacaacttaataattccctgtcatctaatacatggtctttattcaaatttccaaaactgtcttctatgcctgttctcctccatgatataatcatttttcactggttgatttcttttttaattttttttttttttaaagacagtctccctcttgcccaggcaggagtgcagtggcacagtcatagcttactgcagcctggaccttctaggctcaaaccatccttaccacctcagcccctcgagtggctaggactacaagcacacgtgctaccatgcccagctcatattttattttttacttttgtagagataggctggagtgcagtgacactatcacatagctcactgtaacctccaactcctgggctcaaacaatcctcccgcatcagcctcccaagtagctgggactatagctgggtgccactgtaccagctacttttaaattttttgtagacagagtctctctatgttacccaaggctggtctccaactcctgccctcaagtgatcctcctgtctcggcctcccaaagtgctgagattataggtgtgagccaccacgccaggctcacgggttaattttttaaaaattattttattgcatgtaatgtttgcctaaacaaaaattatttcattttgcttataattttactttcttttttttgagacggagtctcgcactgtcgcccaggctggagtgaagtagtgtgatcttggctcactgcaacctccacctcccaggttcaagtgattctcctgcctcactcagccttccgagtagctgggactataggtgcccgccaccacgcccagctaattttttgtagagacggggtttcactgtgttagccaggatggtctccatctcctgacctcacgatccacccgcctcagcctcccaaaatgctgggattacaggcatgagccaccgcgcccagcctataattttacttttatgacaaaggcgtgttattgaatagagtctgggacttgctgttttccacttagctttggttgacataatgctgaagtgtgtagctgtagcttcttagttctcatggctctataatcttccattgagtggaattttaccatgatgcaattcctctctctcccctccttggggattgggctgcttccattgttttgctgttactaagaatgcaattaacacttatagccgggcacgatggctcatgcctgtaaacccagcactgtggcaggccacgacgggaggatcccttgagctcaggagtttgagaccagcctgggcaacatggcaagaccccatctctactaaaaatacaaaaaaattagccaggcatggtggcatgcttgctattcaagaggctgaggcgggaggatcgcttcagcccaggaggcagaggttgcagtgagctgagatcatgccactgcactccagcctgggcaacagagcgagatcctgtctcaaaaaaaaaaaaaaagcagaggaggagaagcatagatccgttaaaaagtttaaggcccagcctggtgactcgcccctgtaatcccaacactttgggaggctgaggcggaagaattgcttgaagccaggagtttgagatcaacctgggcaacatagcaagatcctgtctctacaaaaatgttaaaattagccagacgtggtggtatgcacctgtaggcccatgtactcaggagactgcggcaggaggatgaggtcaaggctgcagtgagctaggatcgcactactgcatgggtgacaaaatgagactacatctctaaaaaaaaattttttttgaaaaggaagaggaagaaggccaggcgcagtggctcatgcctgtaatcccagcactttgggagaccgaggcaggcggatcacctgaggtcaggagttcaagaccagcctgaccaacatgatgaaaccccgtctctactaaaaatacaaaaattagccaagcgtggtggctcgtgccggtagtctcagctacttaggaggctaaggcaggagaattgctggaacctgggaggcggaggttgcagtgagcccagatcacgccaccgcactccaccctgagcgacagagcaagactccatcttaagaaaaaaaaaaaaaaactacagttccctttgtaaaatgggtttttggtagagacagtgtcttgctgtcattccggctagagtccagtagctgggactacaggtgtgggccaccatgcccagctaatttttccatttttatagagatgggatcttgctatgttgcccaggctacatttttttttaaatcatgagtttttgaaggaaattggatagggcaggctgtggtaggggatggattggacaagcccctgcttgaatgcctgcatacagtggggaaaagggggatcaaaatgggtcaagccttaagggtccctcctgcacgcagtgtccaggtgcaggtctgggatggcagaagaaccacaggctcatgagcactggcctgggcacaggtccacaggtctctgccccgctgcagcttggccctcctctctccaggcctcagttatctcatccatgaaatggagctgatggaattcctgctaaacctgtgcacaggccctacaaggggttaaaagctgaacctgaatgtagcttttttattttttcgagaccgggtctcactctgtcacccaggctggaatgcagtggtgcaatcgctgcagccgtgaactctgcccgggcctggcagggagttggggctctgtgaagtggttcaggaggggagagaaggaccattatcccacgcttctgctacagatcgcagtctctcccctctaaaccgcccttgcccttcgctggctgcgtctccctgctgtgaatggtcgtaattaccaacgtgaggtcgtcagtctgagctgaagtcctctaactaggcggggagagtcagggctggccagggctcttgcactttgccccgagagagagccgtggagccagcccaggcaccacccgagccagttggtttaaaattgtgtacatagcatggctgtgattcagtgagcttggttgtcttttttttttcccccttggcaaatttcagttactccttgggctaacagacagcagactggtaaagataagatgagagttgcccagccagcgttaaagagagagaggagaccgaagaacagaatgagcaggaggcgggcaggaaaaatgtcaagggaaggcctgtccaccaaaggtgtcactgtccaggggcagtgggcaggaggtcgctgctgcggggatgggttctttcagcaggactttctgcacagcactgggggcagaaacatgaaggtgaaaccctacacacactgagtcctaactatgacatttccaaacagagaacactctgaaatgtttgcaactgtgggtgtctttacagccagcctgggttcaggggagctcaggcaggtcctcccgagaataggtttgctgacttggtgttccggacggtaaactaaacccccttttctggggggggttggggggagacggagttttgctcttgttgcccaggctggagtgcagtggcgccatctcggctcactgcaacctccgcctcccgggttcaagtgattctcctgcctcagcctcccaagtagctgggattacaggcacccgccactatgcccggctaatttttttttattagtagtagagatgaggtttcaccatgttggccaggctggtcttgaactcctgacctcagctgatccacccacattggcctctcaaagtgttgggatgaaaggcatgagccaccgcatgcccggcccattgctgctttacagatgaggacatcgagtggttcagggacttgcccagggtcgcgagctgattgcagagctgggatttgaacccaggcaatcagtcttgggtagaccactgggcttgtgaccctggccttgaagggcccggtattgctcctgcccctgcagtgtcctcagcagctctctgaggcgattctctgatccgtgtttttcccgtgagcagattagactcaaaggtgaccgggcatgctggagctgccctgccccacctgaggccgaggccaccactgcccacagcagtccttggggaactccctggtggcgacctggtggtggtggcaggagcctggctctgttgggaaagaggactcatgaccccacctgcagctctccgagatgctcagctggtctgggcacgatggctcacgcctgtatctcagcactttggaaggccaaggtgggtggattgcttgagcttaggagttgaagaccagcctgggcaacatagtgagaccttgtctctacaaataacacaaaaattagacagacatagtggcacacacctgtagcaccagctactcaggaggctgaggatggaggatggcttcagctcaggaggcggaggttacagtgagctgagattgctccactgcgctccagcctgggcaacagagccagaccatctcaactcaaaaaaataaataaataaataaagcttggctgggccatctgggttagcaaggatcttagcattctccctcagggctaaccagggtgcgtgggcgagctgtctcggttgcagcgggggccacgattcctgtcgggcaagactggtgccagcctgcacacctcagagcccaacaggaatatctgttcagatcgagacgttgccctttcccctgcagggcacggctagagcacagacacaaacccagtgtcaggtccccagacacggcaggggacaggggagttggtcttcacctgtggttcaggttccctcccagacagtgagtcacttatgtgcccaaggagctgcctctggtgcactcacagttcccagaagatctgggatgggactacaggtgtgcaccaccatgcccagcattttttctttttttttggtagaaacagggtttccctctgttgcccagactggtcttgaactcctggcctcaagcaatcctcccacttcagccttccaaagtgctgggatgacaggcatgagccactgtgcccagcctgtagtgctttttgatatgtgagattagatccagcaggcccagagtcccagttgaggaatgtggaaacaggctcagagaggttgagtgactttccatacaccacacagcattagggattagaatcaagattgccttccagtctgatgagccagggactttccccatacctggccctggggatcccccttttccccactgtatgcaggcattcaagcaggggcttgtccaatccagctcccaccagagcctcccctactccatttccttcaaaaactcacgatttaaaaaaatgtagcctgggcaacatagcaagatcccatctctacaaaagatggaaaaattagctgggtgtggtagcccacacctgtagtcccagctactgcactccagcctgaatgacagcaagaccctgtctctaccaaaaaaaaaaaaccacgtaattctctttactctaaattaaataaaaagaaagaggtaggaaaatgcaagaacagctacagagaaaaatcagtgttcttcctgagcttgatgttgactgagctagagaatcccacagacaaggtatattgtgggccttgcacagtgtctgcacgtagtatgtgccaagcttgttttttattttttaatttttgtttggttgtttgtttgaaacaggatctagctcagtcacccaggctggagtgcagtggggcaatcatggcttactgcaacattgaccttccaggctcaagcaatcctcccacctcagcctcccaagtatctgggattacaggcacacaccaccatgcccagctaatttttctttttttttctttttttttttttttttttgtggagacagggtcttgccatgttgcccaggctggttgcaaactcgtggcctcagtctcccaaattgctgggattacaggcgtgagccactacatccggccagttcttggtgttattgacaaaggcatttagccccactccacccctcccacactccagaggtggtcaggacgcctccccaaactgccagccccctcagccagcccggccccactttcctgacatgcacactcccaccacttctggtccaccgcctgggacctgtgccccatatagaattgccatagtatcctatcgactgccccgtagtgtcactcctggttagctgcagcctggtttagggttgcacttcttcccagaccaggcaagacttggaaggaagaggggaagtttcctgattggctaaagcatgttgagcacctgaaatcacaggatactacaagtttccttgtgtcttactcaccgctcacaactgccttggaggtccgtgtgatgagccccagcgtgcagatgagcccacatccttggagctttgggccccgtgtggtggtcacctcctctgggaagtcctccctgactcccagctgggtcaggatccctgctatagacccccgtgggccatgtaaaccaaaagtgcctgaaacaggtctcaatcaatttaaagatttattttgccatgggggaggacacagccaggaaaaagagactcaagctgcaatagggtctgtggcctgtgcttttttccagagttttgaggactttggtatttaaaggggaaagagggcctgggtacggtggctcacagcactttgggaggccaagccaggtggatcacctgaggtcaggagttcgagactggcctgggcagcataacaaaaccccatctctactaaaaatacaaaaaattagccaggtgtggtggcgggtacctgtaatcccagctactctggaggctgaggcacgagaatcactcgaacccggtaggcggaggttgcagtgagccaaaatcatgccactgcactccagcctggaaaacagggagactctgtctcgaaaaataaaaaaataaagggggaagaggaatagttaatgatgtatttatcctgtgctcagtaaatctgccttttacataagataaagtaaatagagtagaggaagtcatataggcatttgtcttgggtagacagagcaatgatttctattcttatctttgtcccctgcctgtgaagataagctgtgaatttacatggccagggtgagggaggccaccaggggagctaggtggccttctatcttgcagccatctgtttaggaacaaaaggctattgcgtgactcagttcccaagcttaacatttccctttggcatagtaagtttggggtcccatgttttttgtttgtttgggttttttgtgtgttgttgttgttttgagatgaagtctcgctcttgtcccccaggctggagtacgatggcgcgatcttggctctctgtaacctccgcctcccaggtttaagcgattctcctgcctccgcccccggagtagctgggattacaggcacctgccaccacgcctggctaaattttgtacttttagttgagacggggtttcaccacgttggacaggctggtctcgaacttctgagctcaggtgatccacccacctcggcctcccaaagtgctgggattacagatgtgagccaccgcgcccagcctgtttggtgttttttttttttttttttttgagacggagtcttgctctgtcgcctaggctggagtgcagtggcgcaatctcagctcactgcaacctccacctcccagttcaagggattctcctgcttcagcctcctgagtaactgggattacaggcatgcaccaccacgcccagctaattttttgtatttttagtagagacggggtttcaccatgttggccaggctggtctggaactcctgacctcaagtgatccacctgcctcggcctctgagagtgctgggattataggcgtgagtcaccgtgcccggtctgggcctcgtctttgagaggcctgctaagcttctttctgtcctgcaggtttcgtagagctctgactttgagtctcgctctgtcccgacacaggagaagacagaggtgtggcattgtgggctgagagcaacagattagaggaaactatcttaaagattaagccttctttctacagctactgtaggggagcctgggcatggtggttcacgtctgtaatcccagcactttgggaggccgaggtgggcgaatcacctgaggccaggagttggagaccagcctgagtaacatggtgaaaccccatctctactaaaaatacaaaaatcagccaggtgtgatggtgggtgcctgtaatcccagatactcgagaggctgaggcaggagaatcacttgaacccagcaggcagaggttgcagtgagccaagatcgcaccactgcactccagtccagcctgggtgacagagcaagactcttccaaaaaaaaaaagaaaaagaaagaaactgtagaggaatctgagacctcaggaaacccagggctcatggtagagtggaaagaccagggctttggggttgacacagagtactcctggtgcttagaggctgtgtgaccttgggcaagtttctttacctctctgagcctctgtgtctttggctgcagtgtctaggaaagcatctgcacacagtgatgtgtgtgatccaggccatcctttctctgttctgtgcatgcatggccatgcctgctgagaatcctgccaccaaagattcctcagtggcatggggacagatggaatgtgctgttgcttccctgcaggctctaggagctggtccttgggcccaggactccatcactgttgtctgcatggatttggacaagggtggccttgattcttcccacatcctagtcctgaaaggaaggcccgtgttgggtcacaggagaagacgagggttctaggggatgtggagcgtggggtctttgtgtggctgaattagaggcattactccacgagatagggacacgggaggaggacgttgtctggaatggctgatgtttgcagtgtctctgggcacgcaggggggctggcgggccgtgcctgaagacagatcagcaactcagagatgtgcagagattgctgagtgtgggtgtggacggaccaggccagggacctgcagggtttgggaggacctgaggtggtgggtgttggagccctgggaaaaggaggaaccaggccaagcaggtgcccagcctctgtcctgtgggaagctccctgctctttggggcaacccccacatggggaacagggcctccattctggcagcttgcgcacgggaggccaagccacccagacggggtcagcagactctaagcagcacagagcaccacgccaggagatgcagttcccaaggcagcctcctaaacagaagtgagctcttcccagagttttcaagattaaaagagccagacacagtggctcacaactgtaatcccagcactttcggaggctgcggacaggaggatcgcttgagcttaggagttcgagaacagcctgtgcaacagagagagactctctctacaaaaaattttaaaaaaacttagtctggcatggtgattcatgcctggagccccagctacttgagaggctgagtggggaggattgcttgagccaaagagttcaaggctgcagtgagctatgatggcaccactgtactccaacctgggaaacagggtgagaccctgtctcaaaaaacaggagtcaggctgggcacagtggctcacgcctgtaatcccagcactttgggagaccgaggcaggcagatcacctgagctcaggagtttgagaccaccctggccaatatggcaaaaccccatctctactaaatatacaaaaattaaccggacgttgtggcaggcgcctgtagtcccagctctcaggaggctgacgcaggagaatggcttgaacctgggaggcagaggttgcagcgaaccgagaccgtgccactgcactccagcctgggcaacagagtgagactctgtcttggaaaaacaaaaagaaaaaaaaacaggagtcattttgctccaaagacccatcagtctgctctgccctgaatcatccggccctggctccctgcctgcgtctagctccaccccacaacatctcacccttaccgaacccgcctgccccaagaggcccagcccatgtgaccccacgcttctcagagaggagatttcctgttggacatgcaaaccacccttcctgcaatcccagccccgtcctcaaccctggcacaagcccacaggctgctgcagagctctgccccagaccccatctccagcccaacccccactcagccttacagcccagctcaggccccatctccagggctaactgactccagcagctcctctaggctacagggaggggagagcagagcacaccagggctcaagcagcagataggccgtgacggttacctgggcagtgagcagggagaatgcacggcccccacactcccagacacggtctgtttcccattcacagaccttggtcagcgagcggtcaggggatttccaacagcccagcacagtgacaccggcccctgtgcatggaccccactaggcccatcagtcatctcccctgtaccaccccaaagttcagccacttccaggacatgggatctttttctttttttcttttcttttcttttttttttttttttttgagacggagtttcgctcttgttgcccaggctggagtgcagtggcgcgatctcagctcactgcaacctccgcctcctgggttcaagcagttctcctgtctcaatctcttgagtagttgggattacaggtgcccgccaccacactcggctaatttttgtatttttagtagagacggggtttcgctatgttggccagggtggtctcaaactcctgacctctggtgatctgccaatctcagcctccctcagtgctggggttacaggcgtgagccaccgcacccagccaacacaagatctttcacgcttgagtgcctatgcatggctggtccttctgtcctggtggcttcccactgccactccgtccttcacaaactcctacctgcctttttggagcccattttttgtttgtttgtttgttttcatttttgtttgagacaggtctctgtctcccgggctggactgcagtgacgtgatctctgctcactgcaacctccaccttccaggctcaagtgattctcctacctcaccctcctgagtagctgggactacaggtgcccgccacatgcccagctaatctttttgtatttttagtacagacggggtttcaccatgttggccagaatggtctcgaactcctggcctcaagtaatctgcctgcctctgcctcccaaagtgctgggattataggcatgagccaccatgtcaggccttgagagcccattcaagcatccttctctcttgggggaggtctccccagacttgcccacagagggtgggcaccctcattcatgccccttgtctcctaagtgtgtcctgttgtactttagtgaccagatgacaccccctctggctgggagcccctcagggaagcagccctgcctcttctctttaggttgttttgtgcccaacacagggcctgtgctggggacactgataaaaaaatgtgggatgggctggccaccgtggctcacatctgtaattcctgaactttgggagggcaaagcaagaggatcacttgaggccagcaagaggatcacttcagcctgggaaacatagcgagactccatctgtacaaaaactttaaaaaattaggcatggtggcacacatctttattcccagctactcaggaggctgaggtgggaggatcacttgagcctgggagttggaggctgccgtgagctatctatgatccactgctgccttccagcctgggtgacagagcaagaccgtgtctcaaaaaaagaaaaatggatggagggacagaccaataactgatgctagaaaccagctgcagccaggcacagtggctcacacctgtaatcccagcactttgggaggctgaggcgggtggatcacctgagccaggagtttgagaccagcctgggcaacatggtgaaaccccatctctactaaaaatacaaaaattagctgggcatggtggcacgtgcctgtgatcccagctacttgggatggtgaggcaggagaattcgcttgaacccagaaggcagaggttgcagtgagctgagatcacgccactgcactccagcctgggcaacagagcgagactctgtctcaaaaggaaaaaaaaaaaaacagctatataggagtgggtcggccctgcagagaatgtaatgttttggcagatcagggacgcctggtgggagaagcagcaggtccagtggctaagctggtgccaactctcatgcccccttgtcttcctcttgtagatgaagatgacgccaacagactcggggagaaggtgatcctgcgggagcaggtgaaggaactcttcaacgagaaatacggtcagtgcctgtggtcagggtcagcacaccaagccctcctcccgggggtggtggggggcctccctctgcagccagcctggctttcaggagcccccagctggctgcctgctccctggtgacatggctgctctgcccatgacccacgttttgtgtatgttgattttttttttttaaacagggtctcactctgttgcccaagctggagtacagtggcgtatctccgctcactgcagccttcacctcctgggcttaggtgatcctcctgcctcagcctcccaagtagctgggactacaagcatgcgccaacactcccggctaatttttctatttttagtagagacaaggtttcactatgttgcccagactggtcttgatcttctgggttcaagcgatcctcctgccttggcctcccaaagtgccaggattacaggtgtgagccaccatgcccagcctgtaggtcttgatttttttttttttggagacagagtctcactctgtcgcccaggctggagtgcagtggcgggatctccactcactgcaagctccacctcctgggttcacgtcattctcctgcctcagcctcacgagtagctgggactacaggtgcccgccaccacgcccggctaatttttttgtatttttttagtagagacgaggttttaccgagttagccacgatggtctcgatctcctgacctcgtgatcctcctgcctcagcctcccaaagtgctgggattacaggcgtgagccactgcgccccaccagggtcttgatttttaaactctctgggtgtgatggctgctgggctagggcagcccagactccagccctttccctagagggctttgccattgacaggagacatctttcctcactgtgacttcctgtgccctctaggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccagtgagtgcccggcctctggaacggggaacagagagggcgaggccatggggagggtgaaagtcaaggtcacggtgggtcagctgggatccagacccaggtgtactgtaatagttcctgcctctttctcctgaaacatacaacttcaacagtcatggacatttacttatttttaaagatttttttttagatattacatttgttctctggggaaaaaacaaaacatgttttaattaaatttgactttttctgactatacaattctgatttttaacatttaaatataaatatgtttatttaaatatgaatatttattatatattttagaataattataattccatagtctcagtgattctcttttttttttttttttttttttgagacagagtcttgctctgtcacccagtctggagtgcagtggcacgatctcagctcactgcacgcttcacctcctgagttcaaccgattctcgtgcctcagcctcccaagtagctgggattacaggtgtgcaccatcacaccggctaatttttgtatttttttggtagagatggagtttcaccatgttggccaggctggtctcgaactcctgacctgaagtgatctgcccgcctcagcctcccaaagtgctgggattacaggcgtgagccactgcacccagcctgcattattactattataccgtatatccttacaatcttttgggttttggtttttgttttgagacagggtctcactctgttgcccaggcaggagtacagaggtatgatcatggcccagtgcagcctcaacagggtctcactgtattgcccaggctggtcttgaactcctaagctcaagtgatcctcccacctcggcctcccaaagtgctgaggttacaggtgtgagccaccacacccaaacctgggtggcccagttttttttttttaatacaatagattatttgattattttcagaataatacacacagcaacctggaaaatacaaaaagatagaagaaaagaagatagctgtaactctcctactgaaagtcaacactgtgatgcatttctttatatttttaaattattattttattaatatattattactttctttttgagatggactctcgttctgtcacacaggctggaatgcagtggtgtgatctcagctcactgcaacctccaccgcccaggttcaagcaattctcctgtctcagtctctcaagtagctggcactacaggcacacgctaccacacctggctaattttttttttgtatttttagtagagatggggtttcaccatattggtcaggctggtctcaaactcctgacctcaggtgatccacctacctcagcctcccaaagtgctgggattacaggcatgagtcaccacacccagccccccctttttttttgtattgcacaggctagtctcgaactcctgggctcaagccatcctcccatgtcggcctttcaaagtgctgggattatgggggtcagccaccacacctggcctgtggtgtatttctttctttcttttttttttttaagatggagttttgctcttgttactcaggctagagtgcaatggcacgatctcagctcactgcaacctccacctcccagattcaagcaattctcctgcctcaccctcccgagtagctgggattacaggcatgtgccaccaccccagctaattttgtatttttaatagagacagggtttctccacgttggtcaggctggtctcgaactcccgacctcaggtgatctgcccacctcagcctcctaaagtgctgggattacaagcttgagccaccgtacccggcccgccttcaatgttatattatgtgttttgtttcttcgtttttttgagatgaggtcttgctctgtcgccctggctggagtgcagtgccgtcatcttggctcactgtaacctctgcctcttggattcaagcaattcttgtgcctcagcctcccaaatagctgggatcacaggtgcccgccaccacacctggctaatttttgtatttttgtagagacaggttttcaccatgttggccaggctggtctggaactcctgaccttaagtgatccgcccaccttggcctcccaaagtactgggattacaaacatgagccactgtgcctggcctacatgtttttttaaaattacgataatatttgcgtgtgtcaaaaaaaaacaaattgttcaaaatcaaaaagtagaggtttcctttctcccacagacagttcaccccctgaagtaacaactagaaaatgcaggaaaacggccaggcgtggtggctcacgcctgtaatcccagcactttgggaggccgaggtgggtgaatcacctgaggtcaggagttcgagaccagcctgaccaatatggtgaaacctcatctctactaaaaaaaaaaaaaaaaaaaaaaagatacaaaaattgggccaggcacagtggctcacgcctgtaatcccagcactttgggaggccgaggctggcagatcacaaggtcaggagatcacaaccatcctggctaacatggtgaaaccccgtctccactaaaaatacaaaaaactagccgggcgtggcgcagggcacctgttgttccagctactcgagaggctgaggcaggagaatggcatgaacctgggaggcggagcttgcagtgagccaagatagtgtcactgcactccagcctggatgacagagcgagactccatctcaaaaaaaaaaaaaaaaaaaaaattagctaagtgtggtggcatgtgcctgtagtcccagctactcaggaggctaagacaggagaattgcttgaacccagaaggcagaggttgcagtgagccaagattgcaccactgcactccagcctgggcgacagagtaagattctgtctcaaaaaataaaaataggctgggcgtggtggctcgcgcttgtaatcccagcactttgggaggccaaggcgggcagttcacgaggtcaggagttcgagaccagcctggccaacatagtgaaatcccatctctactaaaaatacaaaaaattagccgggcatggtggtacacgcctgtaatcccagctactcgagagcctgaggcaggacaatcgcttgaacccaggaggtggaggttgcagtgagctgagaccatgccacagcacaccagcctggacaacagagcaagactccgtctcaaaaaaaaaaaattaattaataaaaataaaaattagccgggcatggtggtgtgcacctgccttcccagctactgggaaggctgaggcaggaggatcgattgagcccaggagttcgaggctgcagtgagctaggatggcaccaccgaactccagcctgggcaaaagagtgagactctgtctcaaaaataataattgataataatgctgtgatgaatatccacttgcataaatctgggcacacatttctgatcacttggtcagacaacatcctcgctttatagatgaggacagcagacccagaggaaagatttgccagcacaggcccatcatccagggcctatatgggggatgctctgttgggacgttgtgccccccatttttatttgggtcttaccaggctcccccagcagcagcagcagcatatctcagggagcaggtgagaaggaggggaaaacagccagacacctggattctccgggcgcgatggctcatgcctgtatcccagcactttgggaggtggaggcaggcagatcacctgaggtcaggagttcaagaccaacctggccaacatggtgaaaccccgtctctactaaaaatataaaacttagccgggcatggtggcgggcgcctgtagtcccagctactcgggaggctgagacaggagaatggcgtgaacccaggaggtggaggctgcagtgagctgaaattgcgccactgcacttcagcctgggcaaccgagtgagactccatctcaaaaaaataaaggaggggaaaacctcattttctaactgccacctcatttctttctttttcagaccctttgcagaaatctgcaatgatgccaaggtgccaggtgagtcagaggtgaagaagccacccttctgctccgtggggactagagactgttccatttgaaaaaaggtagacccgggcgcagtggctcatgcctgtaatcccagcactttgggaggccgaggcaggcagatcacttgaggtcaggagttcaagaccagcctgagcaacatggtgaaaccccgtctctactaaaaatgcaacaattagctgggcgtggtcgtgggcacctgtaatcccagctactcaggggactgaggcaggagaattgcgtgaacccgggaggcagaggttgcggtgaactgagatcgcgcccctgcactccagcctgggtgacagagcaagactccatctcgaaaaaaaaaaaaaaagaaagaaagaaaaaagcagagacaccaggagttggaggctgcaatgagttatgattgtaccactgcactccagcctgagcaacggagcgagaccctgtctctaaaaaaaaaaaatttcataaaaaaattttttaaaggcagaaatagatgtggtccaggtgggcatgcaatagatggctgaccaccttgagaaaaatatagcccctctccacgctggggcctccccagggagcctgaggtctccatgaacagagccaggtatccccaagaggcctccagaaacctgcaggtgccctgcagaggggaggccttgccatagcaccagtgagtgtatgaggtcagctggaaggacaagaggcaggctgggcctcagggaggatcatggagtcctcctgggtagcagaggggtagcacgtgaccaacagtggtgaggcaggcaggcattgcccgagactggccagaccccctctgttctgctggcatctgcagggtatacagaacctttcactaggcacctgggggccgcctggcatgatggttctgattaaggtgtatgatgggacttgggagaaagtactcccgggtgactatgatgtgcacctgattaagaaacactgattgggccaggcgcagaggctcacacctgtaatcccagcactttgggaggccgaggcaggcatatcacttgagatcaggagttcaagtccagactggccaacatggtgaaaccccatctcaactgaaaatagaaaaatcagggccgggcgcggtggctcacgcgtgtaatcccagcactttggaaggctgaggtgggtggatcacctgaggtcaagagttcgagaccagcctggtcaacatgctaaaccctgtctctactaaaaatacaaaaattagccaggcatggtggcacgtgcctgtaatcccagctacttgggggctgaggtaggaggatcgcttgaacctaggagacagaggttgcagtgagccaagattatgccactgcactccagcctgggcaacagagcaagactctgtctcaaaaaaaaaaaaaaaaagaaaaagaaaaaaaaaattagcctggcatggtggtgcacgcctgcagtcccagctacttgggagtctgaggtggaagaatcactttagtccaggaggcagaggttgcagtgagtcgagatcacaccactgcactccaggctgggtgacagagcaagactctgtctcgaaaagaaaaagaaaaagaaacactgattggccaggtgtggtggctcacgcctctaatcccagcaatttgggaggcctaagtgggaggactgcttgagtccaggagtttgaaaccaacctgggcaacgtagtgagatcttgtctctacaaaaagttttttctcccatccaagtactaaccaggcccgaccctgcttcagttctgagatcaggcaagatcgggtgcattcagggtggtatggctgtggaccaaaaaggtttttctaaaaattagccaggcatggtagtaggcacttgtagtcccaggaggctgaggctggaggatcacttgagcccaagagtttaaggctgcagtgagctatgattatgccatcctgcctggatgacagaatgagaccccatctcttttttttttttccgagacagcgtctcactctgtcgcccaggctggagtgcagtggtgtgatctcggctcactgcaacctccgactcccgggttcaagtgattctcctgcctcagtttcccaagtagctgggattacaggcgcctgccaccacgcccagctatttttttgtatttttagtagagacggggtttctccatattggccaggctggtctcgaactcctgacctcatgatctacctgcctcggccccccaaagtgctgggattacaggcgtaagccactgctaccggccttttttttttttttttttctttcaagacagagtctcactctgtcactcaggctggagtcaatcttgcgatcttggctcactgcaacctccgcctcctgagttcaagcaattctcatgccttagcctcccgagtagctgggacttcaggcatgcaccaccacacccagctaattttttgtatttttagtagaagtgaggtttcaccatgttggccgggctggtctcaaacacctgacctcaagtgatcttcccaccccagcatcccaaagtgctgggattacaggcgtgagctactgtgcctggccgagaccccgtctcctaagaaataaaaaagaagaagaaagaaaaaatactgatctaatcttaccccacctcattgtacagctgggaagctgaggcacagagatgcccagggacttgcccaggccacatagtgagtcagatgctgtgtagaccctgctctcaggaccacccatctgaaccatagaccaccgtgggccacacggcccagtatggctgctcaacagggacagtgataggattcagcaagtccacgccacaaccttacctgagacccaaggccctgactcctgtcaggaccaggttcacctggaactccacagcctggggtggcacagcccagctagaagccacctccttccatcaagagctagtcacaagcctgggccataaagtgagaccctccctccgtctctgcaaaaaaattaaaaattagccaggcgtggtggcgcgtacctgttgtcccagatagtcaagaggatgaggcaggaggagtgcttgaggccggaaggtggaggctgcagtgagctatgattgtgccactgcgctccagcctgggcgacagagtgagaccctgtttccaaaaaaaaaagagccagttaaaagggtcaggtctggcactgaacacacggatctggaggcgatttggtttactctcaggtcaaaggcagagaggaggccagtcgcggtggctcacgcctgtaatcccaacactttgggaggctgaggcagggaggcaggtggatcacctgaggtcaggagttcaagaccagcctggccaacatggtgaaaccttgtctctactaaaatccaaaaaaaaaaaaattagccgggggtggtggtgggcgcctgtaatcccagccgctcaggaggctgaggcaggagaattgcttgaacccaggaagcggcggttgcagtgagctgagatcacactactgtacttcagcctggggaacacagccaggctctgtctcaaaaaaaaacaaaacaaaacatggcagagacacagaaggccacatgaaagcctcaggaggatttgggacagatgcccagagggtggatactgtcacccacatccaccactccctccaatgtggccatctctcatggtgattcaaggatggccacagcccatggaccagtctgagacagagggtggggcagcctctgacttctttttcatgtggaatctcccacaaaaatccctctgactcatagcctgggctcctcctgcctccagggtcttctctttcgcagggtctctatgcctcaccacagacccccagtttctgacttctccaccagttgaagagacatttgccccatggacccagcctgcccttactctgtgtcattaagacccttccggtgggctgagtgcagtggctcacgcctgtaatcccagcactttgggaggctgaagcaggagaattctttgagcccaagagttcaagaccagactgggcaacatacagagaccccgtctctacaaaaaattagccaggcagggtggtgtgcacctgtagggaggctgaggcaggaggatcacttgagcttgggaggtggaggttgcagtgagccaagaccacaccactgcactccagcatgggtgacagagtgagaccttgtctcaaaaagacaataaaagcccttctttattgggctgggcgaggtttccatgcagtaatccatccaatcaggacgtgctgctcaaagtcttacatcttcacctcaagttaatccagcaaccacagaacacctgctgacccctcctccgtgctgaactaggtgctgggttcttttatgcatgcggtgttttttgagtctcacatcacactggtttccccatttgactcagagaggttcatcagttttcccagattcacacagtgataatagtaagtggccacagtgaaatttgaacttaggacttctgattctaaaccagagtttctttcactggggcactgcctgtctacttggacctgtgaactctccactcaggaccaccatacattagtgataaccatagcaatacaatttttttgtattttggtagagacagggtttcaaccttcaccatgttgcccaggctggtctcgaactcctgacctcagtcaatccacccaccttggtctcccaaagtgctgggattaccagtgtgagccactgcgcctggccccaggtcctctttataccctccctggacaacctagcctgcagttccagcctccccagaactcccagagcctctcctggggtcccacatcccctcacagccttaaagagcccaggaaagaatgtggcctccggagccacgcagacttggccttggagaaagtcctttaacagccctgccccttcgggtgctcgtgagtgaaatgtgaataggatcttggagggttgctgggaggatcccagcagacaatgtgcaaagcatttagcacagtgcccagcacccagaaaatactcagaaactgagaatgcgattaatattgttgccatgagccaggcacggtggctcatgcctgtaatctcagcatttagggaagctgaggcaggaggattgcttgaggttgggaattggagaccagcctgggcaacataatgatgcagaaatacaaaaagttagccaggcatggtggcgcgcacgtatagtcccagctactcgggaacctgaggtgggaggattgcttgagcccaggacttggaagctgcagtgagctacgattgcaccatggcactccagcctgggcaacagagtgagaccctaaaaaacaatataggccaggttcgatggctcatgcctataatcccagcactttgggaggccgaggtggatggatcacttgaggtcaggagttcaagagctgcctgcccaacacggtgaaaccccatctctactcaaaatacaaaaaaattagctggacgtggtggcagacacctataaccccagctacttgggaggctcaggcactagaatcgcttgaacccagaaggcaaaggttgcagtgagccaagatcgcgccactggactccaggctgggtgacagagcgagactccatctcaaaaaaccagaaagagagaggacctagggcctaaggggtgagcttgctggggaggaggagggacacatggggatgaggatacggtgttagcaaaggcaggcaggccagcaagagcaggaggccggggagagtgggccctcgggcttgctttgggaaggaggctggacatgtgggctctggacaggtgggccctgacccccaggggatcaggagcctgaaatcctgaaagggggactcgaaaccttaagacagagcacttttccagggagctcaggaggctgagacagaaaagcctcagcttccagtgtcaacagccttttcccctccttccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagactccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactccatctcaaaaaaataaaaaatataaataaatagcctctgagaaagctcttccaaaagcagaactaagcattttgggtttgttccgcatcacctggagtcctaatccagtccctttgtccctctctctagcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaaaaagagtgttgcctttacttttacggtcactgtttcatgttctcttttggatcgtggccgcagctgtcactggggacagggtcaggaaacgcagctcaggtggcctgccaaggccctccttcttcatcacagcagaggtagtgtccaggaagaccccagagctctctgtgctcctgggagcacgtgacctcaagaagaaaagccacggaaggaaaatgtgccacggggccgggcgtggtggctcatgcctggaatcccagcactttgggatgtcgaggtgggtggattgcttgaggtcaggagttcgacctcattggcctgtaataccgatgctttgggaggccaaggtgggaggattgcttgagaccaggagtttgagatgagcctaggcaacatagtagaaccctttctctagaaaatgttaaatgtggcttacacctgtaatcccagcactctgggaggctgaggcgggtgaatcacctgaggtcaggagtttgagactagcctgggcaacataaggagaccccgtctgtacgaaaatgcaaaaatgaggccgggcatgatggctcatgcctgtaatcccagcactttgggaggccgaggcgggtggatcacctgaggtcaggagttcgagaccagcctggccaacatggtgaaaccccatctctactaaaaatgcaaaaattagccaggtgtggtggcgggaacctgtaatcccagctactcaggaggctgaggtaggagaatcacttgaacctgggaggcagaggttgcagtgagctgagaccacgccattgcactgcagctggggcaagaagaacaaaagtccgtctcaaaaaaacaaaacaaaagcacaaaaattagccaggcgtggtggtgcacacacctggagtccagctactcaggaggctgaggcaggaggaggattgcttgagtaaagatggttgaggctgtagtgagtcatgattacaccactgcactccagcctgggcgacaaagcaagaccctgtctcaaaaaaaaaaaaaagtgttaaatatggtaaatgtcagagagggaggggcccatcccagtgaagcactgtggctggatgggaggcttcttcaaaaaggggtttggagaccaggtgcggtggctcacgcctgtaatcccagcacattgagaggccaaggtgtgcagatcgcctgaagtcaggagttcgagaccagcccagccaacatgatgaaaccctatctctactaaaaatacaaaaaaattagccaggtgtggtggcgcgcaactgtaattccagctacttggaaggcagaggcaggagaattgcttggacccaggaggcagaggttgcagtgagccgagactgtaccattgcactccagcctgggcaacaagaatgaaactccatctcaaaaaaaaaggggggtggggtgggggcaggacaagttttcttttttcagaggcaagttctttctgtgtccccaggctggaatgcagtggcacgatcatatcttcctgcagcctcaaactcctgggctcaagtaatcctcctgcctcagcctccagagtagctgggactacaggtgtgagccaccacacccagctaattttttgatttttttgtagagatggggtcttgggttatgttgcccaggctggctgcaaattcctgggctcaagccatcctcctgccccagcctcccagagtgctgggattagaggcgtgagccaccatgcccagcctgggatgattttggatagagctctggatacctgacaagcagagtgatggggtcccagctgtgtctcagaaagaccactttaggggcaggtgggaagttgaaggaagggacaagactgaaggcagaaagacaagtcacaagagcgtggcaggcgtccaaggcctggcacccagtccctgcttattgggtgacacatatttactgagccctgcccttctggctggggaggccaagcagctgagtgtcct

SEQ ID NO: 12776 - DNA, 187169 bp, Human
  misc_feature (1)...(187169): n = A,T,C or G
gtgccacccgagccgcaccgccccgcccccgcgcggccgtcgcccgagctcccctcccctctccagcacgcgagtgtcggtaggtactacggcggagggcacctcctgggcccgcctccctaaccagggccccgcttgcgcgctgcctgctgtcttcacgtgatgcgcacccgagcttcgccgccaggcggcgctgatcatcggggagggggttaggggtcctagacacgcgagtcttcgctgtttctcattcattcattcattcacttaaatgttatttttcccttccttccttccctccctccttccgggatggggtcttgctgtgctgctcaggttggtctcaaactcccgggctcaagtgagcctcctgcctcagtttcccaaagtgctggggttacaggcatgagtcacggtacccggattctctctttctctctctgaatatatataatatatataaaatatatatataaaaatatataatatatataaaatatataaaaaatatatataaaatatatataatatataaaatatatataatatataatatatataaaatatatattatatagtatatataaatatatatactatataatatatataaatatatataatatataatatataaaatatatataatatataatatataaaatatatataatatataatatacataaaatatatataaatatataatatatataaaaatataaaatatataatatatataaaaaatataaaatatataatatatataaaatataaaatatatattatatataatatataaaatatataaaatatataaaatatataatatataaaatatatataatatataaaatatataaaatatatataaaatatataaaatatataaaatatataatatatataaaatatataatatatataatatataatatataaaatatataatatataaaaaatatatggatatataatatatatgatatataaaatatataatatatataaaatataaaatataaaatatataatatataaaatatataatatataatatataatgtataaaatatataatatataatatataatatataatatataaaatatataatatataatatatataatatataatatattatatatataaatatatataatacatatatattatatatattatatataatatataaatatatatataaatataatatatatatatttatatataatatataaaatatatattttatatattatatataaaaatatataatatataaatatataaataaataaaatatatataaaataaaatatataaaatatatatataaaaaatatatatatattttagtttctaagacagggtcttgctgtgtcgcccaggctggagtgcagtggcaaaatcataggttactgcagcctcgacctcctgggctcaaacaatcctcccgcctcagcctccgagatagctgggtccacaggcgaataccctgcccacctactttttttttttttttttttttttaattgtagagaccgggtcaggctggtctcaaactccttgcctcaggggatcacaggcgcgttatagagacgggggctttccctgtgtttcccaggctggtctagaactcctggtcttaggcagccctcccgcctgggcccctcaaagtactggaatttgcaggcgtaagccaccgcatctggctttgcacatttatcttccagcaaagaaaaacctgggcaactacatccaggaacttaattgctttaatttgggaggaagcaggagattgaggggtaaaggtgcaagaagagagaaaagaaaaattaggctgtttggaaagggtagcacagatatgatgtaagaaattgggtttcaccatatttgtgtgtgtgtgtgtgtgtgcgtcctcctctctcctgccctcactaggcgtgcctgtttgaaggccccgcgcgtttccggctcctgctcagaagctgtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaagtgagtcggtctcccccaccgcccacccatttaggtgccctatagtgtggggttgatatgaagaaatgcagatccctacccccccacacctcagtggttgaggggctgtgacttctcggtgtgattgatgcccctcaaaactctcgttgcagttggggggtagaggttgacactgtgactggagaaggaatttcacttgggtcagcagtaggagtaaacttaaaatctgtgtataaacaacaggaatcttaaagaaaataaaaaggtatccttgcaaaggttagtgaccaaactgatacttttgcgttttctgttcagttttttctttccttttccttattttttttccttggaaatccatccttttaatttaaataaacattcttaaaaatcacttccaagtgttggacactatattgtcaccagaggagaaaattgctctgcatttcccgtactgtttaaattatttcaacctttcattccaagtagaattgacaacactcacttttgtgaccctgctcccaccccctgcatgtttatgctgttagcataatgcaggaagagtttactggctgactgtatttgtcgactgtctgtctccagcaacgtgattagaccttcaagggcaggggtccttattcccagctcttgagctcactcatagtgagtgttcagtgaattaagaaaccgtcagttcagggaacaaagatgagcaaggcatgattccttgtctttaggagctttcagtctaactggactacctgcacactaacaattttaatgcaagctacaaagggatatgtgcaattagaaaaataaagttatgtgggaattgtgagttgagagttggttggggtggtcattataggacaggtagaattttacattccattttttttttacagctttattgagatagatttctcatggcatgaagtccaaccatttcattggctttcagtgtattcagagttgtgcaaccatcaccaccaactaattgtagttcatttccacccctcccgccaaaacatttgtacctcccagtttcctctgtcccctgtcatctggaaaccactaatctattttctgaatctatggatttgtctattctggacatatcatataaatggaatcatacggtatatggtctttatgtctggcttatttcacttactgtaacattttcaaggttcatccatgttgtatcatacatcaatacttcattctttttattgttgaataacattccatgatttgggtatattaccttttatatccatgcttatccatttatcagtttgatgtatatttgggttgtttcacattttaactattatgaataatgcatctatgaatatttgtgtacaagttttcatttctctttggtgtatacctaagagtgaaattgctggatcacatggtaactctgtattccatagtttaatagaacattttaattgaaattcatcttgggccccaggatagaaaaaagccttgaccataaatctaagcttatgaattcataagcattattggattcttaataattaaaattcaaataaagtcttataactacatagaaatatttttcaaaatatcactaaaattcttgaatgtaatccttcttctcctatatttgtttaaattgagttctaggtattctattatactttttgttacgtcagacattcttttcatggaaagtgagggatatatttggatttatttttccctcccctgaagcttcttaagcatgctttgttaaacttcgtaaaaaagggctaaatgaaattgcatgcttaaaggaaacttaaaaccaggagactgaagactgagttgctcatcagctctgtgtccttgggcaagtcgcttgactcagctaatcagtttcttaatacagaaaaggtgcataatcatttgtaccacacagggctgtgataaaaagtaaatgctatagatgtgtgttttgtaaacaccaaagtgttacataaatataagacacctctatgaccagttccttttgttacatactttattttttattaaatatttccgtctaaagcaatttcgtggaaatgaaagtctggttcagaatctctgaacggctgaaaattgtagactcacttttatagttcatgttcttttgtttatttgatcctaccaactcacaagattaaaaaaaaaaggtacagttccacaccaaataaaaaagtgtactcaagtctctctaagagatttgcatgttatttttgctttcagttcatacacaaaaaactgaatttgttataacagtgtccatggttaggtttccatgctgacagatgactattttatttgtgttaaagaagtagtatctacggttataatgatagaagccaagaatacttgaatgttgaatatatttgaaacttagcacttataagtttatgtaaagaatggagaaactgtcagaacaaaagaaagcccaaacgatattgaggacaattcgtgggctttcatttagaccctaaatgttgggaaagacagcaacatcttttccaaatggaactgatcaaatcgctgcttgaattgctttcacttagatttttctaatatttttgaaacgataactaaacatcaggtagctattaaacccttatttatttcaaatgtgagaccatacattcacaacctttattttacagctgaggattctagagagtatttcccccaaaactttccctgtgcattgttggaagttgactctgcagcattaatcttgtggatctgaaaccactttcctgcacatgacagaatatttcggtattatttcaaaactcagcccctgcaggtccacaaaagacccattttattgctaagacggagtgtttgcactgttttaaaaatatgactacttttatataggggcattgtatgacaatttccagagatatgaattaactaaagtattttatccaaaaaggcaaacagcaacaataaaaacatttcaatagccaaaattaattctaacataagctttttttgggacaagttggcaattgtagtagttggggtaaaggattgatctatcattataaattatatgttagatttatactttttaatattaaaatgtttatttagcacattttatgtatgaagcacagtttagggaccatttaaaactggaaccacatcacagtgatattacacgtgaagttgacaaaggtatacagttttcaggttgtgcttatgtaacagctaaagaatgatcactgttagtatctagagcaaatagtaatggaataataggggtctccagaggttaactagtccacccatctgtttcttagctgaaccaattaccaaagtcatcccacatgagtgagtgtttttgtatcattaaggtgctctcatagagacaataatttctcagcctttcccagttgttaccctaatgcacgctatcagtacttcctttgacctaaagcctgtatttaatggaacagttaagcagctttgcacataagccactcttttaaaaaatcaaatctgtaagaatatagtgtatatagtaagcagctaactattaagagggaaaaatgttctctaatagatgtatgtatttctaagactttccttctcttgaagtttagggtagacatatgtcagctctggttggtgacactgcaaacagtttttactattgtaattgcttttcattagtagctatttgtttttgctttaaggttgagaatttcctatgagttgctttatttttttatgatttttaaaaataaattactgacttaaagtctataaaagcaactcttattgtttgtttgttttttcctcagttacttggacataggagaaatcaagaaaagaccaatggaagttgttaatacagaggtaatgcaaatattattttgaaaattcaaataaataacggtgccatttgtttctcatggtgtgtcttagagatttggacggcattctactttgatgagttctctaatgtaaagaaatggaacattatatgttttaaggcaaagataattctttctttgaatcattgtcagaaatgaaaagactgagtagatgttctaagatgtgcaggatatgtcaagattagacaaaacatatttttctcttttctagctacatgttctctgattgaaatccatgggaaggttccctgtcaagtgagaagattctgagcgttgttaaataaatctttaccaaagctacatcctcatcctaatgtgcctctgataactcagtgtttgatgtagccagggtcaccctaactgcccctgaggctttcaaaggagatgagtagatgtcacgttggacactttgtgatgtcaggaaaacacctgtgttttagcttctatcgaagtacgagttaagcatagttcgtgaaagtttatgtgaaggttggaaaaggagcttgtgaaatattcacaataccgcattccacgtagcttctgaaaccctggtggagttttaggtattctgtaggatgtattctttagtttgtgaatgaaaaaatagattaaaaacaaagttggggccacagcctgagacagggaaaattgtagttagatccagaataggcctctattcaccagcccagacagccactcttcccattcagaccccaaataaacaagtgcttccaatgggtaagtgctgccaatgaagaaatggccaacaggaaaagtagtttttctcacttgtagtccagagccccagagggactctcctcaacactcaccatttcctctcacatcatgtttgtgcctaataggaccaaataggcccctctagaaaaaatattgcgtaagaaaaaaattctaattgtacagtatttgaagaatatgaggttaaattcattattcaaataatctgtagaaagaggtacccttcctagacatcatttaacataattaatattttggcttgtattttcagtgcatcaaattgattagtcatgaaagtgataggctttgtagcttaaagtagacaaaggtatacaattttcaggttgtgcttatgatatagctaaagaatgaccaccagttgatatctgtctcaagtagagtagtaataaagggcagtgttgtgaatttgttctggatgtgattctgatgaaaggatacacacctgtttaaagtatactaccttgcatgaaattggtgaagaaacctggacttccgcaatagaatttgagatgtgtgaattcccaaaaaatgtgagcacagtatatttactctggattccagtgtctttgctgaagacattatccctagtaaaagacaacaggtgtgcaatagatttattgaatatacttttttcttaaaaatttttttttgagacagagtctccttctgtcacccaggctggagtgcggtggctcgatctctgctcactgcaacctccacctcctgggttcaagcgattctcctgcctcagcctcctgagtagctgggattacaggcacgtgccaccacacctggctaatttttttgtttttcgtagagacggggtttcagcatgttggtcaggctggtcttgaactcctgacctcatgatccgcccgccttggcctcccaaagtgctgggattactggcatgagccaccaagcccggccttaaaatagtatttttaataacagaagcattcacagaaactccagttcatttaatttgcttattgttcttccactctggggacagtaaccattgtttctctttattttgcacttacacatgagccaacgtacaagatccttatttatggatgcacaccttacgtgtgaaaaacctaccccttgtctccaaatgaaagactgcatctctttcatcctgcttcctactggtgactccctcccacttactcctttcctcttgctgccctgctgtggccttttatttcttctcagtccttacccataaacccttctaaaggagatggaaagagagaagtagaagaaattgtgaaatgcaaaggagatgggaaaaggtgttcagaaactgcttgtccatgctctttcccgcatcttccactcactcatgcccagctttcccacttgttcgctagagtcctctctcccactctgccctcctgtcctaaagtttcctccaggtctggacaagcagtgtgttcacttccctcacttcacatgtccagtccggagataccttcctccccaaagttcgcaccatgaccttcaccctccgaagtctgctttaagcaaaggcagcccctactttcattgccagaaagaaaggtttttgggttcttggcatctcaaaagggaactatgaaagcatttttcttctggaaatatcactttgactctgaattctatggtatttttacggctgttttaggtagagcacgagtggaaaagggttttgcaggctgccctgagaacctaattatactgtgtgatttttagtatgggaaactacctttctctttcccacaactgatttatagtcaaacttttggagttcaacaagttgataagttggaggatgatctatgctcaaaatttgagaacagacttggtagaacactggcatttcacaaaaattatagatctttaaaaatcttaggtgggtatttcctttcaacattaatgtgttgagaaaagattgcacatcttgttaagtgctattaaggatgagcattctttggagtatgatgatatataaagggagatcaatagagaattatttttgaagtggatttagaacatgaatacttcatgaaattggagggttaagagttgtttcaagggggagtttcagtgccgtagtagcacaaaaaaattcaaaaatgtgtcattatgagggatgagtaaaataacttactcaccaaaatggggggcatttccttcaaatctaaggtaattttgagttttcagtgatgggcctgcataataaaagccaccaccccagtatacacaattcagtttttctggttgcctaaaacatactaattctaattattccgagtacattttatacggaaagacctttgcatttcagtggagtcatgcagagtgtgtggcactgggtcctacccactgtggctgggacaccctttcagtgagtgctgggagttattccttctccttttccagagcagctcacccaagaccatgggtacgatttgttgcttttacgtagttaataatttagacaagatggcacctgcttattgacttcaggtcatgctaactagaatgtgcgtgtcaccttgacattggaaattcttttgtggtttgtgtcactgcttgcttgttccatgaggctcatctttgaagagatacttaaggacagccaatgctattcctcttcctctttatggcctcatgatgggtttggggaaaggcagaactgtaatggacctaacccaaaagaagcatagggtcctatttggtgaacactttgcacagcaggaagtaatggggtggagggggggaataaagaaacagaagaataaaagaaagaggaataaggtgactctgtggttgtttgcacccacctcagagtcagggcaccatatgggctcagagcagcctatccctgactctctacacccaggtcctgcttttactaatatctaaataaacagatctcctggattgcccttgtactctttttgtgctcctgagtcattttgcatagctatattttcatttttcctcccactttccctgtgtcagtggtggtttaatgaagacagttttcttagcttctgaccgtggtaactcatctccttgtatttatgacttcccaatcctctctttgcttcctcgtgtcccacctctcagtccagtttcacatctcattatatcttctaagtcctaagttgatttaccagctcctttctttcctctttaccttaagcagcctgtgggagtcctctgtcctcatgcagttggagacctctgattctgcatgtgtgatgcctttaccagcacttactcttgcccctacccttctgctttactgaatgtgatttctgcttcctctcttcttgttttcctaccttgtcctctctgcttccatgttattgaatgcctatacaatgcagtgggcagagtaagcaaaatgattaagacatgcatgacctctcacatccaggaatttatagtcttgctgaaaagacagatgagcatctctagtactacatcataagtgattcgatttagtaaatatagtttgcattgagccatttagttcaagtgcttctggctttatcatgttgcagcaaagccatttgtggacccttcaaatggaagcgtccttctgctttgacctggcattgtagatctcactcttcattcctgcacctcatgtctcatccatgtagtacatccttcaaataatgacattcttttttttccataaccattcaaggtggaattaatgacattcttaaatagatatttagagtacaaatctgttttactgtgtaaggggctttggtacatgttatatagagaggggaagagcaggcagcttgactttggagcacttagatgggctgggaactgtgctaggcactaggcataaaatggatacttcactgctcttgctctttgggagttcagcgtgtaggagaagagacagagaagtaaactagctatgattatctagtggcaggtggctgtgctagaggtgtgctcagaggactgaggaagtgcagattggattagggttgtgggtcagccagtttgaaatggtttaaaatataatagacccttttgttttttagcctgcttctcttagatcaaagttttgagaaagtctttttctacaacttgattaagagggtattatttaataattatatctgtaagagtcaaaatcagtctctagcagaaagagtgaaaatcagcttgcatggaaaagaggaaaaggtcgctttgctattaaccaggcttagaggatagacacatttaaagccaactataaaattaacaggaaacattgtttctcccatggtggcacagggctgtaaaatgccacaaggatcccttctttgagtgatgactgctttcttactgctgatgctctcagacttgctttgctattcccatcttttacggagatctttattggataaacttctcttatctcatacaacccctggttaatccctgattcttttaatttcaccttaaaaacagaaaccaatctagaactgatctctgtttcccttagctcttcagaatccttcaatgagattccaaaccctacaaacctacaaaccctcctgcctctttgtcactgtcattttatggattctttaagtgctggcacttgctacaccaagtccacacatctgattttgtcagactgcaggcttgttcctgttagacttctgattaggctttaacatatacatcagagttgtctgttagattgtggtctctaggaggtctgctaatcctgtatcgtacccaccacgctgaagactgggaattgtttaaatttgccatggttttgatcttccttttgggccaatttaagtagatgtccatttgccttgcacatgcctggttattccgatttttgcatgatggataggacgtctcaagtaatttaaaagcctttttttccaccacctatttagattttgtttcaggggtaaaattagttatagttaaatctttgtttgatacatttattgcccctgtaggataatttgcagctatattgaatgaatgctattcatgcaacaagtagagttatccttcagtatactcagtcctagggattgtttccagtaccccctgaggataccaaaatccaaggacgctcaagtctttatataaaatgtcatcatatttgcatataacctatgcacatccccccgtatactttaaatcatctctagattactagtaatacccagtgcaatgtaaatgctatgtaaatagttgttgtactgtattttttatgtcatttttaaatgttgagtttttttctttttctttctttctttgtctgtggttggttgaatctgtgggtgcagaacttatccatatgagggctgactgtatttattgtgtgcctgttatgtgctaggcgttgtggttgttagctgggaaccaagctcctggtttctgtccatggagcttactaatcttaagccttcctggtgtggtatctcttgatttttaactctaccaatgttggtctttgttgcagaatctggtgtaaggcagatttctttgattcaagagctgtatttagggggctaaatagcttttaaactttattattgataatgagtcagaggataatgggattaatttttgaagagtaataaacacctaattcctggaaagtatttttctattttcctaaagttataaacacttagtctactcattgtaacctgaataatagctggggttgtccctctcttatgatcaggataagtaggcttgaatctccattgcttagcctttttcttcccaagatacatgtgaattccacaggtattattatctcatgcccacctcttcttctgagtttctgcttctaaagtattggttgagttatggattctcttgttctcttacagtttgtgtctgtttaagacctcatcaacccagagatgaaattctttcattgatgtccacaagaatacctcacccatacaagtttatgtgtggtgaatctttttttttttttttgagatggagtctcgctctgtcacccaagctggagtgcaatggtatgatctcggctcactgcaacatctacctcccgcgttcaagcgattctccatgccttagcctccagtagctgggactacagacacctgccactacacccggctaaatttatatatttagtagagatgggggtttgtcatgttggctaggctggtctcgaactcctgacctcaggtgatccacccaccttggcctcccaaagtgctgggagtacaggcgtgaaccaccacgcccggactgtgtatggtgaaatttatcaatggtttgtagaactagagtggatattctaagtcacgtagaagtgttgacagctctacatgatgttgtacttccccactcttaaaaataccttggccttatatgccaattcaggctccagcctgtggccatgcttcttggtgacttctttcttttttccctcttcctgtctcttttctgtactacccctactccacatttccattaatttctaatacagaacaagttggaagttcatttttgtttctgtaaatccatgttctcagggtcagcagtaaatacattttttttttttttttttagacagagtctcttttgagcaatctctgttcactgcaacctcccctcccaagttcaagcagttcttatgcctcagcctcctgagtagctgggactacaagtgtgtgccaccacgcctggctaatttttgtattattagttgagatggggtttcaccatgttggccaggctggtctcaaactcctgacctcaagagatccacctgctcggcctcccaaagtgctgggattacaggtgtgagccaccatgcccagtcttgcagtaaagataatttttactctcttttccacatttatatttaaaaaatttagtagtctgttttgggcttcctcttcttttatcagttcttcctcatctgctattgatatccatcaataactctcaataaccagtcacaagagaaatataagcaagaagagagagcagaaggtcaagctcacctaattcaaagggatctatcagtgaataagtgtgctatctgtacttcagagaaatgctgcctcaaaagtaagaccacagtgaaaatcttcccagagagtagcagccttcttcttggataagccatccttctgaatcctcttgaatacattgagataggtatattctctcagggagaacgtggatcaaccttgtttcttcttagtggggtggagaattttagaagtaccaggagaggaagagagaaaggaagagagtgaaactgcaaaactttgccttgctgaaaagtttgtgggaacccgggttgtacttcaggtcagttactcaggtgaatgtccttaagattttgaatatcattattaaaatttcacatttcagtttaatcattaggcataatctctaatgaaacatactataggatttcctacttaaaggctttggttgggaacgggattctagacattaaatggattctagatattaattgggattccaggcattaattattaaccttattgcaggaaggcatggtgattatgtggtttaactcactaacctttagcttgggaattttgagacccaagaggcttcaaagagcgaactactgaagaggtaatctaaatatttctttctttaacttgaggaaaactttccagattatgttaacttgaggaaaactttccggattatgttagtcaggtttattaatttatgaaagaatcaaagaaaataaaacacacttttgcaaattcttccaaaaatattgaagcccctccccaaacttttattttataccttttcccccaccactctgatataactgctacttaagaagcattcttttaaggaaagccagttcacgtcagtgaccaaggtgactcccaagtattcatgaccttaccaaggttttctgctaaagaacaactgctatatttcatttttctttcacactttcttgttttacccttttgtcagcattgaactgtgtgtatggatgtgtatggatgcgtgtatgtgtgtttgaacaagactaagaaagacagaagtgtatctgtcaaccagtgaaatatcagtctaatgaaaaatattcatcaataactctcaatcagctctgatcaaaagctaaaagattggtgattttactttagctttgaacatgtatcatggcatttgttccaaatatctggcatcctctctttggcatttaggcatgatgttaggaagcttaataactgtgaaattagcagatatgcatattagagcatgtatagttttttatttatagtgataagctgttctaagcaaagagaaagttaataaatgtttagaaaagaattattaaccttttcagaaaaaaataggaaaagtaataaaatattaaattactaaatatgtgtaaaataccacttgttttttctctgcctgacttatttcacttagcataatgttctccaggctcatctgtgtttttgcaaatgacagaatttcttttgtttttatggctgagtagcaatgaagctcacatgtggaatctaaaaagtcaaactcatagaagaaaaaaaaatggtggttactggcgcttgggatgaggacagggtggggaatggggagatgtttatgaaagggtacaaagattcagtttgacaggagggatatgttctggagatctattgcatagcatgttgattataattaataataacgtatatttgaaaattgctaaatgagtttttaaatgttcctactacaaaaagtgataaatatgtgaggtgatagatatgttaactagcttgatttaatcatcccacagcgtgcccatatatcaaaaaattatgttgtactccataaatacatacaattttgtcaattaaaaataaataaaataccacttagttgaaatatcaaactattctcaatacagattttcttttaaattctgaccaaaataagatccttttggcaattgaacagcaacacctattgaactgagaggagcttgttcttatattgcatgagattcagaaatacagaaggtgaaatttaggactgtgtagtacagtgcatgatctgaaattctgccaaggtatatcaagcttttggttgatggcagtttagatacttgtgcacttgtgagaaaatcaatgtttagatttatatttcaggataattattagaatgagcttattgagttttctggtgaaatcagaggaactcgtcttgatgaaagtatatttccatatggtataaataatagaaaaatgtgtctaaatcaatagtaatgtctagccagggaagacaaataaattgtattcaactttttattgaatgctgctcatgcatgattttacatttcctcaagaatatttaggcggggcacggtggctgacgcctgtaatcccagcactttgggaggccgaggtgggtggatcacgaagtcaggagatcaagaccatcctggctaacacggtgaaacccgtctctactaaaaaaaacacaaaaaattagctgggcatggtggcagacgcctgtaatctctgccacgccggaggctgaggcaggagaatggtgtgaacccgggagacggagcttgcagtgagctgagatcacaccactgcagtatgggcgacagaaagagactctgtctcaaaaaaaaaaaaaaaaaaagaatatttaccaagagccaggcagtggactacattctaggcctgcagatataaaaagactcacgtgccaatcagaaatgacaacaaggtaattgtaggaggactctctaaagagttttaaaaggtaagatacatgaaaagagtaaaaatgttggaaagtaatatcagagattattaatccaggggaagaaaagtattatttagacccaattaataattggcttcaatacttacaaagaatgtggtaatcagccctctacatcatagctgggtaacaaaatgggggtaaaaaacattaagatattgtgtgaagattggtgaatttgagttggtttgaaagaaaacccttttttttttttaattggagactactaaaaacttactgaaggagaaagagtgatacctgctttctatctattttaaatagaaatacattcttctgacttgcacatttcggttgtatgccaagatggcagaggtgaattgaggcttatttaaatttcaaaatgcgctctaatctaaggttttcggggtcagagccttcctgtggaagcccagaaggagcgctgcccagctgccacactccacggagaagtggctggtgcaagaagactgccggagtgactggcagcagtccgtattgacacctcctgtcttgatttcctgtttcagagagttcttccatgcaaataaacatgcgatgctgtgattttctgacttacagtcaatattgtttaagcaaaaaagtaacacaatttgaagcaacactgtgaaagtaaagggtttgaggaatattcctgttttgccgtatggttttcatatttagaactgaaggtagcatagcaccctggacggacatagcaaccacctaaagagatgtttcagttttcccccactaactgtatgtccagcaaagatgcattaaaggaataagggaagtaaagcccaaaggagtcagtaataagaaaccagtatatgaagtcatctgtgaggatgctttcacatttgattaggatatagaaacttattgggttaaacactttaaattttatttctctttaatgtagaacaaattctctgtgtgtttgtgtgtgtgtgtgtgtgtacgcgtgcacacatgcgtgcgccctcttacatgtctgattgttggggaagtatttttggattttgggaaactttgtttcaaagatctagagcagcaataaatctttggacttttcttggaagggtagtttggtgagaacactgtgctaatgaggccaaggacttgggcttgaatcccactcttagatctactaggtccctggccccagactgttccctaaataaccagctgtcctctcaaatgtggtactggttaaggtttgtgggaaagtatacatgtaattcagcctacatctatcaccgaactcagaaaacaactaaaaaggtccatgtctcgaaagtaggaggctaatagtcctatctttatgtgtaaaataaaataagtttcagtatagttcaaaacagatggatggaggcattttttttttttaaaaaaaaggtaggtctctatttgcacttggctgatttcagcaggaaatatgcaggcagtatgccctagtgtctagcttggtcaacaatgaaaattcccatgtatcattgtgaaagcctcctttataagcagccagccagatcaaactcagatgtcatcccatgattacatagtttggatgtttggtttgttgaaataaagttgatttcagcccacctcttagctgggggtagaacttttaagtggtgaaggatcgtgggagagagacaaataaattgactttttatatttgcagtgtctaatgtttaacctggaactgttctctctaggaaatctcaaatggcaatctctgctgctttgtattttttccctctttctagcagtgagtatgtttgtgtttcaaagatctgtgaacctctatggccatctttgctatttcaaattacatagccatatgtaactgggctgccaacttttagaaatttttagataatggccaggttccatggctcacgcctgtcatcccagcactttgggaggccaaggcaggtggatcgtttgaggtcaggagtttgagaccagcctggccaacatgatgaaaccctatctctaccaaaaatgcaaaaattagccaggcatagtggtacgtgcctgtagtcccagctactcgggaggctgaggtaggagaattgcttgagccggggaggtggaggttgcggtgagccaagatcctgccactgcactccagtctgggcgacagagtgagacattgtctcaaaaaaacaaaattttttttttagaaaataagtcatctaatatcattcaagttgcattttgttaattatattctaagtgataaaactccatattcatggcttgttttcttagaaacgagtggataactagatttccagtattacaaattttgcattagctagttttagatcttccatgctagtttttaaaagctggattaaaaaaagaagtgtcaattaaaaatatttttactacagcaaatacattctgttagtatggcttttgcaaatgcatagcttgttttgcatgaaggctcaactgactaatatttaatttagtcaaatagtatatgaaaattgaattaaattgcccttccgctagccggtacttcttctaatcagattgctattcccttgtgttatttctattttaattaattttatcaataatattgattaactttgactttcctcacctattaggctaccataagccaggggaatcctcagaagcttcctggaaggaatgatgtatacattgtgacctaaagggaatgagtatgttcaccaggcaaacagaaggaggaagagcattgcaggcaaaggagatggcatgtgtgaacgtctgcagatgagagagcacagggcacattcatctacatgttcatctctgcatgaacatgtatataatgcaatccaagcaatgtgattgtctactgggaattttcagcatttttacttagtgactcttatttattccgaaactctattcctctccaccgcttcaccaattcatttccttatgtataatcatattcaaatgataattttccatctctttaggaattccctttgctctctctatcttatagcatcaagttagtggatcaattttgatgtgtgcatcaaatttggtgtcaaaagacccatccaacacttattataaatatatccattcatagacaatcttggttagatgtccacattttaacctgtaacaatgttagtttagcttgtgtgtcccaggcaccatgtaattactctgagtacacagacagaattataaaatcataatggcactctcctagtactccatcaaagtgatcctaaaggattacaaagatggttttgttggcagcaattggagaagaggagtctgcagatgaattgatctatggtctctgctattattttaagccttctttcatgtgggagggtttggaccccaagggaatgacactagtcacaaatttatggctctcacgttttggtggtaaaaaattaacatcacaaattctttcatcaaaaaaatgatatgagcaccagtttatgtgccaggcattatgttagttggatttgcaatggtgaatatatcagacaaggcaagctttcctgaagctggctgtgtagtggagaagatggggccgtacgcaagctatccgaagtgtgctgtgtgggaggatacaggcggcacaggctgctggaaggatggctaccataagccaggggaatcctcagaagcttcctggaagaaatgatatatacgttgtgacctaaagggaatgagtatgttcaccaggcaagcagaaggaggaagagcattgcaggcaaaggagatgacatgtgtgaatgtctgcagatgagagagcacagggtacatttgagaaacatacatgtgctgtttggctgaatcacgggaagaggttgggatagaaggttgggaatggaactatgtgagagacaaggcatgggaggtagagaggtaccaacatcaggggttttaaaaagtaatttatctttttcctaaaaccaaccaaaagctgctgggcatggtggctcacacttgtaatcccagcactttgggaggctgaggtgggcggatcacctgaggtcaggagtttgagaccagcctggccaacatggtgaaaccccctctactaaaaatacaaaaattagctgggcgtggtggtgtgtgcctgtaatcccagctacttgggaggctgagtcaggagaatcacttgaacctgggaagcagaggtttgcagtgagctgggatcacaccattgcactctagccttggcaacaggagtgaaattctgtctcaaattaaataaataaaaccaaccaaaagctattgaagggatttcatcagggaattgacacaatgactcttattgctacagcaaggttggaggccaggcgaccatgtgttggaggtaaatgtgccactcatgatgggagaggctgttgagatggtggaaggattagatttgagaaacagagcttagtgattgagtggatgtggggtaatgaagaaagattagctggatgatttttgagtttctggcctgggctactggatagatggcattccctttcgtgaagacagggaatacagttgttgtttttttttaatggcggtgacaggcagagatatttgaagcattaacttttgaatattgagccagcctaaatgttagaagatgcacaaaactggaactcactgtgagtgtttgtgcatgtgcacatgtgtgtgtatgtatttctttgatatgtgtttagtcagtgttgttctaagtactttacaaagatgatataatcctcacaacaaccttatgaagtagggattgttattattctgattttacatgggaggaaattgataatgaaaacatgtttctcaagagctcacagatgagggactgtgtgttcatgtattgtgtgttaatgcagaaggaagcgtttcctaagaattaatgcaatttaattaaaagatgatcattcagtgtctttttgcacttgaaaggatgtttgtgggagtgaagggttttaaaattttttaataccttgatttaatgatgataagaaggataaaatatataagaaagactaaagaattaggaagtgaatccagaaaagggataaaatattctttcaatttccttaatagtctttttttttttttttgagacggagtcttgctctatggcccaggctggagtacggtggcaccatctcagctcactgcaacctccgtctcccaggttcaagtgattctcctgcctcagcctcccaagtagttgggatcacaggcacgcatcaccacacccagctaatttttttatatttttttggtagagatggggtttcaccatgttggccacctcggtcttgaatgcctgacctcaagcgatccgcccacctcggcctcccaaagtgctgggattacaggtgtgagccaccgtgcctggctcttaatactcttctttaacaagtcatcattagtcacaaaatattgccgggaattattttagttgtattctcaattgacatttttttttttggctttgcaaatattccctataggacaggatatttatgttgaatgtttccaatacagtgcttgaaaaggctttggcatatctgcttataaaaaggctcccataggaaaccagaaatatttttacatggaaatttacaacagagtgtgaagagattacagagagatatatagagctgagaatcactgaatgcattttttatttatttatttttattgtactttaagttctgaatgcatttttaaaaagtttttactgtgctactgtcaaagggccatttggtttctttagctgttttttccagatgtttcgagtaacatttaccaagttactaagcaaaaaacgcaacttgaaggatgggaggaagataataggggagagcatcatgtgttggagacaagctacttttctccccaagatctcaaggtgtcagttctttgatctttatgagcctcatgttccttatctaaaatgtgaaaataatactactatcttttaaaaattattgtgaggattagaaacatataggtatgtgtttagctcctagcactgtacctaatacatatttagaattcagtaaatggaaattatgccatgttgttgctgatgttacaaagggccacattaattgaatagctcataagtgaaataagacagggtttacttcttgaagactgggtatttggaaaaaaaaataaaaaaaaaaggcagggatcactgacattatattggctgctttatcaggctgtgactaaaaggagaaaatgcaaatgcacattaaatgtaaatgtaaatgtaaatgcttggtcagctacaaatccctctacaaatgttatgtgatacttatcattacttctaaaagaagtaatcatagagtgaatgtttgataaatagttgagatcattattatataaatatatgaaaaggaaaatatttcagcaaataaaatagcacataatatacttctatgtgtgactggatcttggaattgttcttcacatgtttagcgtttgcataatttcacaaagactgagagatacagagagagtaaaatacactgtgaattagccaagagttttccttgcaataagtggaaaaaaaaagaagtctctgcttcattttagcagaaaaagaatttttgaaaatatgttaaatatccttcaaaatctctggtggggctggagaactacgttgagagaataagcagccaggaaatcaagacagccagaacccagattacactatgtcaccaggaccaagccattaaagacagtcctgccaccaccattgaacagtggagacattcagatttttaggctactgcccccaacttttgacagtggatattgtaaatacttcctctagaacctggatttggttgctgttgatggcatgattataccttctttgctttgttggtccatcagtactggcgtaaaagcctgggtgggactactgggccaagctaggtgatatggtttggctctgtgtccccacccaaatctcgttgtaatccccataatcctcacatgtggagggtgggaccaggtaggaggtgattggatcatgggggcagtttcccccatgctgttctactcatagtgaatatgttctcacgagatctaatggttttgtaaggcagttttccttgctcttgctaactctcctgccaccacgtgaagaaggtcgttgcctgcttccccttctgccatgattgtaagtttcctgagtcctcccagccatgcagaactgtgagttaattaaacctcctttgtttacaaattacctagttttgggtagtatctttatagcagtatgaaaacagacaaatacagtgggcttggctgcaataggctgacaaagtgaacatctggcctttttaccttctgtgggtggtggtgggatctgcttccctgccagacacatatggttggaattctattcaaatagaaaacgcattcagatgctggaaagctgaaatatgacaaatacttactatacatcctttgatggtcgaataaccacatatcttttgtttctgccaaaattaatgccgctaattctaatgcttttgaaaatacactcctcctcttcaggaggaggcaacctcaagtctctttagttatcgcatcctatctcacttctcacagggcacatttgcctggtgaatggctttgtgtgctttgaaaagactttgaggaagactcaaagcagttacttgtgatattattgtaggatccttcagcaaagtaccaggtcttcccttcaattttgggggctgtcaggtctggtaattgactgtggggttgagatgactgatagtttacatcaggccacagtttacatgatctagctattttttgttacacaaatcaagtagagggttgtacaagtcttttaatcttgggaatctcgtgatcatttagtcaccatcataaaatccattgattgtggttaccatgtttgctgtgccgccctcttgtgactgctctgcctgctttgtctctggagaataagtgctgtttttctccttttgccaccccaggatcctgatacatcactgaaaccagaaagcccgtttcaaatgcagcatcttccaccagcatgtctggtctagggagaacaacaagtagagtacttttagagttgctggagcaacattcttcaccagtgtgtttctcaaggcctcgttgaagggagtgtgtttgggatcctcacttgaattacatagatagaagattagtgggtggggtgctcatgccaaagctactccacaatttctgtttcctttagcctttgaatccctttctctaagttacatgtttactgtaaacagatagtaaataacttaggctttgcaggccatatagtcactgtggtaactactcaactctgctgtggtagcatgaaagcagctattgatgatttgtgagtgaatgggtgtgtctgtgttctaataaaactttattggaaatcagaagatagacagaatttggcccataggtcatagtttgccaacctctgctctgagttaccttgaagaaaatttggcatcttaaccttatttaatgagggccaccgcaagtcctggttttcgtcaactagctaagcaaaaactcagagctatccaagataacatattgtgtccagcatttccagtaagtatacccatgataaaagaacaatacctttgtttttttcatttgactctctatgtacaaccttcagaagagaatgatactttgtccaatgttagttccagctagtttccagtgaagacattatcagggactatggaattatttaaaaacaaattccactaatcatgcttcagaattactgtactccaattagcaataactacaaactagaagccggttttgtttgcaagggctatcttccctgctctatacctgactttcctcctatgttccttctcctctcttcacttcccactatccattccagttttgagagtcataaaccttccttattctcactgcttaatcatgcccatcagttataactcctgtttctgaaattcaccctcttctctccacttctgccacctctaccatcataacccaagctactgtacaccttgcctgatttgcctcagtagtctcctactgtgtctccttgcacccattcagcttttgcattctgttttatattttatttcatccagaatatggaaacactaatctgatcctgttaccattgagtttaaaactcatcagtgacttcctgttactcttagcataaagataaatgccttaaacttagcctgcaagactttacatcaatgttttttggacttcagttcatgaatcttcagtacgttgaaaatcaatttaggtagttgtgacaaatgtatacaaacataaaatagaacatatcaggctgccctagagatagcaaagataagtactgttttgtgaaattgtgattttggttgcgtgtgtgtgtgtgaattggattggattgcaacataagacgtatttcttactttgagttctggtcaatagaagtctgaaagatactatgtgtgttctggggtcgtcatacctttcaggatccacagtctaacacttccttttgctctcttttctctgaccttgccaccgtctttcaagaagtggagtatgttttttctctctgggaacctggatggaacttgggactacttggaagaataaaatgcaatggaagggacatggcatgacttctggcctttcttctgtccacagcatacctgtgctacctcttatctcagggcctttgcacatggctgttctcttgagtttggaacattctccctcattcttctttttgccttttttgctcatatttaccctagcaccagtgtcatttcctcagggaagtcttgtctgattttcctaactaggtcagttccccattattgatatacatcaggcctttctcctttgcagcacttgctacagctgaattttacctttgtggggttgcatagctgaagtctaactctcctcctagattgtaaactccaagaggttagataccatgcctgtttatactcatttttataccagcccagcatcaaacacagtgtcttgtgcacagaaatatgtgtgtgtgtgtttgtgtatttaatgaatagtaatcatgctgttttcctaatatatgaaaatggctgtaatgagtttttgctttaaatactactgttcttttatgttttaaattgcttagtttaaaaaaaacaaacaaactgttccaattattaagacaacatagtgagtcaccccaaaacttagtaccgtaaaactatgacttattctgcacctggattcctgtgtgtcaggaattcagggagggtgcagcagagatgccttttctttgcttcacgatgtctggagccttagctggagatctaaaagctgtaggctggaaccatctgagggctgttacacatgcatgagtggtgactaatgttggctgtcattgggccctggttcctcctcttcacctgacttttccatgtggtctcttcttgtgggctagattttccttccttacagaatggtggtggagttctaagctgggagcaggaaaaaagagggagactgcgaggaaaagatgcttggacatcacgcagcatcactcctattgcatttattcttccaggcagtccgaagtcatatcccggttttcggggaggggaaatagattccatctcttgatgggaagtggcaaaattataaaaaagaatgtgagccagaaatattgctgtggccatttttggaaaatacagtctcccacactgggaatgtatttcaattacaattcatttagatatgtagctaccgcatgcctttagatgtcagtatatttgatggttactttgtgaatttcacacagggtctcttcctttccaaatctcttattttttagcctcctgaaatgaagaactgatttttcacctaattgctttcagaattaaatacacttaaaaaatagttgtgcaacatgtttattccaatctatacataatttctccttcttggttttctggttgctgaggaagcaacactttcttttggaaattttttcctgtggaggattaccaatattggaaaaagaatatgaagaagctactgagtttgatctcctgaaatataatctgtcatcagaatcaagtagaaatatgttattacatgtacaatttagtctgagaaatctgtatactcacatgcagataatctaaaagaagttactttatataattataaaaaatacttaaaagcatttagatattgctgagtatatccaaatatttctgacgagattcaaatatctatttagatataataaaggttaattctaaatataattattcaataacttttgtactttagtatcgcatatcaaataaaggattagatttaaaatattaccattttgtatataatatacgacccattctagtccatatcatctattcctgtcctagctactcaggaggcaaaggcaggaagatcgcttaaggccaagagatcaaggttgcagtgagctgtgattgtgctactgaactctagcctgggtgacagagcaagactctgtctctgaattaaaaaaaaaaaaaggtatatatagacaacttaaaaaacttcaaactaagaattaacttttatttattaacactgtataagcaatggctcaatgcactttaaagggttgagtagagagagctatgggaattatacattgttaccagagggaattctcttcccgtcttccagttagataggaaagattttatagaaggggcgatatttcattagctgtttgagtgaaagaaggaagatgccaggaagagctggaaacaaaagaaagcaaatatatatctttatcatcctggaaggaacagggaagaagccttcatttttttgccttctttttatttcaatattctttttctcctcaaatattgtagttttaaagtaaatatcccagttgttataattcatctataaacgataaaaatgcctagtttctaaaactgcaatttaagcctttttggcactactctgctgcgtaagggttcatcgcagtattgaaaaatatgattaaaccacagcctacctagacttctcttattcagatagaataatttcagtttcaaacatcattccctgtggatcctgtttctccatccctcagttgctatggctgcccactctttcctttctaagttctctctgtcccccttgagctgtgggatcctgtgtgaacatactaatcttgaaagagatgaaagagtattgaatggcaaagatagcctgccttgcacactagcaaagcaaatttacaagagagaaattctttcaagtgttctttgtggtggtccattttaaaaggttttctgatagttttagaggccaaattccttctccttttgaagctagacaaaatgactttttagagcaaagttgcccaaacaatatgtttgtacaatgtgacctgaccctttactttggtttattattgtactccccacggtgtgaagattgaaatttatcttttgatacatagggcaggttttagagtctttggaacagtacgtgtagaagttacattcagcccggggttgtttggtagttggtaacctggaaacgtaattgccacaacaagccatccaaacagttattcttctgagtgctcataatgaaagtaataccaggagggatcagccaggaattgactagacagcccttgcaaacaaaactgactgctacattttggttattgctaattggggtacagtaattctgacacacatttagtggaatttaaaaaataataataattctacagtagtccctgataatgggttcactgaagactttagttgggactaacactggatggagtatcattcttttttcatttgaggggtaaagtagctaattttttctttgtattcaagaaagtgtaagagacttgctttcttaaataaatgtgtttttcctccagtatttcataccatgcaagtattacaattcaatggaaaggaacacagtgtgggcatttgaacacaagcctctccctgcctgcccccttttttattcattcatgtcttcattttggtattataaaaataaatgctgatagaagatagcgcaggaaagaatgtttcatgtgggatggattttgtgtcatctcatggattccttgaattatttgtattgaatgtaactaaggcacaaagcaagctaggcctcttgttgcaaaacttagatgaatcatggcaatgggtagcttggttctaactccaattccccattctgtttggaatattggatggctaatgttaagttgttgcccaagttgcctgtctgcattgtatcttaagttccaagttattaccattctttcttaccgtaccattataattttgggattgcagggtgaaaatgaggagttgaaatgaaataggatagcaatggtatatttttcaactactctttcaataaacctaagttgaaaagagagatttaattcagcttgtttttcttcttaatattgatacttacatactcaggaaaacaaacaaatgataaagtctgtccaggaagtctagcttctgtgcaaagggaatgagggttaatattctccttcggttgtgctatttttttgtgtgcatacctctttgattacatttactgcctacattttgggtgattaagcttctttagcctgaatcatctctccaaactttcatttatgtgtttccgtcagtagggagggctcatcattttttacctaaatgcttctgttttgcgttgtttatcattgagagatggcatggcatggcatggtggaaaagacgtgaattttggaaacaaatagccttaagtttaaatcctgattctaggacctataatataatttcctctgtggagactggaaaaaactaatgtttatcttagagctgtggttatcaagaaatattaagtaaatatctatcatgtatcggatacatgatgttgatgaaaaatgagaactatgtggctcctgctttccaaggaagagcttgttgtccagcaagcgtagatatgcgtacaaataactgtagtaacctgtagtaattgcttcacagtgtctaagcccaatgttgataagcatttcaaggggcatgcaattaatattgcatgataagggaatcaaggaaaggacacttcagagaggaggtggttttcgaaaaatcagtagttcagtggaccattgagggtgggttaaaaggccaggagtagggacatagaaccataaaatttagcagctgtgttggctactagtttgatcaatatacctctggggcatgattggccatgggcgtgggtttggccctcaaacttggcagaagggggctctggctataacaagtcccaaaagcagggattctcaactcttgggacattcaaactatacaaactccccctgtgccctaagatattcagatacaagttatggcctcaattagttgaacttataagccttgcatattcagatgtccaaagtacagccagtttgatattccttatagagtactttacagaaatctaaactccttattactcagagatctaataatcgtaaatgtaaatctacacaagggaatccactttaaaatcctcagttgtcaacaactcagtgccagtaggcaggggatttagaattactctgtgacctgagcaatagggcttaccaagtttcctgtatatacagaggagatgtatgcccttgaagaaagtatttctctttggttcttgagcaaataacatttattagatatctcggacacagaaactcttcttgttaattgtcagagaatttctacttcacttagaaagtgtctgtattttcatccatgcaaatggaatagcgtgaatctcatttctttgtgcttgccatctctgccatctgtcaaagagtaacacatgttgggcatcaaagaatgcatcaagctaaacatatattaagcagagactagcaaatgcaaggagaaagacaagcacatttgagaggcttttagaaattttttttatttaaagaatattcattttgtttactagtaacactccataaattcattataagtttataatgttgccaggcgcggtggctcacacttgtaatcccagcactttgggaggctgaggcgagttggatcacctgaggtgaggagtttgagaccagcctggctgccatggtgaaaccccgtctctactgaaaatacaaaaattagccgggtgtggtggcgggcacctataatcccagctactcaggaggctgaggcaggagaattgcttgaacccgggaggcggaggttgcagtgagccaagattgggcccttgtactccagcctgggcaacaagagcaaaactccgtatcagccaataaataaataaataaataaataaataaataagtttataatgttgattgactaaaagtggactgttgccatgaaaactaattatatatatgaaatgcagacacattacatgctgacagttgctaaagaccctgaagctattagcagaaattagttttaagtaagcaagattaacaaagtgtcaacagcaatgaaaacaaaatgcttatgtaagggagagagatctcagggtttatagtcaaaagtcctaagctgggtggcccgtggcctcagtttccttaactgtgaattggtgacgaaagcaacacttggcctaacctaggtttccctgtaattcagttcccctcatcaaatacatactatccagttaattgtaagttttgacagtgcagttaccctgactgacttgttcatggttacagagggatccatagacatttgttgcctccaatttgccaggtgctgagctgtgctgaaggaatgagattatggtagaacacaatccttggcctcaaagtgagcccatctatctggggagtagttagcaaatactgcaagtagaatacagtatggtatgggttaaatgaggatgtaaatgaacatttttatgcattttttttttttttttgagacagggtctcgctctgtcacccaggctggagtgcagtagcatgatcaaggctcacttcagcctcgatctcccaggctcagggaatccttctgcttcagccacctgactagctgggactacaggcatgtaccaccacacctggccaattttttgcacttttagtagagacggatttttgccattgttgcccaggctggtcttgaactcttggacttaagcgacccacatgcctcggcctcccaaagtgctgggttataggcataagcctccatgcccgctcatcatacatgctttttattgatacaaatgatggtgtttttttcttctgctagataaatgttggcttcctttctatatctgctctctttatagttaatatatatgtcacccagctcttaacatgctttgtatgatttttaattttatggatcatctatagtaaattttaaatttttgactaattttctactatccagggagctctagggcatgggggggtccttctattggttggtgtattctaaaaatggagactctttttaacatttaacattagcttgagtcaaaaagagaggtggtaggtatcccgatgaaatgaaaaggtctgatttcctccctcccttccttccttccttccttcattctttccttccttcctttcttccttccttccttccttccttcctttccttcctctctttccttcctctctttccttctttttatttttctccctgtctttctctcttttttcctctcttcctttctttctttctttggttttggaactttgcatgaaacttgatcaataattttaattctgcattcctacatatgttgataataaagaaaaattacagtagtttgtggtctgggattcaacatgggtgtggggaaggaagaactgaaataatatcaagtaaatattatggtagtaagaacagagaggttgtgacactgaaaaacagtttcccaaccttttaattttatttaaaaaccagagacatggtaaaataaatgtgactcatttctcattcacatgtataatatatatatttttaaaacaggccttgatattatactaaggaataaactctgctctataggctgagatgtgaatgtgatgaagaagagagagggagaagaatgttctggattttctctagtatgttatattaaaacataacaaaaatccactgcacctgctatatgtaccctgaacttgcagaaaattttgtggaatatgtttgctgaaaaattctggactaagagaacatgatgatgctaatgtgactgaaatctttgattcttctttgaggaacaacctcacagaaatggggccatcaggtctcccttgcgacatcttcaagcatgtgagggacgtttagtttcttagagaagacaataacccccactcatctttgccagtgggagccaagatctaggttattcttaaaggaagacagttgattgaggcttccagcctctcacattttctctagatggcacaataacttacattccatgctgattttcctttcgcccagaggacctcataatttgcttatttgctgtaacataaaaacggatcacagaataaagatggcaaatgtaagtgagcgcttttatttgagaaccgaggagaagtgtgaggaagtagatatcgtgctctctcactcctagatggaacgttttagttttgaccacggggctctggagattctggttttggattattctaagaggagagggtctcttcagggaacctctgattccaaggcattctctgtggtaggcaggctgagagtaagacgaacatggccttactcttcattgcatttaatgtgaaatcctttcttctacttcttgtgctgtctttgatgtagttgaactatttgagatgccaaagtgtcatagctctctctctctcttttctttctttcttttctgtctttctttgttttttttttttagacaagctcttgctctgtcagccatgtgggaatacagtggcacaatcatagcttactgtggccttgaacacctgggttcaagttttcctcccacctcaccctcccaagtagctggaactataggcatgagccaccatgcctgcttaaatttttaactttttgtagagatagggtctactatattattcgggctgtttttgaattcctatcctcaagccagccttcagctttggcctcccaaagtgttgggattacaggtgtgagccactgtgcctggccccaaagtgtcatagctctttgatgagctaccctcacccaaacaatccagggagacgaggcaaaatatgaaaaagatgggacaaatagggaacagactttgattttcttgctaacaaatattaacaagtgagacacactcagtatcataaacaacttttgcttttgcttctgcaaatctggatggaccaaatacagattttatttctttatgtgtttttcttaaaccagtttcactgtcattcattttcctttcttaggtgaatgtgtttcattctagtaggatagagattagcttacagtgggctgattaggtaagggggtggtcactggggccattgacagttttaaactgttactttttgcgagcttcttacactttttgaggaaaaaactcactgaaccttgagcgttcttctgtatcaggtgctttgacctcctggatggtgcagttttgatgtgaaagtgaggttcttttgacccagctctacccttagggaatgcaaatatttttccaattaagcttggttcactggttaactacaagccattgtttctcactgttctgagctaataagcttggtatgtgaaaaaagacctccctctgaatattagtgacaaaacccatgagtgatttcaggggctaactgtactttctcctctgttttagtggtatgataaataattactttagtgttaaatatagtttgagtactttttgttgttcttttcaacttgcttcacaaagtaatagaggatcaaatttctttgaaactaaaacaaaacccaatgtaagcaaatgacagaagtttatgcttaagtgcttaaatgtagtctagttacagatggagattgttgctggttgcctcaggtggtagtttttatcacactgtaagtacatacttgtgcttgattattgggagaagacagggagagagatgaagacagggagaggtctcttatgtattcgatcttttatttgcattaaggtctattaagcattatattcattgaacttttcattttgaaatgattttagaaaaaagttgccgaacttacagagaattctttgtataccttacttcacccagttcctttgttaatgtcctacatagccatagcatagttatcaacactagaacattaaaattgatacaattacctaatctacagatcttactagaattttgtcagttttcccactgatatttttttcctggtccaggatcccatctaaaatcccacgtcttgtttggtgttcctatctccttaggttctgccaaaactaggttgttttgatagaaaactaccaaactaccaactaccctgtgactgttcctcagtctttcatgaccttgacaattttgaaagtcagttatttttatttttaaattgaggtggagtcttgctctggaggctggagtgcagtggcataatcttggctcactacagcctcagtgtcctgggctccagtgatcctcctgcctcggcctcccgaagtgttaggattataggtgtgagctaccatatctggcaagtcagttattttgtagatggtcctttaatttaggacatatctggtgttttcttgtgatcgggttgaaatgattcatttttggagatgtcaacaaaaagagtcaaactctgtaaaatattttaagaggttaattctgatccaaatatgagtgaccatggcctgtgacacagccctcaggagatcttgagaacttgtgcccaaggtggtcggggtacagcttggttttatatatcttaggaaggcatgagacatcaatcaaatacatttaaagaaatacatttgtttggttcagaaaggcgggacaactcaaagtgggggcttccaggctataggtaaatttaaacattttcttgttgacaattggttgagtttgtccaaagacctgggatcaatagaaaagaatgttccggttaaagacaaaggattgtggggaccaagttttattgtgcagaggaagctctcagatagcagacttcagagagagcaggttgtaaattatttcttactggacttaaaagggtacctggctcttagttgattatctcctggatctggaaaaaaaaaaaaaaaaatggaaggaaaacaaaggggaaaggagattcgtatagaatgtggatttttcccacaagagactttgcagggcaatttcaaggtatggcaaggaaatatattttagggtaaaacatttttattttcttccttgttatgccagaatcagattggaaagtaagtcacgatatgcaaggtcaaataaaacccatctgatgagaatttatgatttgtaggttatgactccccagaccccttagataggaatttgggcaagataaaaaatcagagcttaatcttcagggagcaaaaataccaggaaattatgttccctgttcagtgcattgtattagaagacactgctgaggaaacatgattgaaaaaaaagtcttttcccaatccagaaattctctccacaaaaggtagtagagaaagaagagtgttattattacacaagcgttaaatcagaatatgacacccatcacaggcaatccatgaaacgattgcaaagacaaaaagaaatcttacccttttagatagccaagtagaggctacccattacatacatgttttcaagataaacaaaactagtcttcaagaaagagggcttgacagcatcatttgtcacacgtaattaattcatcctaattttaccaggtatttggggtgaccatttgtattagctaatttgtttttatccaaaggagaaacaaacgtctcatgtctttatgacaggaagtttggctcctacccagcaaagttaggatcctatcctcccacagagactgggaaataccagtgatatcgcttttgctttttgcatttcaaagagatgactgctaggtccttgagtgggacatttctgggtcataaagttgacaaaaggcctaagtagtgtttaaaataattatgcagatttcacagagaggacaaagtacttatactctagtattctaaagcaaatgctctgataaaaaggaagggagggagatctcttatttttagaattaaacctcttatttttaatttgtatttgtccttgcagtacatgatgctgacatgtcatattactggtgagactgactttgatcagttggttacggtgatgtctgccaggtttccccactgtaaagttaccattattttttcctttgtaattaattaccgtcttgtggaggagatagtttgagactatgcaaatatactgtttcttaatattcatagtttcacccacaaattttagcatccattgatggttcttttctgtagtaactgttactattgtgtttaccaaaaggtgattttctattttcattatttcttctacatattaattggaattcttctatatggaagaattgccctcatttattttttaatgtatttattcaatcatttatttgcatcagtatggattcttagatatttattttaggtgttaaaatctaataatatcattcgttttgttgcttaaattattcttgatttggccactgagaactctttcaagttggcttttgtgtctttccagtacggccctgctgtttttttttttatttttatttttttatttaattactttccagcaccacaagatgttccaggcttgtcttatatttttctttctctggccctggaataaattgtttctccaaggatctctagtcccttttattggagaatggtatttagaaaccagcatctgggcattaggggtgattcttgctattgaggtttcaatgcttttaggccctctcagtagacagaactagaaaataaatgtacatatataactatacatacatacaaatctagttatttctgtatctattctgtatctattatgcatgtctatatgcaaatagatattttaaacactgagtttgtagccgagtgtggtggctcatgcctgtaatcccagcactttgggatgccaaggtggacggatcacttgaagtcaggattttgaggccagcctggccaacatggtgaaaccctgtctctactaaaaatacaaaaattagccagttgtggtggcaggtgcctgtaatcccagctacttgggaagctgaggcagtagaattgctcgaacctgggaggcagaggttgcagtgagccaagattgtaccactgcattccagcctgggcgacagtgagactctgtctcaaaccccatcccccacaaaacaaacaaacaaacaaaaaccaaaaaattgagtttgtactgatacctccagttctactccagcaccacggggtttattctagtctgcctcagttccttatttgtaacttctttctgtaatagtaggaaatcctactctcatcatccacattacatttatgtattggtttacttttaatgtagattcaaaatagatttagaattgctaacctatactcttatgagaagcatttgattgactaaagtacagtatttgtgtacagctttttgtcgttagacttcagtatatagtaagaataccgttttcccaagctctttgggttagtttcttccttcaccgtccatttattgatttgtaacacagttaggttcatttgttactgtatctttctattttgtgttcctcctatattttggttggttttaattatttgccatggtcctaaaagtcataagctatacaaaatatatactgagagaagggttgctcctctccctccatctctgctactcagttcctacccacacactacccattacttctacttatttcctgtccattctctgtaggaaaccactctccttagattctggtttatccttcctgtccttatcctgtccttttgcacaaatgagcagatacatgtatacattttcaaaatacccttcttacctatatgtagggtagcatactgtagatagtctttggcactttactgtatttcacttaacaaaatgtcttgggaaaatctctcctggacattggtctaggcaaagaattcgtgactaagacctcaaaagcacaagcaagaaaaacaaaaatattctgaatcaaggaccagagaaaaagacaaacaaaacaaaacaaaagtagacaaatgggacttaattaaattaaaaaacttctacacagcaaaagaaataatcaacaaagtaaacagacaccctgcagaatgggagaaaatatttgcaaactatgcatcccacaggggactgatatccaaatttacaaggactcaaacaactcaaaaaaggaaaaaaaaaaccccacaaataatttcattaaaaagtggaaaaattcatgcatagtcatttttcaaaagaaggcatacaaatggccaaaaagcatatgaaaaactgctcaacatcactgatcatcagagaaatgcaaattaaaaatgcaatgagatatcatcttataccagtcagagtggctattattaaaaagtcaaaaaacaacaaatgttggcaaggatgcagagaaaaagaaatacttatacactgttggtgggaatgtaaattagtacaactgctgtggaaaataatggagatttctcaaagaactaaaaatagaactaccattcagtctggcagtcccactactgggtatctacccagaggaaagaaatcattacatcaaaaaagatacctgcactcatatgtttatctcagcactattcacaatagcagagatatggactcaacctaagtgtccatcaacagataactggatacagaaaatgtgatataatacacacacacacacacacacgtacgtatataaaacggaatattattcagctgttaaaaagaatgaaattatgtcttttgccgcaacatggatggaactggaagccattatcttaagcgtaactactcagacacaggaagacataggaagtgcatattcccacttataagtgggacctaaataatgtgtacaaatggacatagaatgtggaatgatagacattagagactcagaaggatgctggagcagaaggggatgaatgatgagaaattacttagtggatacattgtacattattccagtgatggatacactaaaagtccaaacttcaccactatgcaatatattcgtgtaataaaaatgcacttgtaccacttaaatttatacaaaaaacaactaaaaaaactaacaacaacaacaaaaaacccagtatgtcttggaaacctctccctattggtatgtaaagatctttctcacaccttactgcaacttcagagccctccatcgtatggatgtgctatatttaagcactctcctatgtatggacatttaggttgtttctaatattttggaattataaataatactacaatgaataaaactgtgaatatgtatttttgtctcatttgttggaggtatatatttagagtagatttatagaagtggcattgctgggccaaaagatgggggaatatgtagttttgttagacattgctaaattcccctctggaagctttgtgccaattcgtgttcctatcatcaatgtatgggagtgtctgtttctactgtcttaaaaaacaaatatgttgccttactttttcattgtttgccatctagtaggtgagaaatggtatcttggtgttgttctaatttgcatttctctagttacaagttcgaacattttttatatgtgtaaagatcaatttttagattttttttaaaaacatgaattgcctgttcttgtcctttcattttttctatcagagtataaagagttttttttttatttgtataaagagttctttttacattaaggatatttatgctttatctctgatataggttgtgaatattttcttctagtttgtcaattgtcttatgactttgcttatggtgctttttttgtcatggaaaaatgattttttgtttttatgttagtcaaatttatccagcttattgcctctggatatggagtcataattagaaagtctttgtctttaccaaggctaaagaggaattcacccatgttttcttttagtacttgtatgatttcattttgtacttttatattactattccatttggagttcattcttgtctatagtataagatatggatcgaattttctctttttccagagatgcctaggctaccccactgtcccaaagccatttattgaaagtttatctttgctccagtgatttgaaatgccaacttcatcatatactaaatttccatatgtacttcctttggtctgtttctgggctttctagtctcttcctctggtctatttgtctatgcacaagtaccaccctgctaaaattaatttttaaaattatggtttaaaaattatcaaaattgtagtttagaataagtatagtttttaaaaaatgaaaaatatattgtccctgagtctaacattcaaacaattggatttcatattttaaaattatctttcagtttttctccatacatacatctgtaaatacagatgtatgcatgtatgtgtgcatatatgtagtgtttttgccatggaaaaatagctttttgtttttacgaagtcaaatttgtctctctctctctctctctacatatatatgtatatacacatatgtatatacagagttgtaatcatggaatattttatacaaagcttttttcattatttttctcttatattgttttccttgtatttttcatacttgcatcgtctttgtcatcatttttgatagcaatatatactgttttattgagctgatgtcataagttacttaatacaattgtatttagaaaatttctattgtttgagtcatcatctttaagtatatagcttttttccacatcttaattattttatcaggataaatcaggcagacatttactgtcaaaggatataacacattttatgcctctgaatacctaattctacagagttttgaaaaaacatattaattaaaaatgttatcagtaaggtagttttgcctcaaatttctcagcattggataaatgatttttgaataacctgtagaatatgtaaaacttcaggttttcttaaagcactctgaatttggcagtatttaggcatttgtttcttactcgtttatcttaatatttccattagtggcatccatacagctgatccttctctcttagcttctgaaatggttcgctctcttggtttaccccttaccattgcactctcctacctccctgtccacttttctcctgagtcctctggaatttttttctcctccattacccaaccccaaagcttggtcctgaaccattttctttgctttctactctcttcgttgctgagcactttcattttcatggctttaaatatgatcagtatgctgattactcccacatctgtgtctctagccctgacttcatggagccccagcctgcctgcatgaatggcacctctatctggaggtctcataggcatctcagatgtaatgtccaagactgaactctggatccacagcaagtgcaaatgttctctgtcccagtagacagcatcactgtccacctgactgttccaggtctccttcgcttactagccacaaacttctttcagcaagttccagcttctactgcaaacatgtatctaggcttcacccacttttctttttttcctcagtcatcccccaggaaaagctaccaccatctctgacttggataactcaccagcctcctttttggtctccttgcttccattcttgctttctgcagtctcttctccatgtggcagctggggtgatgtttataaaaatctgcagtggagtctaattatgcttaggctgaaacttagccttctttctttggtgtaggaggccctgcattgtgcccgccagcctgtcctttcctccttctccctactgcactccagctactccagcctcctttctgctcccaaagtatttttttggtttgatttcttatttttttgtgtatcactaaccctctctgttattttgtgggcttcatgaaggcaggggtcttgactattttatttaccaacaaatactcaacacttagtccagtgcctgtcacacagtaggtgactgatagatgtcattgaatgaatgagccctctctgtggatagtaaataaactaggaggtacatagacgatttactgtagacagcttctgatttcagaatgtggggtgcctcttagggcctgtctcttcctttggaaggggagtatcatgtatggaaggctttcttctctgcattggggttcttcagatgtcctcaaccactgcagtaaaggctggtggctggtgtggacgacttggttctaggaggttccttaaggtgtaagtgcttcgctaaggagctacagaaacatgcattatctgggactatttatggggctggttatttaaaaaaaaaaaaaaaagcaaagatcaatatcattttccatcctggaacattgcccttaaagtgtgtttttggaaatcaaagtgtattccactagtatatctatcagagaggtatagctattatatagcaatggggaaaacggacatgaactgctgaggcaggattaatttgagtgggaaacatgctcagattcttaaatttaggttttagtcctattacaagaaaaatatatttcttttgaaagatctcaagcacttagcactagtatatcagttttggttaaggacaggacacgtttctctaccttgaaaccacctagaacaatgcaagttagcagcatcattggtctgttgctgaacagttgtgaccctgttaggaagggtttctgatcttccggacttttttccaacactgacacttattcaaatttaattactatcacgtttgccttgtgaaatgtggcatctagtaagcaattgaaactgaagtttataggttattatattaaaaacctagctgatctagtcaatgttcatttttttaaacagttatgagaagattcctatatcggattccattgatgttcataatgatgatttgttccattttggaggttcctattgccttagcaattgtttgacatttagggttagtaaggccatatttttagttttaattttagtgcttttttgtttttgtttttgttttttttgagacaacgtcttgctctgttgcccagactggaatatatagagtagcatgatcatagctcatttcaacctggaacgcctaggctcaggcaatcctcccacctcagcctcctgagtagctgggattataggaatgagccactgcacctagctaattttaaacctttttgtagaaacaaggtctcactatgttgcccagactggtctcgaactctgagcttcaagtgattctcttgccttggcctcccaaggtgctgggattacaggcatgagccaccatgcctggctcatatttttaatagtttaattttaaaagctctatttttgtttgaaataacttgtattttaataacactttagtatttttggagaatgtgagaacttggagagattgctgaaatgcagtgccctcatcctgtagctgagtatgcaagtcacccatattggtgaagtgactgcctccggaaactcagtgaggagctgcgcttctagggctaggagctgactcccagtccagtgctcctgaataagctgcaccaccttattcttccctttacccctttactgtctgccatccctgtaagctcagtgagagtggggaccccgtctgtcctcctctgctgaatcctctgaagagatcataaagccagcacattgtgggtgaaaaactaatatttgccaaaaatgttagcttcccttttcttgccatctgttggtgggttcacagctttcatagtatttctgaaggactgaatgtagatcatgtacagttggcacattctccagtgggaatcctgggggctaaatgacttatttccttgcaggtggaagctgcacccgcccacacgggctgcccgctgcatactcagcattgctcacttttatcttgcattgttatgtacacactgtcagctgctctgcattcctagtggaaaatttacattccactgcctagatatgtttgataaccaaaatcccatttgggaaaataaaacaaaaacaaaaaatggcaatggtgaaatctaagtatggtgtagtaagttaagaaagaatacaaaagaaaagacaaacaatccccaaatacttttattttttttttccccagtgcttgcttagtggcagttcctgtagacttctgagaattctcttgagttaattggttattttttaactttatgggggccatattattctcttaagcatagcattagggaaacccatgggcatttacttgtgaataccttaacaagtattcaagtaacatttattttcttgtaagtgcccattgcaaataattatttttagaataagttagtacacttgaggcttaacattatatattcagaatgcttaggatcatctgtggaaatatttctgtggtgatatattccacagaaaacaataaagagaaaaatcaaaccagaatttcaatagcttaaaaatttgtggtatgaaaactgatttgaagcatcaaaatttcctgagaagacttaggaatataaacatttacttaatatatacttacattgaagagttttccaaagaaggtattacttatgatgggtatcttatcttctgggtcatttttaggttaaaaaagaaatattttactttgctttgttttgaatagcatatcatctgtttgtttgttaatttggtttgagttgttttcctgtctcagtgaatggaggtattcatttagatcacagtacaaaaggcaaaatatgcaaaccgatgctatggtatccattattgggaggaaaatagccatctgaataaggaatgataatccacacttgacagataagccctaacctttcctttggaaatcagcctgtgtactgggtacagcaacatgggggccaataggacccaggtagagatgagtggtttcatcagctcatagaaactaactggacccttctgggaatgttccagacagcttgttcgttataattaaagacatattctctaactagtttctcactggttagtgcaattggaatttaaaaaaaaatattattatataacaatgccggtaaagagattctttccaaaatatttccgtggctggcctgattttgccaccatccctggattatggaatttctagaagttactgggattaacagattttaattttcattccactgaggtgttacgtgtccatgtgaagagaccaccaaacaggctttgtgtgagcaataaagctttttaatcacctgggtgcagtcagactgagtccgaaaaaggagtcagcaaagggagatggggtgaggcagttttacaggatttgggtaggtagtggaaaattgcagttaaggggagttgttctcttgcaggcgggggtgggggtcacaaggtgctcggtggggagctcctgagactcactgtccaggagaaggaatgtcacaaggtcaattggtcagttagggtggggcaggaacaaatcacaatggtggaatgtcatcagttaaggcaggaactggctattttcacttcttttgtggttcttcagttgcatcaggccatctgaatgcatatgtgcaggtcacaggggatatgatggcttagcttgggctcagaggcctgacatcaggttgtacataaattgtactgttagcctcatgtgaagaatatttgatagtagtcaaggggagacagacttgggtgaacgtgagaacgtatgtgctgcaaggcacagtaggaagaactctggtttggaagtcagaagtggattcatgtgactgcttctttgcttactgcatgaccttgagagatggggaggctcatcttttcccatctatacaattagagtaatggtagcctcataaggttattttgaggaacaaatgtgaatataaatgaaaaccttttgtaaattctgatgtgttttacaactgtaaatttattagaaaataactaccttagaatgatattgtgaaaagtcaaagtaacatatggaaagtatttgatgcagttctgggcataatatatgctcaaaaattggtgtcctaattgttgtttaattaaagtatgtactgagcaaattctgtattcaaagcaccaataataggttttttggttatagataaggctgtttactaagaaaacaaataaatatgcagtctacataaatattgatgccattggggaatatgttaactttataaaaagtattgtataaaaagtattgcatgaaaagttcagacaaaatgatttgcattttggaagagagaaattatccagccaagtgaatggtaaatgtggcaataggagaaataaggttacagtgtggtaggatggggtcagctcaaatatgatccaaataatcaagtccagtccaagacacgaggacatcatctgaagccagtggcagcttttataggtgtttgcagagagacatcacatgtttgggtctgtgcttcaggaagatgaattcacacagagttggatgagagaggaaagatgctagaggcaggaatcctggttagaccatgctaggtgcagctcctagaggatttgtgaggacctggccttgggctgtgggggcaggtaagaaggggacagataaaataattttgagtggggagagctctgggatttcatcagtggtaacgatgtgtcctgtggtaacattttcttgcaactgctttgaaaaaaaatgcaggtgatttatgaaaactgaataatgcaaaacaaatttcttatgttttagtgactctgctgacttgatgactgtttaggtatagacagacttttacaaatcttagttttaatgaaaagcattagacatatccagctgggtatacagatttggtgtcaggagaaaaatttggactagagatagggatttggttgtcattggcaaaatgatgttggtcataaacaacatggcatgtgataaatttgaccaagagagtgtttgggttaaaagccgggaaggcagagatggaattcttggggggaaataccaacatttaatgtgagccaaggaggaggagttgttggtataggaaactgagaatggtcacagaaggatggggttcagagacaacatatagctgaactgtgatggagtatccagttatgcagttagtattttcctttgataccatagaagattatatacccaaaatacccgggagctgtactatttcagattaacaatacttatttaattttctggagcttaattttttggagctcgattttcttacatccaaaagagcacaatactagaaaaagatattttagcacatcagatattatatgggatataatgttctctaagacatagccaagtataaaaagtatatttgtttaaaaaacactttaatacaaatctactatgaaaattaatcaagaaaatggatattatgtttctcttgtagttttgcattgaccaaaaacatctgaatttacttgattaatatttatctggtatatctttttccatagttttaacctacccatatcttgtttttgtcttttttttaattattatttttttaatagacagggtctcactatgttgcccaagctggtcctgaactcctgggctcaagcagtcctcccatttcagcctgccaaactgctgggattatgggcatgggccaccatacctggcctactcacgtctttatatttaaagtgtgtctcttataaacagtatatagtgagatcttgttcctttttccagtctgcctgtctctgtcctttagttggaatttttagttcatttgaatttactgaattactggcatgattagaatcgagtttatcatgttatttgtttttttgttccatctaatatttgtttttgttctttcttgtcttttttatgaacagattcatcaaacatttaaacaattatttcattttatctctctattggctttttagctatgcctctttgggattttgttttcagtaggtactctagggctcacaatatacatccttaacttattttagtttgccttcaaataatattatgccagttctgtacaacagtgtaattccatttatctttaatggtacctttgtgttcctattaaatattttagttttatatatgttaccaatctcatgaatcatcattattatttttgttttaaactagtctttaggactaattttttttttttttgagatggagtcttgcactgtcgcccgggctggattgcaatggcgtgatctcgtctcactgcaacctctgcctcctgagttcaagtgattctcctgcctcagcctcccaagtagctgggattacaagtgcccgccaccaagcctagctaattttttgtatttttagtagagatggggtttcaccatgttgccaggctggtcttgaactcctgaccttgtgatccacccaccttgacctccccaagtgctgggattacaggtgtggattaatttttttgagttttaaaaattactcacatatttccattcaatgtccttttatacttctgtgcagatccaggtttgtatcttgtattattttccgtgtttgaagaacttcctttgtgattttttggtagcatgggtctggcaacagtcaattctctcggcttttatctgtctaaaaaaggtctttgtttcaacttcctttttggaggatattttctcagggcactctctgttgtgtctaatttgctaaagcgcatggaatgaattcttcattacagatattctgttttttagttctagaattttcttttgtttctttagagtttcaatttctgggctaaaattcctcttaatttagcatttttccaccttttctactgaattttttaacgtatttataacatttatattaaaatccttatttgctaatttcaatatcatgatcatctctgggtttgaccttatttctcttgataacaggtcgtcatgttttctactttatttacatgttttatagtttgtgttgtgtactagtcattttgtatgaaattttgtataaaacttatagaaatttaaagtaggtgataattatccccaggaaaaagcatgtccccttcttctattgggctgctagggaaaggagctgatcttatagtataatccatagttgagctgggaacaggctgggctgcagttttagttagatttagtttactagtggtttcaaacactttgagggtgaaatcagggcttgctttctgtgcaacaggacttgggagttaatattggtgagatttagaaatctgtctctacaattagtccagctattagctatttccaccactggagattctgtctgttacacagctttccacactatgggattcctttctctgctcttttgccctgctcttggcttttgttacacttccgtgcacttgaagaaggccccatggggaagaattcatgggtggtgtggacttgctctgcatctgggtttccttggtcatgctgactaacacaggctgactgtctatggaggtttattcctctgccttttgtgcccctggggatgaaagcagctgaagatttcttctcccttagaaagggttcatcactctctggaatttagttcatctagacatctttgcatcctaacaaagtgacattggcactttccaatatcagttatggcacatcccctcaaaaatagggcccgttcagtctagtagatctcatcagacatcttagccagtctttctcccatttaaaaaatagtgatactgaaaaaaaaaaagaatgattctttaaaaaatctttttcagaacaatctataatttggatgtatctggtgtattgactccttgataaattgttttctagtctggtgtcttttactagcctttggcccttctcatttatcaaaaagtggtgaaaactgattcattattttgtaaaggattttgttctctttgatgctgtgtgctgtttgctaagtagtaacagtttcctctaaaattaccattttgagaacctacttttccttaaatccatacgataaagaaaatagagttgaagcttttttgtgtaggttggcttatattttgcaagtaagaaatttcactacatatttttctttaaaaatgcctatctcatggacagtcacaaaaatctgatatgtattttttaaagttattgaaaattgagcttttaaattctataatcagttcttccaagaggtttgtggtcattacaattttgtgatagtatcatttaacagcatcctttcctcacctctttagacagagtttgtttttttttggaccaggttttcaagacgtggtgagtgctgagatttgaggcagagggattctcagaagcattcagtttacagccccagggagtgatatttccactttattaattagttcatggagcatccctttgggctagtttagcaggattattcctacttttataggtctagaaattgaagtgtgaagtgttgaattggctcatgtaaaaaggtttaggcaatcagtgtcaaaattcagaattccagagctttagtcagttactcagtttatcaaccttcatcttgttattccaaatatatgtttttaaaggaacaattttgattttattgattttatttttcatagcaaacagattcatccagcttttaacttgaatgttgacccagctgtgatattgacctactgttatggaatttgtgaacttgacttaaattacttatgtaaacttactggattcacatgaagcattttatttttgtatggtcatctgtgacataaaatctaatctaaataagatgtcagagacagggtgatatattggagacagcatgtgatttgtatccaaattctgcactagactcctagctcatcccattccagcagggtaagaatggttaagttacttttgccacctttgactttggaaatatttccaagaaatattttgtctgtctgtctgtctgtctgtctgtctgtctgtctgtctatctatctatctatctatctatctatctatctatctatctatctatctaatctccactcaggggtttgaaatggggttttgccagcctcttcagcctgctccagaatgactcctctctctaattcactcggctaacctacttctcaatattgaaataaatttggtttttcaagacaatgttgagcccagtgcagaatcaaggcaagaggtcagtcatcagtgtgtcctgcttttgcttggtgttgattccttcaccaaatgacaaagtcaaagtacaaagtgaaagtttgaattttgcaatgataacttaccatttgattggtttcgtagtcacagattacacgctggtcagcctgctcaccagtgaactccatccctggctacacggggctctgagtgagaatacctcatactccatctctaggtgtccatctccttgtaactaggagtgttgatacttaatattaccctcatatttcaagtagcatttcttttctttcctttcttttttttttgagacagagttttgctcttgttgcccaggctgaagtgcagtggtgcaatcttggctcactgcaaccactgccttctgggttcaagtgattctcatccctctgcttccaagtagttggaattacaggtgcacaccaccacgcccagataatttttgtatttttagtagagatggggtttcaccatgttggccatggctggtctcaaactcctgacctcaggtgatccacccccccttggcctcccaaagtgctgggattataggtgtaagccactgcacctggcctgaagtggcatttatgtttacagtgcaaggggaagtgtatgggctaataagaaaattgatttaaaaattctaatttatcattatgttccccatcatctaaagccatcatgtccctagagtaccatcaactgaccaaccctttatccccgattagggctctggagaagttcctcttatacccagttgatttggtttaatttttttgtgtgttgtttattacttaaaatgcctgctaaaaatgcattttgtataaaaactggtattgtttttaaaaagtatgaatcattttttataattatctttttgtttcttttacaattcaggtatactactttgagtagtttttcagatttttagtgtatctgaaaacagtaatttagttattttaattatgtaactcaaggaaatataactttaagattagttttcaattcaactggttaatcatgaacatttggggaacacttttgccatgccgaatgaggaaaacaattattatttaaaacagatggtttgattgaattcaagtaataatttacatactcagaatcaaattacataattatttcaacaatcatgtatttttatgaatttcaatatattgtttatagctatctgtgctctaaagcaaaacagcatgttttagacaatgcaacaagatttttaaagttacttattgatataacatattaacttttgcctttaattcaataacccaacaagattttaaaccatcaagaatgggtatggttagagagtcacatattgaagagataacagcagagcatcctctgtatgtgcttagtgcattgctagctaaggcactaaggaggaatgcttaagcccaggaatttgaggttacagtgagctgtgatcgcaccactgtactctagcctgggtgacagagcaacaccctgtctctaaaagggaaaaaaaatgatataaccctcacttgtaagtacccatttgaaacaatctccatgataaattattaaattaaaaaagcaaggtgctgaagaattggtaaagcaggccatcagcgcatttaaaaattgtatgtatgtgctatgtacataagataatatgcatgtgtatgtacagactatctttgaaggaatatttctaactctggttgcagcttggtgattagggcataggagtgggaaggacacttcttttttactgtacaccccctttaaccacttgaattttgttcaggtgcgtgcattacctgctaaacattttattttattttttcttttgagacagagtctcgctttgttgcccaggctggagtgcaatggtgccatctcagatcattgcaacctctgcctcccggtttcaagcaattctcatgcttcagcctcctgagtagctggaactacaggtgcacaccaccacactcagctaagttttgtattttcagtagagatagggtttcaccatgttggccaggctggtctccaactcctgaccttaggagatccacctgcctcagcctcccaaagtgttgggattacaggcgtgagccaacacacccagccctgttaaacattttttaaaaagtcagcgtcacttaatgtgatgctaggtgttagtgtagggctaagaacctgtgtgcttaaaatgaaaaaaagttactatgattaaattttaaaaattgtactctagagtatgacattttaacaaacatttattgtgcaactcgtaggcattgccaagcactgttttaggcacttgagagtcacagaaaaaatattcattcttgtttctctcagagatggcataattctaccaagaatggagtcccataaatgatctagggctactatttgatttttaagataactagcaaagtgcgtagcaaatagtaggggctcatagacataggttcactaaaactctaccacttattatgtgtgattttaggccaattaattaatcaagctccagtttctttagtaaattgggactatagtaatgccacttcaggacactgttttgatgattagaaaatatataatgcatataaattacttagtacggtgcttgccatgaaatatagcacaactgttacctatttttataaattagtgttgtttgtaagttttcctttcaaatcatggggtaaaatcacctaaaactcaaagtgcaagaatcaatactatagtagctgtagcagtttgagacagaaagcgcaagaagaatgagcagggaatgattggtgataactgagctgggccttgaagagcagatggaattccagtaggtggagaaatgaggagggcgttttagccagaggggcaaaggcaaggtgtggatgcaggggatgttttgggaatggaggggagcaggctggttcaactacagtgcgtgacgaggagtctgtgtggaaggagtgttggtaggagatgagggcaccaagtaagcggcacttggccctgggagttcttgcaggccatgcttgaaagtcgggatttatcttccagtattaaaggtggacaccagacggcagaagcctgaagagaggatagggaggaagtcggaataggaataatgaagagagagatggcagctgtacttgagagcggccataaggtcaaggggaaaattaaaggcaccaggtagagatggaggtcttaaatgaatgaacaagcagagacagccggggacaaaatcaagatgtggggttagcttcgtaaaggcatatagttccttctgagacaggcagaaaaggagaaaaatggtgaggatctagatgaggtgagttgtggagggaaggaaagttgaggggcttcgtgtctactggcttctatttcttgacatttggaatgaaatgacctgctgagagtgtgtgtgcctggagtgggattttaagggttaggtgaggggtgaggtgagatgagaggtgaggatttggactatccactgtgggaaatggaaaaaagaactgtgggaggagtggagggctggctgagcaagctatactgaggtccaggtgatggcttgatgctgaaagctggtctcaggtgagggctgctcgtggggccccgtggttctctctaatagcagctgggaccctggaagcaaaaagagaggcaaaggtgatcacatctacccagtggcaagggctgcgggaattgagggtgctggcgtgagtgtacctgattcaatgggggataggggagaaagtgaaacctgggaaaaattgcttgtgtcagtcttaagagaaaagggtggggtcaggcacttggtgggggccaaggatcagaaagcaggtgcatgggaatgggaaaggaaagatgatggaacacagtatgttgggctgcaggcacagcacttcagagctcaagattttataggattattttgttgtttttcagaatgcattgtttaaaaattatcttaatattttcgtaacagaaaatgatttctgtttttttttttttttccacagatcatgagcagtgtgcctagggcttaagggaaattttcctttcttttcttgagagctttgttaagggcttataatattgctaaagggtgagctcagagtttacagaaatgctgagaaaagcaaggttttaacaaaggcacaggaagtctcaggcagttccctagaaactgtagattttcctcataggaaaaaaaaagctaatataagcttagtggtttatattttttttcctttgcttttaaaggtaaaaccagtaatccatagcaggatcaacgtgtcagctcgctttagaaaaccgcttcaggagccgtgcactatcttgtaagttgaaaccctttatacttcaagttaaaattggcttggtggtttccttttggtttggaatttgtgttgtagttttcaaggcataactgtttcagaaggtttgcctcctgttttccagcttgattgcaaatggagacctcataaacccagcttctcgcctccttatccccagaaaaaccttgaatcagtgggatcatgtactacaaatggtcacagaaaaaatcactctgaggagcggggctgttcacaggtatgtcaaaacaatcttgtaagtggaggagtttttgaattgttgaagatattctcaggaggctccggagtcactggtctgtggatttgaattttggctccccagttaggccccgtatgcctcagtttctttatctgtagaatggagatatacctcatagcgttgtttaaaatgaggtaatccacatacagagcttaaaacagtcattggcacatagtagcacatctacaaatattaacgatttttattctttgatttagagtgactaggcaaacataactttagttgagaaggattttttgaaagagccagccccttaacttttttttttttttttttttttttgagatggagccttgctctgtcgcccaggctggtgtgcagtggcacgatctcagctcactgcaagctccgcctcccgggttcacgccattctcctgcctcagcctcccgagtagctgggaccacaggcgcccaccaccacgcccggctaattttttgtatttttagtagagacggggtttctccatgttagccaggatgggctcgatctcctgacctcgtgatccgcccgccttggcctcccaaagtcctgggattacaggcttgagccaccaagcccggcccagcctcttaactcttaattgtccgtttttttttttttaaaggggtcatttatgattatttgatagtttaaactatttgcctagggtaaaaatcagatatcaggaagtattagtgcatttaaagaggaggcatagaaagaataatttagtggggttgtctaaatgtaagaagtcaaaagcatttttttcaggttccaacatttaagtgaagattaacatcatagatttaaattgtgaagcctatgaaattatcccttgatggaggctgacatttattttccgtcagatgggagggttacaaataacatatacatgtgcacaacatattaaaagtatgtatatgtatatactgctttagcagagtacactgtttcaagtgtttgtgttttcatacacacgtgataaaatagttctcaaatgattgcatattacgtctttcaggtaaatgtgtatgcagattaatgtttgtatatttacacatattaatatccacagtctcatagtcattgagattttaaatataattaggtgttttaattgaaaggaatactttacatgtggcaaaaaattcaaatacgatataagtaaagagcatttctcctatcttaggcatgtccagtccttctccctagtacttttcagcatcatcccggaaatattctatgcatgtgcaagcatatacatttttaatttttaatttcatttttttgagacagggtctcgctgtgtcacccaggctggagtgcaatggtgtgatctcagctcactgcagcctcgattgtgcagactcaattgatactcttacctcaacctcccaagtagcatgcaccacaacgtctagcttttgttttttttttcttttttgtagagattagattttgtcatgttgcccaagctggtcttgaactcctggggtcaagcaatccgcccgccttggcctcccaaagtgctgggattacaggtgtgagccactgtacctggaccactttttaaaaacattaaatggaaatgcatacatatgtataaataaataaatacatgtatacaaacacccccttgattttttcctataataaatcttagagattattcttatcagcacagatacctctattttattatttttaatgactacaaagtattttatttatttttatttttatttttttttgagatggagtttcactcttgttgcccagactggagtgcaatggtgggatcttggctcactgcaacctccacctcctgggttcaagtgattctcctgcctcagcctctcaaacagctgggattacaggcgcctgccaccatgcccatctaattaaaaaaaattttttttcgtagaaactgggtttcaccatgttggccaggctagtttcaaactcctgacctcaagcaatccacccgccttggcctcccaaagtgctaggattacaggtgtgagccactgcgactggcccaaagtattctattttaacacaaagtattccaaatcctaattttttcattaagaaatttttagttgggcaacatctcattttataaaatagaatgagtgttcccaacttaattttttagaccagttacctcttttttataatttcatttgtttattttaggttcagggaatacatttgcaggtttgttacatgggtatattgcatgatgctgagatttcgggtacagatgttgtcacccaggaagtgagcatagtacccaataagtagtttttcactctatttccctcccctctctagcagtcaacagtatctactgttcctatttttatgtccatctgtacccaatatttaagctcccacttactagtgagaataagtagtatttggttttctgttcctgcattaatttgcttaggattatggcctccagctgcatccatattgctgcaaaggacaggatttcagtattttcctggctgcgtagtattccatggtgtatatacaccatattttctttatccagcccaccattgatggagcacctagactgattccacatctttgctattgtgaatagcacggcagtgaacgtaccagtgcatgcttctttttggtagaatgatttattttcctttgggtttgatggatatttaggtcatttctaatcttttgctattacatgtacatgtctttttgtataagcaaagtttatcaggatataaaagtctagaagttgaattgttgtattaagtttcaaatgcctttaacattttgatagatactgccaattgccttccaaagagtttattctaatttatattttcaccggaagtctatgaacgggcctgtttgtcatactgttacctgtctagtaaaactaacatttagtcttttcactcatgttgcgtgaaaatagtatttcattgttttgggatttttatttaatatacaacatcatctattgactatttcttatgtgtcaggcattattctcagtgctttatatttttgacttaattaactgagcgaccctatgaggtaggtagtgtttctattctcttttaatagacatgagatgtgagacatagagcaggaaaattatttgcccagggttatggagatactgagtagcagggctgggattcaagcctagtaggcattccggctccagagcctgtgttctaaatgaccaaggtactctgtaagtaaatgccacatatttatatccattgtatctgaactgtctgtcatggcctttgcacgtttatcttattgatttataggcactctccagggttccccaacccccaggccatggactggtaccattccgtggcctgttaggaacccgactgcacagcaggaggtgagtggcaggcgagcatcaccgcctgcactccaccccctgtcagatcagcagcagcattagattctcataggagcatgaagcctattgtgaactgtgcatgcgaggtatctaggttgtgtgttccttatgagaatctaattcctgatgatttgaggtggaacaatgtcatctcataaccatcccgtcccccactccgtctgtggagaaattatcttccgcaaaaccagttcctggtgctaaaaaagttggggaccactgctctagacatattggggaaattggccttttctgatatgttttaagtacacttccagtttgcattttctttacatttcttttttcatacaaatatcttaaattttaatgcagtctaattttcaatctttataatcactacgttttatgacttgtttagatcttccttactccaagattataagaatattctcctatgttttctccttgtattttaaaattttatttaaacctttgattttgttggattttattttggtgtcagaagtaaaggcagatctcaataattacaattttttttacatatataattttgacatttgacatatacatagatgtaaatccaccctataagtaataaaaaggacacaaaggtatatacaggtaatttcacagccagatatacctattcatacatatattaatatgaaaaaatttacacacagaaataaaatatattcaagtaaaaatatagaaatgaaagtatagttatgttgctcaaacacttgaatacttagagaaacttctttttttttaaacttgtattttaggttcacgggtacatgtgcaggttagttgcataggtaaacttgtgtcacggtagtttgttgtacagattattttgtcacccaggtactaagcctagtacccaatagttacttttactgttcctctctctcctcccaccctctaccctcaagtaggccccagtgcctgttgttcttctctttgtgcgcatgtgtcctcatttatctcccccttgtaagtgaggacatgtggtgtgaggttttctgttcctgtgttagtttgtaaaggatgatggcctccagctctttccatgttcctgcaaaggacatgatctgacccttttttatggctgcatagtattccatggtgtatatgtaccactttttctttatccagtctaccattgatggacatttagtttaattccttttctttgctactgtgaatagtgctgcaatgaacatatgtgtgcatgggtctttatggtagaatgatttatattcttttgggtgtatacccagtaatgggattgctgggtcaaacggtagttctgtttttagctctctgaggaattgccacactgctttccacaatgattgaactagtttacactctgccagtagtgtataagcattctcttttctctgcagcttttccagcatctattattttttgactttttaataataaccattttgactggcatgagatggtgtatcattgtgctttttgtttgcatttctctagtgataagtgatattgagctctttttcatatgcttgttggctgcaagtatgtcttcttttgaaaagtgtctgttcatgtcctttgcccactttttaatggggttgttttttttcttgtaagtttaagttccttatagatgctggatattagacctttgtcagatgcatagtttgcaaaaatttctcccattctgtagtttatctgtttactctgttgatagtttcttttgatgtgcagaagctcttaagtttcccaattggtaaatttttgcttttgttttgattgcttttggtgtctttgtcatgaaatctttaccagttcctttgcccaggatggtattgcctaggttgtcttccagggcttttatagttttgcgttttatgtttaagtctttaatccattttgagttgatttttgtgtatggtataaggaaggagttcaatttcagtcatctgtatctggctagccagttatcccagcaccatttattgaatagggactcctttccccattgcttgtttttgttagttttgtcgaagaacagatggaagtaggtgtactgtgttatttctggggtctctatttggttccgttggtctacattgtctgtttttgtcccaataccatgctgttttggttactgaatccatgtaacatagtttgaagttgggtaacaggatggctccagctttgttctttttgcttaggattgtgttggctatttaggttcttttttggttccatttaaattttaaaatagttttttctagttctgtgaagaatgttaatggtagtttgatagcagtaatattgaatctgtaaattgctttgggcagtatatggccattttcatgatactaattcttcctatccatgaccatgggctgttttttcctgtttgtttgtgtcatctctgatttctttaggcagtgttttgtagttctcattgtagagatcttttacccgcctggttagctgtagtcctagatattttattttattttttgtgccaattatgaaaatgtgctcctgatatggtgctcagcttgggtgttgttggagtataggaatgctactgatttttgtacattgattttgtatcctgaaacttttctgaagttatttctcagctgaaggagcttttgggccgagactgtgagattttctagatatagaatcatgtcatctgcaaacagggatagtttggacttcatcttttcctatttggatgccctttaattctttgtcttgcctgatgactgccctaggaagggcttccaatactatgttgaataggagtggcgagagaaggcatctctttcttctgctggttttcaaggggaatgcttccagtttttgcccattccgtgtgatgttagctgtgggtttctcatagatggctcttattattttatgttccttcaatacctagtttattgagagtttttaacttgaagggatgttgaattttatcgaaagccttttctgcatctattgagataatcatatggtttttgttttaagttctgtttatgtggtgaatcacgtttattgatttgcatatgttgaatgaaccttgcatcccagggataaagcctatttgatcatggtggattagctttttgaggtactgctggattcagtttgcaagtattttgttgaggacttttgtattgatgttcatcaaggacaacaaacttggcgtgaagctttcttttttgttgtgtctctgccaggtttgggtatcaggatgatgctggcctcatagaacaagttgaggaggagttcctcctcctcaattttttggaatagtttcactagaaatggtaccacattttgtacatctggtagaattcgactgtgaatctgtctggtccgaggctttttttgatcggtaggctattcattacggattcaattttaagagtttgttattggtttattcagggaataaatttcttcctggttcagtcttgggagggtgtatgtgtccaggaatttatccatccctttcaggttttctagtgtgtgcatagaggtgttcatagtagtttctgatggttatttttatttctgtagggtcagtggtaacatcccatttgtcgttcctaattgtgttcatttggatcttctctcttttctcctttattaattcagccggtggcctatgtatcttattaatttttttttaaaaaccaactcctggatccattgatcttttgaatagtttttcatgtctcgatctccttcagttcacctctgattttggttatttcttgtcttctgctagctctggagttggtttgttcttgctgctttagttcttttagttgtgttattaggttgttcatttgagatctttctaactttttttttggagacagggtctcactctgttgcccaggctaaagtgcagtggcatgatctctgttcattgcagcctcaacctcctgggctcaagcgatcctcccacctcagccaagcagctggaactacaggagtgtgccaccatacccagctaatttttttgtattttttgtagagacggggtttcactatgttgcccaggctggcctcaaactcctgagctcagacaatctgcccggctcagcctcccaagtgctgggattataggcataagacaccatgcccaggcaactttttgatgtgggcatttagtgctataaattttcctcttaacacagccttagctatgtctcagagattctggtatgttgtatttttgttctcagtttcaaagaacttcttgatttctgccttaattttattatttaccccaaagtcactcaggagcaagttttttaatttccatgtaattgcatggttttgagcaatttttaaagtcttggtttctatttttattgtgctgcgatctgagggtgtgtttggtatgattttgattcttttacattttctgaggattgttttatgtttggttttgtggttaattttagggtatgtgccatgtggcaataagaaaaatgtatattctgttttgggatagagagttccatagaggtttatcacatccattttgtccaaggttgagttcaggtcctgaatatctttgctaattttctgcttttatgatctatctaatactgtcagtggagtgttgaagtttcccactattatgtgggagtctaagtctctttgtggatttctaagaacttgctttatgaatctgggtgctcctgtgttgggtgcgtatatatttaggataggtgaaattcttaatgtaatggcagatatgagagatttggttgctgctctcttgggatatgaccgttttcctttaacgttaataaatcttatggttggcccctccctatgcatcagtatattcatatataaaaagcatcccataaaaatttactgaacttgctttttatgtttcttgtgtttgtagcaaaagaagaaagtagagcaacaacagttatataaaagaaggctaaaatcatgaattagaatttattcagtgctgggccaggtgtggtggctcacgtctgttatcccagcaccttgggaggatcacttgagcccaggagttcgagaccaacctgggcaacatagcaaaaccttgtctctattaacaaaaagaatttattcactgcgttttacttacctgcagaggaaacaagtcaaatcttggctgtttccagagtccacagctatgctggtttttaatttctagctatgaaattactactgattgagatataactattttgaagaaaagtagaaaaatagtgcttggatataggccattggctctcaagcaggtatgattttgccccttggggacatttggcagtgcctgaaaccatttttggtagtcccaactggggatggggtggctactgctactgtttagtgggtggaggccaaaggtgctgctaataaacatcttacaatgtacagggcagcctactcacctttccagcaaagaattatctggtccaaaatgtcaataatgccagtattcagaaaccctggtcaagtgttttttgagatagcgtcttactatgttgcccaggctggtcttgaactcctgggctcaagcgatcctcttgccttagccttccaagtagctggaactataggcataggccaccatgtccagcttaagttaaggcaaaaaacatagaattctgggttaagtgttgatatttagacttgttaggagtagaggtacaatgttataaagaaagagactttaccatctgtatactaactaaaaacacaaatacatttcaggaatgttggtggctattggtggctattttcattgtatttcatggttctgtatgatatggccatttatgtcatcaggaaacaagctgacaggtcaatgggtttttttttttgcgtctgtaaatgacatttaatcttattatgtaatataggaagacagaaagctttttgatgatactgaaatccttccatttattaatagctcttgcttataaccttaaaaaatatgcactgtctttctggtttagttttctaatacttattttcctgttctttaaaaaaatttttgtggacatttaaaatcatctggtaaaattatgactgttcttttaataagtaacatattaattgtagctcgtagcagcagttttacagtaaaggaaggttactgtgaaactgctcgattctgggaagatataatgttcactcttgttttgcttagtagggacggcaaaaaaaaagaaagaagcacaaatgctatgcagttctgcatcattaacactggcaatgggttcttttacctcctgccctctcaccccattgttcctgacccggttctctgtgtgtttgtatgtaatattttggttgagggctgttcttacacagaatgtggtcagaagcttgccagcctgatgaatatgctaagaaaataaaatttaaaagtattaacaaggccgggcgcggtggctcatgcctgtaatcccagcactttgggaggccgaggcgggcggatcacgaggtcaggagatcgagaccatcccggctaaaacggtgaaacccggtctctactaaaaatacaaaaaattagccgggcgtagtggcgggcgcctgtagtcccagctacttgggaggctgaggcaggagaatggcatgaacccgggaggcggagcttgcagtgagccgagatcctgccactgcactccagcctgggcgacagagcgagactccgtctcaaaaaaaaaaaaaaaaaaaaaaaagtattaacaaaatataaatagaagaatcaatgttcaatggaaacagagctttatttaaagcactgtgatctgtacaagttaatttttctcctctaaaattttaatatggcagcaatagggatccttatgccagatcatcagactcactggggtgaaaccctgtacagcaagatagtcattgtatctgcattataacattagtatttagtggaatctgataactttgaggcatctataatgcaataatgaggatagtaacaaatgagctaaattaagtacagaatgtttttatttactatgtaattttaatttttttgacatccagaatactttgtaatcttaagcaattctttaaatgttggttaaaattctaattgttggtgttcatattttcgacaggctttatactttagaaggaaaacttgttgagagtggagcagagttggagaatgggcagttttatgtggctgttggcagagataagtttaagaaactgccttacggtgagttactttttgacaagtcaacgatgagaaggccttttgggtaagtcttactccttaccactcctcatgctttagttaccacttgaaatagcattgggtcttttgctgaccaccattatattttatgtaattgataatcttatttattacttagaatggaaagcatatatggtatacattgatctttgtttttattgccatgatgggagactgaaagctattgaacaaaaatataatttctgggaagttatgaaagactacatggtttttttttagcatgcatgaaatttataagtaaatgcaaaaatttattattgtgaagaagatacagggcaatgagcttctctacagcaaacattattagaagtttttgtgtcttaatagttgctagaccaaataacttttcagttggtttggatagaaacatccaagagtgttaaaaaactcataatattttatacttgttttaataataactgtaaaatataaaaacaacataatcccacttatgcaaatagagaggatgggtgtacagttaattcatgtaaaattttaaggattatatttttaattacaatataccgtaaacagtttttctccatgaaatgtcatatatttgtgaaagatgctttatttcagcctaggagatacactgcggagtcactcaagaagagctctgggccgggcgcggtggctcacgcctgtaatcccagcactctgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctcaaaaaaaaaaaaaaaaaaaaaaaaaaaaaaaaaaaaaaaagaagagctctggcccatgctgcaggatctctcggcttgctcatggtgcccagggatccatctctgttgcttttcccagagattctgtggccaccttgccattgcaaaaaaaaattttttttggttgtcgtccgcagaagtagagcagaatatcaccagtgtgtttgcaattaattcacaatttgtgtaacttgatggagaggctggccaagagcttctaaataagtaatagatgaagtggaatttcaggggtggtgtttgaactatgcaagagcacatggttttctagcacctttgaattatttaccagctgacttatcgctaaccaaccttacccatccatgaaatcaaatctttagccatctttgctaagcagccctaggttaacctgctgtgatcaacagtgtgtacctgatggtaataagaaaactgtaactcacgttggcctttctcatacaattaataagaattttttttatatatgtgtccttctatttttggagagattcagttgggtttcaagatgggtcttttcctaataatacagatatcaacaaaacaacttattcttacagcctaaaagaatttttaactttttggtgaggacgacttgtttaaaaactacctgaatgcaaatgccagtgttttacctctgctctcctatcagaggtagacatagaagacatcatagaaacgaaggaaatttgtttttaactcagtctggaaaaatcattattcacatttggaagtgattttttgaaatgcaaataggacactttgggatctggataaaaatgctatacaaatttcaggtgatactaaaagtttacttgtaagcattgattaaaatattatacaggaaaacattacaaatcttttgggatggaatttggaaatgttatgatctttgtgaaattgggaaagtatgtgttaaagtgtatgttatctaccttttgtgaaacacagcagtaaacagttgacttccaggtggggatgataattatcttgcattgtacattatttgtaaacaacattcagatttctaaattgcaatttgtttccacagtcagaaagcttcttcactacctcctattgtaggatccagaaagtctaaagggagtgtaagtatcagatgctttcctcgttgatgttctatatttttatatgatacaaagagactgtcctttgggcttcaattaagttccaagagataaaacttagccgcttcgtggtgtataaccaattatgtgaaacagcactagaactttaatgttacacttatggtcctaaacagagctaacattttttagaatatgtattttaaaattttttccttgtatatacacctgacataatttatattgcacttaaaatcttggcaataatactttaaactgtaagaaccattgtagtaggtcacatcaatgatcatccagtcttggtttctatctttaacgaagactaaaagggaagtttcgctgagaaaaggggtataatcctcattaatattccttgaaaagattgagaattgttctaggtatttagtttgccatctgaatcttttccatttatcatttattcatggtttgttaattcagcaaacatttattaaatacctactctgtgggagtaacgacagcatttagtaggtaatttcctaaccttcttgtgttttcagtctgcgctccctgatggggtgagctccatgtcatgccagagcgttgccttggcagttcttcctggctgaggcttctctttcttcccttttggttgaattgcccgacaagttgtgatcagaactgatttgacatcttccacccacaccctgaattaattaagcaacattcttattttggtattttgtaaagtaaatgatttctaggcaatgatattgtctcctaatgatttagatccctccttttttttggttatatcatgtgaaattcttgaaagaaagacaaataattttgtgtacataagtagtgccgaactcagcataacagatattaagaactcattagctgagactcttatactattatgacaaaaataaaataaaaatcaatagagctcttgccctcaagcaacttacaatctacttgaaataaagaagatagcttaaaaaggcaacaaacaagctaatgctaaacatcaaatatctagagattggtgaccatgagagggagggaaggactgaatgtacaatggcagcagtccacagaggaagttgaatttgagctctgcctttgaaactgtttaaaattcagaaaaaggtagatgaggggagaggaccttcagatccaagggagggtgagatggttggggcagacgtgggcatgcgaagaagcagtcacgctggctgacatttaccgggcccttgtgggctcaacactatgccaagctctttacagtagtgatttatttaacctcaccccacaaggcaggcatctttgtcatctacatttaaaaaggaatgaaaaaaggaagtacacagagtagaagtgacaggttcaaaggctcccattgaaggcagaggttgcagtgagcagagattgccccactgcacttcagcctgggcaacagagtgagaccctgtctcaaaaaaaatgaaacaaaataacataaaatacaatacaatacaaacaaaggcccctactgagcaaatggcaggggaggaggggaggaattgcatccacacagccagctcagagctcctgctcccgagccccgggacaatgagtcccttaggctgactggaacagatggtcctttttggtgtgggggctgatgtgcctgacatggtaggtggtgacagttattacatgaccttgaatagcagaatgaagagtctagtgtttgtccttgaatagagggcagcccacaagggcttctgagaggtgagaatattaatctgagtccattttgggagcatcagatcttttacatggaggaagacttcacgtggtgagaagccatagataagtcgatggttgtaaggcagttgcaactatcttggtatgaggggaaaggagcctagactggggaggtggtagaggcagcaggaagtgatgattattctggaagaaaccaaggaacaaaggatttgtgtgatgattggatacaaggggttaatggagaaattggggccaaagataactgaggtttttaagcttggaatttgagaaaatggtagttctatggccaagaagaaggcagccagggcaaagaatgacctacgtaatttcaaacgtgttgagttggaagtatcatcaggaaacttagttgaaagtgtgctgcaagcagttgtaaatggcagagctgaggcctgccaaggacatcaggactgaagctgcagttgcaggtggttttttttttttttttgagacagggtctcactctgtcacccagggtggtgtacagtggcatgatcatggtttactgtagccttgacctcccaggctcaagcgatcctctcacctcagtctcctgagtagctgggactccaggcatgtgccaccatgcctggctaatttttgtgttttttgtggagacagagtttcaccttgttgcccaggctgttctcaaagtcctgggctccagcgatcggcctgccttggcctcgcaaagtgttaggattacatgtgtgagccaccgcacctggcctgagttgtagatttgaacaaccatgtaatggtcctagttgaacagcagacgtagcatcactgtggtacttcatcacccagcacagcttgaacagagcaggtctcactggtgctgccaagtgagagaatggatgaggggctcctagaggaagatggtgcggtgagaattacagagggcccaggcttgaggcaacctaacttcacaggtgcggggtcaaagaggagtgagaagaatatttcaggaggtgaaaacaatatcagagcaactataaagctaaataaaactcatgaatttagggattggaaattgtattttgctttttttgtttttctttaggactttgtagcagaatcccttctgtgtactgtatagatattagcttattaattctcacagtgcagctagaggaatgattacagagaccgattgtaattgaataaattgatcaataaattgatcccaagtcacagggaaagtcgatgtcaggaccaaagtcatgacccaactctttgtattcacagtgactgaactttggaatgatatgtttagtattctgaaatttgaaaaactaaaattttaattaaaaatgtgtagagcatttcctgctttaaaatgcatgtgtaggtacacacatgcaatttttatttcttgctcatttgtaagttttttagactgtgctgtgaatactgtgatacatcaatgtcatcacatcaattcatctgatgattgaattttccaggtgtatggcacagtagtaagccccagggatacagcaatgagcgcaaagatctgatgctctctctgatactcgtggtctacttgagtagacaaaagtgaaacaagcgattccattaatcaatggatacttatgaagtataaaaatgaaagaaaagtgcacagtaatatgaaagacaataaaagaaaaacacatttagataggtgtgtcaggggaggcctcatggaggaaatgacgttaagcaaagactcagttataaggtatatttgcatcccatagaaagcaaagttgtcaaacgtagttccatgctatgacttagaaaaataaaatgatagcagagtttgtccctctttccacagtgttcccgtagcaccctgtattcatccactccatccgtcatccattccaaacatactcactgagctcctactaagtgccaggaactgtaggcactgagcgtatagtggtagatagatgaggacttagatttatggtgctttcattctagtgtgtgtgtgtgcatgtatgtgtgtgtgggggggagggtatggatgggatgaatgggagtagacagacgatcaactagtaaacaaatgtacaaatagtttcaaatggtgataaatgctatggggaaaataaaatgtagcagggcattgatttatataaaattgtctgaaactgagaccttaatgatatctaacacagccaattgtgccagggatgaggccggggaagaagagcatccaaggcagaggaaacaaagtcacacaggcccttgctaaagagcctggcatgtgaggagggcagaaagaaggccgtgaatgaaatcggagaggcaggcagggctcaatcatataggcatgcaaagagtttggattttatttcttgatggggtgccatttgagggttatagggagggagtgatataatttgcttcaaaaaaaatttttttttttttttttttgagacagagtctcactctgttgcccaggctggagtgcagtggcatgatctcggctcactgcaacctctgccccacgggttcaagcaattccctgcctcagcctcccgagtagctgggattacaggcgcccgccaccatgcctggctaatttttgtatttttttttttagtagagacggggtttcaccatcttggcaaggctggtcttgaactcctgacctcatgatccacctgcctcggcctctcaaagtgttgggatgagaggcgtgagccaccacgcctggcctgctttacatttttaagtgctcattctggctgtggtatctctagagaaatggtttggggcaagaatagaagcaggaggcagtgggacacgtacaggtatgtgatataggtgagtccgctaggtggccgcagtgggggcggacatctattataactcttctttgagtatattgtcattgactgattcgctgatccaacaactatttattgagttcatatgatgtcctgggactgttctggtgcttcagggcccagagattctgaagtactaaatgcacggaggttacattccagaaacaaatgcacaatacgtgtgatatacaccagggataaacatgaataaaaatacatgaagacatgggaagaggaagtgagagagggtgctatttcagctgggtggttggaaaggcctctttcaggaggtcacgtttgagtagaggagaataacccctggcacagtgcccagtgcctggtaggttctcacaaactcggcttaggcagtgtgtgaatgtttggcattgagccacacagaacttcctatgccagtaaatccaaagtcacaagctcgatttttaacaggattaatttactcctttcctttaatgaattggttcccaggagaatgcatgcattttatagatcattagctgcctggcactgcgaggaggggtgtgagtgaaggggactgtgtggggagagcttagcttctggctgtaggaaccactgcaaaatccatggggaaagcaccctaaattcatgatgcaaatcaaaggggacacagaactagagttttagaaatttatttttccctacatggctttctaggaattgctcttttgcatatagaagggagtgtggatgagggactggtagagcttgagagagaaagagagaaagcagctgccatagtgtacacagggacccctgctggtgcgtaactgagttggtcagggagcctggggaatgccttgtgcaaagcaagacagaccagaagtcattccttttatagcctcagtgctgcgggagtcacagaaattagcatgttgagaaaaattttaagttgtgattctagccttaaaaacaaaaggaagatgtaaataaattatcttaaattcgctgagcttgaagaataaacccatctgcagaaggctgttttctagtgacaaggtgacaccatgtagaatcatagcaccctctatcggaaaagacgaaaaaattaggaaagtatttgaaagtgaaagccaacgactaaatgatcttttgttgtccttattaccatttggcttatacatcttatggtcagtagtttacaggatcaaatattatgatttctacggttttgacaaaaaaatttcgttattattcaagtatcacaatgtcactgtgaagcaagttatacacatattaagatgaattccttatactccaaaactccattttgccatgggggaaactgaggctggtataggtaaaagggcttcttactcttgtcatcaccagatatgcagatgagagaaatgtcaggtgcagtccccgtctagtccctaccccccacccccagcttataatgtctctgggtgcacccatgaaatacatcgtgaaggctgctcactgaggcaaacctctcacgaaattattttaaatttgatgttttttggtctatatgtttttggcacattttcatggggactggaaatgagtttttatgctaatgaaaaaaacctgagttggttggatctagttggaaagagcctagggaactgtttaagaagtatcccaatcttggccaggtgtggtggctcacgcctgtaatcccagcactttgggatgccaagtggggaggatcatttgaggtcaggagtttgagagcagcctggccaacatggtgaaaccccttctctactaaaaatacaaaaattagccaggtgtggtggcgggtgcctgtaatcccagctaatcaggaggctgaggcaagagaatcacttgaacctgggaggcggaggttgcagtgagccaagatagcaccactgcactctagcctgggcagtagggtgagagtctcaaaaaaaaacaaaacaaaaaatatcccaatcttggtagagtgagggatgattggaggctgttttaggctttttgtttgtttgagccagaggtttggtattccttttggatatactgatatgcatgtgagacaaagggcaggacagtggttggagtatctcaaggggtctagtttttgcataggacaccctgtcaaattaggctgcttcttgatttcttccactttgagataaagccataatttgttacttctgggatggctgttttagggaaccatactatgtaataggagtttttagtgctttggacattagaaagtttcagtgtagtagaaaaatcagacccttagaaagttaatttatttatctataaaatggtgataataatacttatctataaatttgttaagtatttgtgttaatgtatatgtagcatgtaagggacacccagtgatatcgttttatttctgggatagctgtatgagatagcaaaactcccctatctcttatgctctgccaatagcaatgactatctatgtatttgagttacaagtcacatgtggaagccttacagaaagaaaaagctccctctctccctttgtcctttcccctctctaactatgtataatttatgtaattgtgtaaaacaaatatatgaattatatgtgtatataatttatatatatagtgtattatgtattttcacatgaacactttagatgaatcaacttttttctcttctcccccttcaccctcctttttttttttttttttttttcttaaaagcatttagctgggtgcagtgacacatgcttgtaatcccagctattgaggaggctgaggtaggaggattgcttgagtccaggaatttgaggccagcctggggaacatagcaagagcctatctttaaaaaaaaaaaaaagcatttcaattattttaaattttctaattacaaaacaattctttcctgtcttagtttagtttactttttactcacaaagttcctggaaagtagttattactcaataattgaatgcatgagtgtcaactgcaaaatctatgcattatgtagtgatttgaatcaattagtctttcttgatactccaaaattaccctttttcgagtgtctttatcagaaatttgataaatcggaactttcctgtctattcataaacaagagtggtgacttagaaagacacgcactccagagtggggcttctgcgtctcccttgtcgtgcccctttgtgagtaatgctttccccagagaactgcagaaaatgatcctgctgagctacagggtttcccattcattgggttccattccagtccttgcaagttcaacagcatctcagaacattctagtaagcttgctaacggcgtgtgaaaggttgatcttctcatctaaagcttttaaatttttaaaatcgaccatgtgcagtggctcacacatgtaaatcccagcactttgggaggctgaggtgggtggatcacctgaggtcaggagttcaagatcagcctggtcaacatggtgaaaccctgtctctactaaaaattcaaaaaaatttacctgggtgtggtggtgtgcacctataatcccagctacttgggaggctgaggtaggagaatctcttgaacctaggtggcggaggttgcagtgagccgagattgcaccactttactccagcctggatgacagagtgagattccatctaaaaaaaaataaataaaattttaaaatcttgggatgaaagactccattgagaataaaagggactatgagacttggctgatgcttttggaacttctgctataatcgtatatttcttctgccagacagtttatggcagagcttaagtttctcaagaaagaatcctcaaagaaaagaaaaaaaaaaaaaacccctggttgcagtgaccataataattaaatggaaactgtatgtttaaattgcagttggaataggaaattaaattacacaaaaagtgttatagatttggacaagttttcatactgttaataaacctatgcataattcatttacttgtaggctatgacaaaatagcataaataacttcatttgtaaggctgtgaatttttccattcctaattggatgatggctaaatccatttaaatgcttctggatgactgaatatataaatgcttaaaatgaacagttataatagttttctaggcagatttgtttatttaatattactacatttactttcagacacaagcatagtacagatgttgcataaagattacactcaatacggtgtgagtttgatatgatttttaagaaaaatattaactctctgctcttgaagacagcattctgatacttattaaacaaacaccatacatcacgcactgtactagtcactccataagccttatcattgcatcctcatgctagacctaaaggcaagtacattaactccactcaaatgatgaggaaactgaggcttagagaaattaagagttagttaaggcatggtccctgtgttcagtggcagagcagtagctctcagccatgtatctggggtttctaaaacttggattctttccactacctgcagcctctcaccacatactctcaggtaagtttagcacctgagcatctgagagccaaggctgccttagtaagggagtttcttgttctttttctcttttttctttttgttagagatggggtctcactttgttgcccaggctggagtacagtggtgtgatcacagcacactgcaatctcaaactcatgggttcaagtgatcctcctgtgtcagcctcttgagtagctggggctacaggcatgtaccagcacgccaggctgatttttttaattgttaattttagagatggagggtcctgctatgttgcttagtctggcctcaaactcctgacctccagtgatcctcccacctttgccccctaggtagctgggactatgcttaggctggcctcaaactcctgacctcaaatgatcctcccacctctgcctcctaggtagctgggactacaggctggagctaccatgcctggcaagagggagtttcttgctgtagcagtggctcagtatcagcacagctgttccttgcagtagcccccaatgtagtggctgctatgtggctccccaggagctgtactgggccagtgataaaagccaccgaaactcaacctcccttttgtgtggaggagcccacttttggcagccacagggtcttcattgtgagagacacatggggaccagagataaccatggaaggtgtgatcacccaggctgccttgtgggagtaggggcaagcatctgcgcagctccctcaggaacaagtggggacatgtggtcgtgagcctcttgagtctgtgtgtggctctggatttgcgattcttagagaccatggtggtcaccaacagactcgttaatattggagaatttctacaagcagagtgtatggctgcttgtaggatgacatctatacacccatagcgacaacttgttacgaaggtatttgtagattaattgatcactgtaggggaagtcaccatttctcatccaatagacactggctggttctgcagaaaggtgcaggagtgagaggattgttaaggcagtggatttacagtagttttggaggcagctgctctgcccctgactggctacaggatcttacacaagatttatcctctaaaccccacttgctgatctctacagtgacgtggtaacagtagtgtctatctcactagcatgaggctagtgagctagtaactagggctagcatgaggattgagtgaatacaattttatagaatacctggtacatattaagaacccaatgattgttagctattatttttatcctccttcctctcctagacccttttgcctccaggaagatacatttggagttaatgtataaagatagacagttgcagaaccaggacaatacacctccctgcccctgccctgcttaccagtagttaatgacatgtatttactgggaatgtttttgagagttcattagctaataataagggtctaatactttgccatttagggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtggtaagtgtgttattattatcttaaggctgtgatacaattttaattcttaaatagatccattgtttctctgggcccacagaagatattccttattttcatatatgagagttttcaaagaaaattgtatttgtatatgagagatgctgctgtttttatgcttggtttttatttgtaattagatgttgtgccatgaggacacttattttgagatcaaatatattttgtggtagtcttattttaaaagtatgtttttttcatcctctgctcccactgatactgcttgattaatatttttacctacaactactatgatattggtctcttatttgtgtgtctgtaacccttgcccacattcattatgatttattagtcaaagatcatctttactgaaaagtcattttgttaattatactgataaccaagagaacactaaatagacataacattttatcagtaaacaataacctattcagcaaaattagatgtagtttcatcttgcactagcaggtgagagatggtataaaataaaaataaaaaattgcattagtccaagatttcactggtatgagataaaagtgtggtagactaaggaagtatgtaatgaaaattgttaactttgatgttagggttttgtaagaggggcgacttttggttttattcccagtgtgttctcagagtggagtgacgctggggtgggaatggctggctgggaagcagaccagtggaatgactcctgctcctcttgccctgagatcccctcacacaccccaccccaccccacccatgggactgtgaggggttccaggaagaggactgatgggatcaggtttcagattaatgggcaaagccttaccttccacctgggagctccagcttatttcaaagtcgatatgaagagttacattagaattagagctaatatgagcttcacagctgaggagacagtttgaactcctgtgagagtttagaggaagctgcacaaatgattaaagagtcagaacaaagacacgtgaggctaggttaaaagaacaggcgaaatgggtgaaccagttgcacagagaagtggaggggtctaaatcatcaaagacctaaatgatcgagactagctggaagtcaggagtcctagattctcgtcccagctctgccattgaccttgggcagctcatttaactttttttttttctttagctctattatctatctgaaaaatgtgggttcttatgaagatttctttttaaagttttgattatcttgaaatttgtacagtcctttcccgtgagtagcaaacaaggaggctagggtgaaatacagtcaacaaatatttaccgagtgcctattgtgtgacaagaatcaaagaaaagaaattagccctaagaacataccctaccttgaacactaaaaataagagaggctttaaaaaattaatagatactagattgtgaggcccccaaagccttgggctatgtcctactagttttttcttatttccaacaactggcacaggtctgaggcacttaataattatgttgagtgaatgaatgatggaagtttaaaaatagttaattctgtaatactttaatacccatcatgaaacaggatccaccttaaacttttcatttttttttttttttgttaaaagccttttataagatgttatttgcttcttttctgtgaggttcttgttagcctatgaaaatcccaatccttacttccagtatattttaaaaaagtctttaaattaagtagttgtcacctggaagaaagagaatgatcatcttttcaggttatctcatttgtaaaaacttgagaacacaagaggctgtattaacatatcccttgttcataggaaagtaaccttcattaaaaagttgaattattggctggtacagtggctcacgcttgtgatcccagcactttgagaggccaaggtgggtagtcggattgcttgagtttgagaccagcctgggcaacatagccaaaacccgtttctacaaaacaaataaaaaaaattagtggggcatagtggcatgcacctgtagtcctagctacttgagaggctaaggtgggaggaacacttgagcccaggcggctgaggctgcagtgagccatgatcgtgtcactgcactccagcctgggtgacagaattagaccctgcctaaaaaaaaaaaaaaaaaaaaaaaaaattgaattattggcatttttgcttttgtagaaattcacagtagtttttaacaacatttgtgttggtgggcatgaagataaaaaaaagtgtttattattgaagcaaatagtattttgaaaagaaaaggtataagccttcctgttcttttatttttttctttagagaattttgcagttgttttagacagtagcccattttaagtctatattttccaatgtggttttataatgtgcagattataggttttaaattgctggatctcattgttacaggaaacgctgctggtgtcttttaaaggaaggttttagggaatgaatttttttttccttcactaactggcttgtaccactgatctagaagcattttgtatcttttcatttggatagaaagaacatataacctggaaaatgaatcttggcttccaaagacaatttttttccaggaaaaatgaaaaaggattttgtgcagttcactagattaaaccatcacttgataactttaagcatattagcttaagtccatactactgaaaattgagcaatttggttcttaatgggatctccctgcagatgtctttgactacagaaattttccagattataatatcaaaagtccctctccatttctctctttaattcagccttcatattcatttattattgaagttgctttttactttaatgtcatatattttagtaattagaaccaagtatgtgcttttgaatactcatgtttcaagagggctcttattcctcataaaggtaaaagcaataagaatttgaagcaaaatgaaagtgaagggtgtaagaactcataataatgtaaaaaaatgcaaaaatttggttttagagataaaatttacatggctttttctacttacaatgtattttaaatttgatattaaataagctatttagttttatttcaaagtgataaattttagggttagggtgaatagctatgattattttctagcatatgttaacttgtgcaaatgtttgatctagtgttctttacctatatagtattttcatttgaattagaaaaaaagagacttcataggttatcttgattttttaataattaaaattgtagtcacatattttttcgttattttttaaaaatatctgatatttactgattcagttaccaaatgctgtatgaatgtgcaatgcttctatcagtctgtagatggcaacctgggtctaattttgttccttttttcttttcttttcttctttttttttttttttttttttgactctgtttctccctgtaatagtaaagcttaataattcaagcagagcagtgacatatttcttcagggaaacaaatctcattttcttttggtagccaagatgcaaagtaggattggttggtgattgatgaagttgggtgtgaaatgcatttttagtgttgcatttaaataccagcttaactggccagcacatgtttttgttacactttccacttgagttgcagtgccttgagatatgctttagaggctggcaactagctatattctccactatgaccaaaacagtaacgatgattgttttgaaatagcattttggatgattgatcatatcaattggtattgttaatatttggtacatgaaaaaatgtagtgcttttagaacccttgtgaacgcaagaagtatagtgaatttaggtctctgtaggaatactgaaagggctgcagagaaaatggcctggtctctttgacttacattgtattgataattgtaagtacgttttcaaggcaaagcattaaaaaggcaaaaataagagttgtattcttttgatggatgtggctctctttcactttgggtgagtgggcacgcctgtgtgcccacacatgggccagtattcttcttgatgcaaatcctggtttattcccagtgtggttctgtgatagtttccatgaaacttgtgatttttagactcctgatgactgattgggagcaggtgtggttccggcagaaggatgtctgaatattatgaccttgttgggtgactgcccttgagcagtcatgctcttgaatttcttaatagctacaacctgcacatggtttgcctgcatcgccccaagcatgaagcgttactgcaattcatcctcagagttatgaggcattgaaacttgagcttctttggttcagccatgaatcaacccaggcacttgcatggttcccagtaacaagagactctgaagacaaaaccggaagcacatgaggaaaatgtgctctctcacgtgttacctcctaagggatatcaaatctgggaagcaaatatgtaagaaggtaccaaggtgacatcaccaagtggcacactagtgttgtttaataagctaaggtaagatttatgattcattggtgtctcttgccaccacattcaccctataccagaaatacaggttttctttttttcttaatttgtgtaaatttaagggatacaagtgcaattttgttacatggatgtattgtgtcatggtgaagtccaggcttttagtgtaaccataacttgaataatgtaaattgtccccatgatgtaatttctcatacctcttcctgctcccacccttccgcctttccgagtctccagtgtctgtcattctaccctctctcatgtgtacgcattatttagctctcactaatatgtaagaacttgtgccatttgactttacatttctgagttatttgttaggataatggcctccagtcccatccacattgctgcaaaagacatgatttcatttttatgactgaatagtattttactgtgtgtgtttatatctatatgtatgtgtatatctacatctatgtacacatacccacaaagtgtgtgtgtgtgtgtgtgtgtgtatgtctttatacacacattttctttttccagttatccattgatggacacttaggttgattccatatctttgctgttgtgaatagtgctgtgataaaaatacaagtgcaggtgtctttttggtataatgatttgttttcttttgatatccagtaatgaaattgttggatagaatgaaaattctattttcagtctttgaggaatctgcatgctgttttccatggagactgtactaatgtacattcccacccacagtgtattggtattgccctttctctgcatccttgctaacatctgttgttttttgactttttcagaacagccattctgactggtgtaagctgatatctcactgtggttttaatttgcatttctgtgatgattagtgacattgagcattttttcaaatgcttgttggccatttttatgtcttcttttgaaaaatgtctattgatgtcctttgcccactttttaatggggctgtcattattttttgttgttgaattctttgagttccttgtaaattctggaatcaatgacagggaaatacaggttttctatcccttggtggatcacaacttcccatctcaatggcaatgtgtactgtgggatatatgggtcagattttatacatcaagtactagtatgataaaaattcttaagatcagcattttttcacaccttcatgatccacttattggaatgatatattgtgccacaaatttctagtacagcgagaggtcttagtaattttcttgaggtttattgtgaatttaaactctattaataaaagttagtttcaaaatgtgtactttgctatctactttagtactgagagactgaaaaattaaaagttggctgaatactagtaagacgtatggctcaatttgagtggagtaaaatactagccctttttcgaaaaggattctttttatatcctgccctcttaaacactttgttcactatatagagagaagccatgagggaagcattctttcacagctgatatagggttgagacttctgcagtaaattcttttgggggttattttttcatgtagcccagggttgagtttgaagacgctttttgttttcaaaaggaaaaatttgtgaggtgttgaattacagaggtattttcaaaactttggaagatttcattccggaaattcattttaaataggtattttgatactcagatcacattttccatacaagcgccccataaaattctatgtaagccataattcatcttaattattgcattgtgctgccgatgctgtgtaggttgcccactgtgtacaatggtgtttccagtgggaaaacaaatgaggagctccactttagaatgccaagaactcatgttaccctgctgtcgtaggatgcagaactgccctctgttgaattactggtgtaggccagagcctccaggtcagggatccatctgggtttgggtctgagaggaatgcagagctggaggagccagacctggagttactcgggtggggacactgaggtgtgggcggaggttcttctattagcgtgatcctctgcaggaggattagtttgggattgtcacatctttatttcttccccagctccagagtttggcttgcctgcctcccttttcatagatgctacccattacttctaagcagggcctctttgcttcttgccttaccaggggctctgacaagtttcacagccttttcttaattctgctgcctgcaaggtcaggttgaacctttctctttttttcttttttttctttctttctctctctctctctcttttttttttttttttttgagggagtgtctcactctgtcacccaggctggagtacagtggcaccatcttggctcactgcagccttgacctcctgggctcaagtgatcctcccacgtagctgggactacaggcaggtgccaccacacaaggctaatttttgtatttttatagagacggggtttcaccatgttgcccaggctggtctcaaactcctaagctcaagtgatctgcctgccttggcctcccaatgtgctgggattacaggtgtaagccactgtgccctgccaggtctgaacctttctgtagcttactacagataaaatatgcatccgccccagtggtgagtttctggcataccaaagactgaagcatgatttatctgcttttctgaaagaagctgaaattgggtcactctgagcatttcatcctggaatctgaggaagggccacatgggggcttggttagggaggtgtctgatgtcatgaatgttggtgagatgcctatcatagagggtgacagggtggagggaggaggaagatgtagccatagggtttattaccctttctccctcttcaactccctgttttccttgtcaggcctggggtgatataaaacctggaaagggcccggtcatttagaatatcagcagatcctggaccataggtcacatgtaaaggacacagataaatgttcagagcattccgcacagagtagtcagcacagggtcagtatttgttgatatatatgtgtgtgtgtgcatgtaggtcaattatacctatattatggtgacaattgaaattaaaggctgcaaactgtaagcattgagtaatggcacactcctgatacccatgctttagaacatcttgatggtgcattctaatctgatattttgtaagcttcatttacaaatacttagaatggataaacagcattttcctagcttagtgaatgagggggaaaagaggagaaaccagtttgcccagagtcaaagatctatcaatggttagtgatttctggaaattgccagactgacacatagctgctggttaagaggtggatgtgcctgtgtgactgtttgaaaggggaggtggagggacaagtgagggaagctctcgtgtgtgtgttttgacctgtcttccttcagtgataaaaatgttgatgtatcacagcagaccctgaagcttagctgggagattttggggagttcctgtttgtttcttcttctactctccactatttcatattaactttttaaatggggatgattgattttcatcccttctattttctaggtggtcggagttagtcattactaacaagccgtttttctctttagcagtctgatgtaataatgggtcttctctattttgacacatcttagctggggactgccttcagcatttagaccctcttttctagggtttagggaccttgaagaaggtagatattttgggggctgacctctagtttctgtatcaaatgatcaaatccccttttttaaaacagttacttaaacattctaggacttaagctctgcaacccaagcctttctctgtgtctgaatttccttccccatgtttcatgactttctagacttaggaaccccatcccctttcctaggtcactactttcatttttcagtgaacatttattgagtccctaccatgtactccaccccttgctaatcaccagagtatttcattttctcttctttgttctaattgctcagtacttacacattttcttccaatagtcataattatatctttatcaataaattttccttggttaagtagatgcaatttaccttttccctttcaatgaccagactttattcactatccctaaatgccaaattatgttgcaagcattgacattttttccttctgggtattgagtcatttcttagacctctgtattaattttgtccttatagaaagtaccagcacactactaaagaacataggccatttctacttaaatgtatttagtccaatgtctgggacaattactaaatactgcttggcactatgagacagggaaggagtatttcctcacttatgtgataccctgggactcctttgtagtctgtggcctattttgtatatgaactctatttttattcttctctattgccctagttattttcaaaataagatataacctttattgcaaatcaccatgcagtgtgctatcacagtggagataaagataaaatatctgtaaaatacctttgagctttgtaggtttaaagctacccatttattcttattttatacaattggatgataataccaaattgtttctttgaaactgggcaagattttatttcctttaaaattacataataaagtggcctggcacagtggctcatgcctgtaatcccagcactttgggaggccgagatgggtggatcacctgaggtcgggggttcaagaccagcctggccagcatggtgaaaccctgtctctactaaaaatacaaaaattagccgggcatagtgtcgcatgcctgtagtctcagctacttgggaggctaaggcatgagaattgcttgaacccaggaggcaggggttgcagtgagctgagattgcaccactgtattccaacctgggcgacaagagcttttggatggtgttaagctgaaggctcttacccagggcgtttactgtcatttcctaagttgggttccattgagcagtagtttcacgcactttttgtatgtttgtttgtttcttttgagacagagtctgactctgtcacccaggctgtagtgcaatggcctgatctcagcttactgcaacctctgcctcccaggttcaagcaattatcgtgccttagcttcctgagtagctgggattacaggcatgcgccaccacatccagctaatttttgtatttttagtagagatgggacttcgccatgttggctaggctggtctcgaacttctgatctcagctgatccatctgcctcagcctcccaaagtgccggaattacaggcgtgagtcaccgcgcctggccaatttcatgtacttttaatatatgcttctggtaatgagtttcatgttcaactacaaatttgggaaatgttggatgatacaaagttaagtcattgtctctgctacaggatttctcagagcctttagtatggacgtattccacgcttttacttgctttggatccctattactgaggagcatctggtgggattattgttctttagagcacaacttgagaagcgttggggtactcaaataggcatactgcttccacacattacctgatcattgtagggcttggggaatttctgatgaaaattaagtcagacatctttttgtgtgattctgatcagatcagtagctagcatggacagtggacattttctgggtgcttactctgtgccagggactagactgagcactttaagtgtacagtgcaagggttcccttgtggagtcctcagacctttggttccagcctgcaaaggttgttctcttggcttgtggcacagatgttatcttgcattttcccttactgtcattatgaaaattgcttttgtgtcttttctgtggagatcccatttccaggggcttttgtatacttatttcttggttgactccattttggcaggacatatcctccagtaatttctggagaatggctagagaaatggtcattattttttgagacccagcaagtctgaaaatattttcatacttttacatttaactttcagtttggatggacatagaatttttgttttgttttatttttaattttcatgggcacatagtaggtatatatatttatgggatacatgagatatttcgatacaggcatataattcataataatcacgttagagtaaatggggtatctatgacctcaagcatttatcatttctttttgttacaaacactccaattatacccttttagttatttaataatgtacaataaattattgtttactataatcacccctgttgacaaacaaaagctcttattcattgtatctaactatatttttgtacccattaaccatctccactcctcaccctcactacccttcccagcctctggtcaccaccattctactctgtatcttcgtgagtttaattgttttactttttagcttccacaaatgaatgagaacatgcaaagtttgtctttgtgcctggattatttcacttaacataatgacctccagttccatccatgttgatggaaatgacagtatctcattctttttttatgggttgataatactctgggtgtgtctataccacgttttctttattcattcatctgttgatgagcacgtagctttctcccaaatcatgtctactgtgaatagtgctgcaataaacatggagtgcagatatctctttgatatactgatttcctttcttttgggtatatccctagcagtgggattactggatcatatggtagttctatttttagttttttgaggaacctccatactgttctgctatgctaatttacattcccatcaacagtatacaagtattcccttttctctgcatctttgccagcatcccttattgtctgtcttccgaataaaataactgggttgagatgatgtctcaattgtagtgttcatttgcttttctctaatgatcaataatgttgagcatctttttatatacttttttgctatttctgtgtcatcttttgagagatgtctattcagatgttttgcccatttttaaattagagtattagattttttccctattgagttgttttagctccttatatattctgattattaattccttgtcagatgggtagtttgcaaatattttcttctattctgtgggttgtctcttcactttgtttcctttgctgtgtagaagctttttaactttatgtgatcccataatcttgtgcttatggggtattactcaagaaatctttgcccagaccaatgtcctgggagtttccccaatgttttcttgtagtggcttcatagtttgaggttttaaatttaaatctttaatccattttgattttatttttgtatatggtgagatatcggggtccaatttcattcttttgcatatggatatccagttttcccagcaccatttattgaagagactgtcctttccccagtgtatgttcttgtcacctttgtcaaaaatgaatttattgtaggtgtatggatttatttctgggttctctgttctgttgcattggtctttttttattagtctggctaaaaatttgtcaattttatttttttttccactatttatttcattgatcttttgtattttttgtttcaatttcatttatttctgctctgttgttatttcttttaattttggattgggtttgctcttgcttttctagttaagatacatcattatggtatatgaatttttttttttttacttttttgatgtaggcacttacatctatcaactttcctcttagtactgccttcgctatatcccatacattttatgtcatgtttccattttcatttgtttgcagaaattccttaattttcttcttgatttacccattgacccattggtcatttaggagcatattatttagtttccatgtacttgtacagtttccagagttcttgttactgatttctagttttatttcattgtgacagagaagatacttgatatgttttcaattttttttgagtttttttaaaacttgttttgtgatctaacatatgatctatccttgagaatgatccatgtggtgagaagaacgtgtgttctgcagctgttggataaagctgtatatgtctattaggtccatttagtctgttgtgcataataagtccagtgtttctttgttaattttctgtctggatgatatgtccaataatgaaagtgggggtgttgaagtcttcagctattactgtattggggtctattgctctctttaataatatttgctttttatatctgggtgcttcagtattggatgagtatgtattttcaattcttacatcctcttgctgaattaacccctttatcattatataatgaccttctctgtctccctttatagttttctttttttcttttttgttgtagagatgaggtttcactatgttgcccaggctggtcttgaactcctgggctcaagtgatctgcccaccttggtctcccacagtgctgggattacaggtgtgagccatcacacttggcctctctttagagtttttgtcttgaattccattttgtctgatataagtatagctatttttgctcttttatggtttccatctgcatggaatatctttttgtatccctttattttcagtttgtgtgtgtctttataggtgaagtgtgtttcttgtaggtaacagattgtcaggtctctttttttttttaatccattcggccactctttgtctattgatagtagagtttaatctgtttacatttaatcttattattgatacgtaagggcttactcttgccattttgttgttttctggttgttttggatcttctcttctcttctgtcttccttttagtgaagacaattttctctggtggtatgttttaatttattgctttttgtttttttgtatatctgttgtagtttttttttgacttgaggttaccatgaggcttgcaaatactatcttataaaaccgattattttaaacaaatgacaagttagcactaattgcaaaaacaaacaaggaaagagaaaattaataaaaactctacagtttaacctcatccaacttttaaacatattatttctatttataatttgttatactgtctgtcttgaaaagtttttgtagttatttttaataggttcacattttaatatttcaactgaagatattaccagtttacacatcacaattacagtggtataatattctgtgtttgcctacttactattaccagtgaattttgtaccttcaggtgattgcttaatgcttattaatgtccttttctttctgattgaagaactacgtttagcatttcttgtaagataggtctggtattgataaaatccctcagcttttgtttgtctgggaaagcatttctccttcatgtttgaaagatacttttgctggatatacttttctaggataaaagtttttttttcttcactttaaatatgtcatgccactctctcttggtctgtcaggttggcaatgagaaatctgctaccagatgtatttgagcttctttgtatgtatttgctgtttcttttctcttgctgcttttaggacattttctttatccttgacctttgggagttggattattaaatgtcttgaggttgtcttatttgggttaaatctgcttggtgttctataaccctcttgtacgtgaatattgatatctttctttaagtttgggaatttctctgttattagtctttgagtaaactttctactcctgtttctctctctccctcttctttaaggccaataactcttagatttgccctttagcggctattgtctagttcttgtaaatttgtttcattctttttaaattcttttttgtttgtctcctctgagggtgtattttcgaataacttgtcttcaagctaattattttttttctgcttgatcatttctgctattgagcgactttgatgccttcttcagtatgtcaaatgaagttttcagctctagaatttatgcttgatttaaaaatttcagtcttgttaaatttatctcataggattctgacttcctcctctgttatcttgaatttcattgggcttgctcaaaacaggtattttgaattctctgaaaggtcaagtatctgtatcactctgggattgtcactggtgccttatttagtttatttggtgaggtcatgtttctcgggatggtctcgatgctttggatgtttgttgatgtccgagcattgaacggttagatatttgttgtggtcttcacagtcttggcttgtttgtacccatctttcttgagaaggctttctaggtattccaagtgtgttgtgtgttgtaatctaagtctttggttactgcagctgcatctgcattagggggcacctcaagccgagtaatgctgtgactcttggcagatgcgtggaagcactgtcttggtgatctggggtaagatccaagagaattccctgcattaccaggcagagactcttttccccttctcttgccttcctgcaaacaaatggagtctctctccatactgagctccctggatcctggggcaggggtgacacaagagcccatatggccaccaccactgggactgcactggatcagacctaaagccagggcaacactgggtcttgcctaaggcccacagtgaccactgcctggctattgctgatgttcacccaaggcccaggggctgttcagtcagcagttggtgaacccagccagacccatgtccttcccttcaaggcaataagcttttctccctgctggcccaaggtgggttcccttctggccctgggtgtgtctggaaatgtcatctgggagctagggcctggatgagtgcatcagggctctgcctggcaccctatcctactgtggctgagctggtgtacaagttgcaagacagtcttctttactcctcctcctcctctcctgtagcagaaagaaggaatctctcccaaagctgcgagctgtactgcttggggttgggggaggggtggcacaagcactcccttagccaccctggctggtgtctcactaatttgtgtgcaccccaagtccactggctccaagggcagcgcagcaccagggctttcccaggagttgcactctttgtggcctagactgtctttcaagtttatttaagtttatcaagtttatttaagtgctctggcactttagccctcagtgatggggctagtttgaactcaggttctgactgctaggatgggacagtttccctctggctggggctggtctaaatgttccctccatgggcactggctgaattctgccccatgttgctttctgctgtgacaaggcagcagtgagttacaatgcaaagtctcacaattactgtgctctccctcccctaagcacacagattctctctcggtgtcacgaggctgctgctgggggacgggggtggggtggtgtaggcaattcaagactgtctttcctaccatcttcagtgcctttctccttgatacgctgttaaaaccaggcactgtgattgcttacctgatatttgttttttatgaaggggctttctcgtgtggatagctgttcaatttggcattcctgttggggggtggacagtgattgctggagggttttatttggtcgtcttgctccacctcatttcctgacatagaatttttggttggagatacttttcaactggaattttgaatgggctacttcattgattgtttatgttcattgcagctgttaagatatctgatgcctgtttatcttaatttgggtttcaccaaaagctatgcttagtagatgacgagctgagaaaaggacttgggtgcaagtaattcatttgggaattgacctcggaaattaggggcaggtaagacataaggatgagaaaagtcaataaggaaggatattattgaaaaagttactcctgtgggcaactgcactcagtcctgctgggaccctctcagagcccatgaaacacaccttagaattgtcccatgcaggatcaaggaaactgggatgtctgtctcccaattactgccctttgttgcttgagggttttacttggagaattacctccctggcactccagcccatcccatactcaggctgaacatgcttctctggccagagaagagattcaggcagagaaactcaggaacttgaggtagaaagacctcaaaccatatgagaactgtccaccaaagctgccatagaactttggcttgggctaagaagttacaaaccttatgtgcataacattagtagcaacaaaaaaaagcactgacatctcagatcagaaacaaaggtagagacattctgcagagtagttgaacaccaaaaaaaaaaaaaaaaagcaagaaaatggatttaaaatgtacttaatgaaggatatggagaagatgttagctgagaattctaaaattgctctttttgtatgaggtgaaaattttgcaatcttaaaatgaattactattcttctgtaactgcagaattgtttaaaagattcaattaaaagcatagacagttcccatgtcagactagacaaagaatgtattaggagcaaaagggaacaatgactgtttctcttaaataaaagaattctgtcatttaccccacattggtaccagagttctcaataattcaatccaatattggaataagcagtgtgggctgtcattgttctgggagtcaagaagagtagcctcccaggacaaaaacttgaaccgttgagcaccatcattgacaaatggtctccatattttctctggcactttttatcccagcatggttgagatttattatattttcaatttggtaaggtttgctagctaaaacagagttccagacctaattagtacagcactctataacttttagatggatgagttcacatcttagaaatttttattttctgagcaagcctcagacagaagggacagagaaataaagcttctttagtagctagatggatataaggcagctgttcaactgtgaggcaagctgcctgtttaatttttagaaattagttgggagaataatcaaattctctttagactttattcctgcattcaccctgaggttataatttagaagcatgatgatggttatttagcatttttataataatgaaacattatgactgagaaaacacttttgtaaagtagaaagtgccaaaagaggcagtatctatgtaaggagatacgaattagtttggactggtctccaagtcagagatgaggaactttagtaccagaaatgagagagcctagagatgagaggtgggaaccggcaacccattaataattcatgctttcctagttagctgtcccttatagctttgtgtcctccccctcccaagactcagttgccactctggtctgaagccaaaagctgaagtttcttggaagatgatgaaaaagtttaaggaagatcagtaggattagaaaggagtagaaggagagagggaagaaaaaagttagttgggcagacagaatcatttcttattctaataaaaatttaaaaaactaaaaataaccttaagcatcaattctctttaacaccagttagcctctaggttactctctttactcctaagctccactgaattttattgtcaacatggtgagtactgagaggagaggcataaaaatgggaaaacactgtggtttgttttcttctcatgaaacttactgagttggagactcagaagtgtttctaagtcaaggtaggatattacaagtagcagaatagagtaaccaagcaaggctttgagagcacaggggagagaggttaaatctgactgctgagactgggaattgatatttatttgagagagaaagttctaggcatagaattttgaaaaaaagaagaaaataaaaccaggaccagtttcagcatttaaatctctaatgcattttaaaccaagagtagttaaatgttaattaatccttcaaattggaaaaacaatttaatttaatatgaacagggaaggggagagattgttcagaaatttgcttcttggacaatagagaattgctgtttttgttttctttttgatgtttccgtgctagtttaaccttataatgttattttcatatactttttcacattagcttaaaagtggccatgcactcttctaaaaatcataatggtgactgcgaatatcactatttactctaaagaccatcacttagtaaacaacaaaactttcatttttcgtaattatgtatccctcactaaaaggcccttgacacattctcaacggcctctttatagatctgagcctggaaacaaatttcttcttacattaaggcccatatttctgactacttgaaatttttaccttgatttgtcacgtacatcctacatgcacaaattaaaaaattctccgagctttggattccccctacatgctgttttttttttcacatgtcttgtatctttggatatcacccagctagaaatctgagtgtgacccacgctagtggaaagggggaagaggagaggagttcatagtatgaacaaaagttctctgaaaaggaatttcgaggaaagactattcctgtgaacagtttgcaaaccaaggagattgcagcctttagtgcacaatgaagatgtgttctagagaacaaagggagggttcaggttttatagcacaagttcctgcccaggttcatttatgcaaatgaaggattcaaacttgcttagctcctattgattggtacagctgagccctgattggttgaggcaggtgagctctgattggttggttcaagtgactctgagagtcccaaagttgaacagaaatgtggattttctgagggctcagagttatgtgtgtgacctctagtcagcaaagggctacttggctctattttaaatttagacccagtgagtgactcaggattcaacttgaaggattggctctctgaggttcacatttgttgacagtagtttccatattgtggtgctacggagaggtgaagccagctggacttctgggtcgggtggggacttggagaacttttctgtcttacaagaggattgcaaaatgcaccaatcagcagcactctgtagctaggattgtaaaatgcaccaatcagtgctctgtggctagccagaggtttgtaaaatgcgccaattagcactctgtaaaagtgcaccaatcagctctctgtggctagctagatgtttgtaaagtggaccaatcagtgctctgtaaaatggatcaatcagcaggatgtgggcggggacaaataagggaataaaagctggccaccccccgcccccagccagcagcagcaacccacttgggtccacttgcacgctgtggaagggtttttcttttgctcttcacaataaatcttgctgctgctccctctttgggtccgcaccacctttaggagctgtaatactcactgtgaaggtcagtggcgtcatttttgaagtcagcgagaccacgaacccacccgaaggaacccactctgaacacactacttcaggaggttagcagtccatgcctgattcctttctaatcccctccgtgtctcctcttacaccactttaatccagttaactttagagtcatcctagatttttccatgcctcattcttcacactcaatcagagctaattttcattgattctactttctcagagtctcttgaatctggtccttcctgaccatccttgatttaagctccttatttttaatgcagactactgcagccttttttccagatggtctccaagctccctccctatctgtacatcacagctctgccagagtgctctaaaaacacaaaacttttctgatgaaatttctttagaagcttgtcactttcatggccttttttttttttccccaacttcaggcgtcttccacaagcctccctacatataaaacattttagagtttctcgatcgcgtgtcttttgtatgtctctttgcagctgtctagaatacccataactttattctctttaagactaacagtggcatcatctcttctataagatctgttctgagactcccagagttgagctttttctttgctctgcctcctagtgggacacaactttacagcaggtgtattacaacagcaggtgttgtaattgaacaggttgttttcatgccctttctctccactggtgcgtgaactctttgagagccaggactcctgcttattattgtctttttcatctttgtgagcccatcatctggcttggtttataacacaaagctctctgaagagcttgatgagagaatgactgaattttttcacacattgtgtactttttgccatgtttttatttgaaggttaggcattccagttatttatgatgatatttcttaaggttaacttgattaaatcagatttgctaatcaagtattttccagtggcacagagattaacaaggcctctgccacaatgttgaggcaaagtagatatatatctatgtaagcagaggcattttatttaaatgcaaggagaagtaataggttagagaaaagaccatttatttgacttaagaaatcaatattagagcttaggtgcaatatatggctctgtgtagagaaaactgaaaaattaatcttgttataattttattaaaaagtcaacgtggttgagtggccccagaactggtgcactgtgctgccaagataacagccttaggaagatgccagtaaaaaatggaagctattaaaagcaaactgagttgatgaattttcctcaatttataatgtaaaattattcttggtgtagtgctgtctacatgatatcggattttccattattagaggatttaaaagccactttggactaaaggttatttacatttctaatttctcacattatatgatggggcataactttaaatagtggcctcccaaacacgtttttataaagggacaattgttagctttctgatgaatgtttcttttacatgtttatttttttcatgtgctgtattctgtttggctccaactagcagaaatacccagcatttggagagtcttctcatctgagcatccagctgtttacacggacacacacacatgcaacaggggcacatttaaaaaataagctttttaacttgactacctctgtaaagaataaaattagaaaaattaaaaattttaagaaaataacataaaaatgagctttttgttgatatataatgtacatacaaaagagtgcttaaatcataagtatttttatgaatgtccacagatgaaatagacctaatgtaatcaacagtcagataaaaaaaaaaaaaaaaacatgtccagcatctgagaagcccctccctctgcatctttagtctagatatcaccccaggaagaaaaccttgattctgacttctatcttcataaactagtttttcttgttttaaacttttaaaaataaaaccacatactatgttgtaaccttttatgcttggtttcttttactggaagttattcttctattttgttgaccataacaatagtttgttattcttatatagcagcatgggattccatgtatgactgtatcctactttgtgcagtccccagttgatggagttttgtcttgtttccagtttggggcttgattgagtagtgctattataaatgttctttcgattttcctctagtcagcatgtgtatttctgttgaattgctgggccacatgatttgcatatttcatcttcagtagatactgacaaacactgttccaaagaggtcatactagttcacactcctgaaagccatgtatgaaaattcaagttgctgtacagcctcaccaatactcattctagcagatgagtagtggcatctcactgtggttttaatttccatttcctgatgaataatgagaatttgaatactttttcatgtatcttttggccattccgaggtgctttttagtaaagctcctattcaagtctcatgtccatttttctgttgtattgtttgcctttttcatattgatttgtaagagttctttatttgtgattcctttattgaatatatgtatcaaaaatatctttttccattctgtggcttgtcatcactttctgaatgacttttttgtgtaggacagaagtctttaatcttaacaaagtataatttattaacttttcctttaggattaatgtttttcctatgttttcttctggaagcttgttttccttttttttttttcagtgctatgacttggatataaacttattttaccttctactgttaaagttacaatctgtctggaattggtttttatgcatggtgtgaagtcaagattagtttttctccatgtgaatatctagttgatgctgtacaatttgttgaaaatgccacaatactccctctgcattgtggtgtcaccttcgtcttaacttagatatttatgtatatgtgaatcagtttctgttctctctatacctttcccttggtctgttgtctatctttgtgctgcactgccttaattattttagctttatcatccttatgtcttgataccaggtggtataaatccttcagcatattcagttcttctttaagatttctttctttattctggtcctttttatttcatatacattttagaatcaacttcctaatttcccaatttcctccaaaacacttgctgggattatgattgggactgaattaaatctatagatcaatctttaaaatattgagtattaatgccctttctgtatctgtcaaaatgattttttttatagtatgaattacactgatttttgggatatcaaactaaccttgcatttctggaataaattggctgtgatattttatttttttgatatctgactgatgtagccatttagacctggagtttttgttacgtgatggttttaatttcaggtctgacttagcctatcaagttgaggagtgcactgaatgcctgtcactttcacttcattgtaaaaaaattataaataaaatcattgttaagtttgggatgtactatgcagccatgtgctacataacaatcttttggttaatgatcacatatatgacagtggcccaataagattacaatggagatgaaaaatttctatggcctagtgatgttgtagccatcataatgtcatagcacaatgcattagtcattagtcatgtgtttgtggtgattgtataaacaataaacaaatttattgtgctgccagtcatataaaagcacaaataattaagaatagtacctaatacttgaaaattataatagataactctattacttgtttatttactatgctatatttttattgttattttagactgtattcctacttataaaagttataggtagaacagtctcaggtaggtgtttcaggaggtatccaaaagagggcattattatcataggagatgatagctccagttgcattattgcctctgaagaccttccactgggacagtgatgttgatgatccagcccttgtgtaggcctcggctaatgtgtgtgtttgtgtcttagtttttaacgaaaaggtttaaaaattaaacaaaacttaaatagaaaaagcttatagaataggaatataaagaaaagatttttgtacagctgtacaatgtgtttgtgctttgttatgaaagagtcaagttaaaaaattaaaaagttttaatataaagttacagtaagctgaggttaatttatgattgaagaaacaagtgattttaataaatttagtgtagcctaagtatacagcatttataaagtctacagtaatgtcctaggacttcaccttcactcaccactgactcactgactcacccagagcaacttctagtcctgcaagctccattcatggtaaatgctctatatagataaccattttaaatcttttataccatttttttttactgtactttttctatgtttagaagcacaagtagttaccattgtgttatagttgcctacagtactcagtatagtagcatgctgtataggtttgtagtgtaggagcaataggctatagcacacaccctaggtgtgtaataggctattccttctaagtttgtgtaagtgcactcagtgatattgacacaacaatgaagttgcctaacaatgcatttctcagatcagatccctgttaagtgatccatgactgtatttacattttttccagcatcagttttgatacattatgttggtaaagttcatttcacttaaattttaaaatttatttgtgtaaaggtattccttatatcttcttttaaaagaaaatgcctgtaggatctataataatgtactatttttattctcacattagtattttatgctttctttttttataattagtttagcttttgacttagatttttctctattgtacattcgttttatttttcatttaatctctacccttatatttatttcctttcttcagctttctttgagtttaacttactctttttctatcttctggaaatggatagagcatcaatttttagcccttgtttttttcctaatattatatttaagcccacgaatttccctcttatcacagctttagctgcatccaacatgttttgatttgtcttattttcattatttatgtaaaatgttttgaaatttcccatgtcatttttttctttgaccccgggttatttagaatggccttacttaatttcaaaacagtttgacattttctggtgttccttttgttgttgatttctagcttaattccactgtggtgagtgaacataaataattttagtctctttgtattgttgagacttgcattatggctcagcatagggtgaaatttggtaacaattccagaggtacttgaagaatgtttttgtgttatcactgctgagtgctgtgtcagtgtatttgtcaattaggtcagatttctttgattttgtactttggctttgagatggctctaggctcatcctcccctcaccattctctttctactttcttgctcattaaatctctttgccctcttgcttgcttttaccagagcttcctcttttgatctagcatctttttgatccatacatgttttcacatgatttcatttggctgtcttccccttaaaattctggtttcaatcatcgccctttttcccttttgttctgtggctttgctcagcaggtcagcatggtctttgtgtcctttagaccttatttgttaaaggagccaatcagctccatcagcaggcattcattagcacatgttgtgggactttagaaattcctgacattgttcactcaaggggcttgtgatctggctggaaattatagtatagttaaatatacagatttaacagtagtacaaggaagtatataatatgaactatatgtgtgttgtagggtagaagaagggacagtcactatgggctggaatggctttgtagggaacttggtatttggtctgaaatcaaaagatgggaaatagggaatttgccagaataaaaatccagaggcaggaaagcttaactactttgtgtttgtatttcataaattactttggctggagaggacgatgttagtgtgcaaagctgtagtggcctggtccatagaggtaggctgggactaggtcataaggagccttaaatgccaagctattacatttagacagcattctgcagctacagaggcaaggcattggagatgatgaatatgtgcacagggatttgatgtggtgaatgtaacatttttgggaaaattatctgatggttgtatacagaatataattgggaaagagtcccagtaaaatcctggaaaaattatgtgatttgagattataatgtgcatagaaagataacagatgcatacagaatcaggagaagggagttgatttacttataatgcttaagaaatccatcctaggtttttaagagaccaaccagtgctgtggatagaaatagagacacagggaggcagagcagaattcagacacaggtgtcagaatgtgctcaagaccagagagctgaagccatggtgcagaggtgagatttagcttaggcagactttgccaactgaaaaagagcacaggtgtcaggaggtgtcaagatggtgtatggaagggctcccgcagagttctctctgagatagcagaatttcaggaggtttgtgaggaattagggctagccataccagctgtggaagccaaggtaacctaacattgctgtccaaacttataatctctaaagtaacagaccaaaatcgattaacaataataatggcactaataaggaaaagcacagcaagctctcaaaccgcaagtgaaattcatttgcgccatttggggttcacttttaaaggagtaagctattcttcatgtatcctcctgttttgaaggtttccctgaaactgtccagttttgcctcaaccaaggcgatttgctaggaaacaggagagaattctaaactccaattagccagtgctattggagattaataacactttagacctgctggaagcgacttcacatctaagcttcttcctactgtgtcatagcaacaatttacaaattttaataatagatgtcctgtttgagaaattgcctttccttatgctatgggaggttttatgattagactatacctctttccttgcagttgttttcaaggcgtttatgttaccatttttgcttatcagtaatggttcaaaaattttctaacacagagcaattaatatctgtcagtagaaataaattacatttttcatcgcttgtgacacactctcaaatgctgtttgaaagtgccataattttgcatcatcatgctatgtaattttggtgcctggtgtaggagtgctttaggggtatgatttatattttctgttttttttttcttgaattaatagggtaggtgtaaggattaggatataagttggaaaatgacactttgcagaataatttgtattatttctgttcttctaaagcagtctgtcttttagaattgttcacatattttataaatatatttgtgcatgcagattgtgtatattataatgttaccatcagtaacttttgccttatagcactagaagggacaacatgcttttagaaattgaatgcttagaatatatgtatgttcagaacatatttttcattgccataaggaagaagtgtataacatttgcaacatttttacctctgtaggatccttgtcgtttaagcacagcaggcccaccctagtgctctgttttagccagccgtgattactggccacagatgagagcctatgacaggcggagcacccaggccaccttctgcttatttttggccccattctcttctcctttggccctgcaagcctggtgttgacatgtgattttagcctggtgcttttaggttaccgatttgtactcacctctggtttgatagattccaacttgcctggaggctcttgccaattgtcttctaccactcactgcctacctctgactcagtccagtgagagatgatgagaaggatcagaggatgggggagggaggctgccgggacccgggtaaaaaatcaaaaaggacttgagcctactaattaaacctctcaaattgcaattgtgctgaaagctcatactgctctcgtcagtgcctaattgatgagtccattactatgttcagtcattgctacctggcagccattcttaaagtgagcaatatatttcattctattagactacaatcagtgattcccttctgaaacagtgaagaaaagctttaactttaaatttacaactcaaataatattgcttcttcaatatggctattataaagaggaatggagtcagggagggaccacactcactcgacaaggctttgtagaggatctactatccccaaacacagtgctgagggtatgatattcctgagaaatgctgttaggagatgtggttttcaaaataattcacaatgattacaactaaatctgtctttactccccatctcttaatgtttttattttttaatttaacactgtcggttggattaggcttagataaaatacacataagagtataaggagatagaaacctaaatataggcgttttgtgcaaccaaatgcatcgctgccttatcttgaaacttctgaaattatcaaaagctacattactgtatatcatagcagcacagctgtgagcaaagctggggctttgctattttaaaatgttagaagagaaagtgtattgaatttttcaattgaattttaaaaaggtatcagtgaatagagacttgtcttcttacatgggactcaaactatcagattcccaaatagaattttagcaattaatactagttaaatgggtttcagcaagtcaaacccatctccacagagctatgattgtagtatatttttaattatggaagtattaaaaacaatcagctcacattaacttttaaaatagaattataaagcagagcctttcactctgctaattcctttgtttagggagtcatcaggtattaagtgagtcactttagaatgagcggcttatttttaagagttttaatatattaaataagaataacagaaatcaaagtagaaggaaccttggaaattatggtcacctgacacttggtatttcatttagaaaacaaatacctaaaattattaaatgcaaaaaagaaactaaagctgctcactggatggatggatggggcattggtaattggtagttatggttttaaaggaaataagggcattaggttaattggcataatgtgaaaacagatgctttatattttcaaacatcttattagtgattccctattgagctccatttttaatttaatatttatgcaggagttaatattttgaaaatgtttatagtcatttttatttgttgtatgttttatatgaggtaggtcagtgcattttttcatctgggtaagtcatcaattaacaggtggagtacgtggcatgtagtaaacagatgtttctgccctcgagggaattacaaattaaattcgcctcttagtatcttactattccaaaggtcttacctttgcttaaccacgtatatcctgccagcaaaactggtcttcaggaaattgtgccacaaaatgatactaatgatactaatactaatactaccaatactaatactaccactgattaaggacatcctgtgtgccaggcagtatattgagttctttgtgcatgttgtataatttaattttcttaacagtgccatgaagcagctactatctcggttttacagacaaggaatcggggcttgaagaggttcagaccatgtaacttgtatgtgaaggtctagatctggtaagtgaagaagttagtgtttgaaacaactgctcccccgcactgcaccgtatggtgtcctgtggtaataatggtggctacatttgttggtggctgtctactaagaacttcacagcatattttcatttaatgcccacaacaattttaggtattttattccaatctacagatgcagaaactgagctgaagagcagttaaagaacgttagaacattctttttttatttttgttttttaatatttttgagatggagttttgttcttgttgcccaggctggagtgcaatggtgcaatcttggctcactgcaacttctgcctcccgtgttcaagtgattctcctgcctcagcctcctgagaagctgggattacaggcatccgccaccatacccagctaattttttgtatttttagtagagacagggtttcaccatgttggccaggctgatcttgaactcctggacctcaggtgatccacccgcctcagcctcccaaagtgctggaattaaaggcgtgagccaccacacatggccaaggaacatttttaagagtacacagctatgaagaaacatagtttcaaaatatagtgctctgcctccatactctgttgctatacccatattccaaactgctcccctttcaacgtttcttcatgtgcgtgataaagatatataaccaatccttatttgaattgaaaggagctcggcatatatctgtgagtgactgaatggtgttttattcagaaagtttgtttggagtatttcttattctcaatatgttcttcccttcttagcctaccctatcttcagtgtactccatctctagatgactagggccctcaaaccatttcttgttccttaccctcccaatacaattacatgttgaaaagcctacagtaagttcagttgcactaagttccaaataataatgtcttttaattaattcttcccccaagttatgggtatttgctgtgattttatatatatatataaaaatagttaaatatgtatatatatatccaagaaaacaaggtcttgctctatcactgaggctgaagtgcagtagcatgatcatagctcagtccccagatgcttaaatcaaactaccttaaccgctacactgcagcctcaaactcctgggctcaagcagtcctttgattggataactttactggaattccaagtggtgggtactggctggagatattttcatgtggtctttggggattcctcaaaacatagcagtagttgtctccctttatatatgttaagaccagcctgagtcttagcaaactgctttacaggatgttttcatctcttttggggttacctttttctgtgggtatatacttctgattttacaatgaaaagtagtgagaaaatgggactcatttcacaacagttcttctttacttagttatatatgcttcatgaagcaaaacaagaggaagctcgtatgtggatattagaaacacaagagttaattaaaacaacaaccctctgtctttcccatttaccaagttaagacatgtcattatcagggccaggcacggtggctcatgcctgtaatcccagcactttgggaggttgaggcgggcagatcacctgaggtccaggagttcaagaccaacctggccaacatggtgaaaccctgtctctactaaaaatacaaaaagtagctgggcgttgtggctgacgcctgtaatcccagctactccggaggctgaggcaggagaaatcgcttgaacctgggaggcagtggttgtagtgagctgagatcacgccactgaactccagcctaggtgacagagcgagactccatcctcaaaaaaaaaaaaaaaaaaaaaaaaaaagaaaaagaaaaagacttgtctttatctaaaacagatcttacaatgaggttcattaagtgaataccatctaagatggcgtacaatttaaatggattggggaatttattttattttctctaaaattttaccactaaagatctagtcacttggaataatagacattttttaaaaataaaaataacccttgaagagtaaacatagtatatcatttcatgatttatacctatcttatggaaaaatattcagcttgcagaattcggcttgatgggatttgatctctcatgtttatttgtttgtttgtttttatctcttttgtctgttgccttttggtgattttcttaaatgtatcctccaggccgggcgcggtggcttatacctgtaatcccttgaacccaggaggtggaggttgcagtgtgccagtgcactccagcctgggcaacagagtgaggctctgtctcaaaaaaataaataaataaaaataaaaataaataaaaaatctatcctctcagatcactaataatattctctacagctgggattagctatttaatctgtccatttggtatttagtccttccattgaatttttaatttcaatgacaatatttttcatttctagtagttctagttgaccctttttcaaatttgccagtttttgtttatactgttgttttctttcagtattgtttctgttgtctttgatctctctaatcattttgatgcactttttagtaatctcttttaaaattgttctttctactgttctctaaatgctaattctctttgttgtgtctgcacatcatatgtaaatctaatcttcaactgaaagtcttgtttgttttgctaagacagtcttgtgtgtctagggtaaggtaacatcccttcagagtatttttcatttgcttcaggtgaggccatgggaactttctggcttgggaccagttttatggttaatgtcttggctggagttttcttgaccacttgactagtataaacagatcttacagcctttctcacagtacatggttgaagttttgatttctcaaagactccagagagatgccaagctttctttctactttctggtctagtggacagctggcatttttcaggcatttggaacccctggaatggtcccggttttatgctgggatctgggttccaacactccacttgtggaccttaaaatcctagctcccagccgctcgaacctaagtttctgtccatttcctcttgaagcactgagattgccctttcttttgagctcagctatgaataaaactttttgagatggagtttccctctgtcgccaaggctggagtgcagtggcatgatctcagctcactgcaacctctatctcccgggctcaagtgattctcatgcctcaaccacctgagtagctgggattacaggagcaaccaccacacccagctaatttttgtatttttaggagagtcagggtttcaccatgttggtcaggctggtcttgaactcctggctttgagtgatgtgcccacctcggcctcccaatgtgctgggattacagatgtgagccaccacgtccagccacataaaaatcttgagttcacattttgtttgcatttctgggtatttgtagcaggagagggtctgtgtcacctcaatccattatgctactttacatttcagctacataagatttgcattgagaaattttgtcagagttttcacgtggaggaaagaatgttgtggaacacagaccactgccagggaaagtcaggcttgggcaccccgggggagctgacaagctctaggggagggagacaaagggcagtggcctttaaggtggggaatggagaggaaaagtaggagaaagcacagagagcaggtctgggaggtggtggagaccaactgcatgttcttgcccaagggcagttcttcccttgccttccagatgcagaatttgtttttctcactgaacaccgtgacatttacccagccagatcaaatgaaggagagtcttaggccccagaggcagctgtgtgagcttcccttgtggttgaaaggtcagggtgatttctacccatctcaggtaattttgcagtgggtacgttttctgtccttttcccaccatccctgatgtattttgaaatgaatcacatacttttttgaagaaaaatcttttgattaggcttcttggttccatatcgttttatagtcctattttcatttgaactgttagaagcaaacccggaaggtcactatttcttaactttcctttagaagtagatttttaagtatgagtcgctgcatagtctatttattttgaagtcttctggattttaccttctagattgagaattttctgttcatggcaactgtttgcttctaacacagaaactgcttgtctgtttagagatcttttgggtggtagtgtgtatgttggttaggaggtgagtagtctttagctggatgctacttaataaaccttattaatgtgcattgaagatttaaattctgaaatgaaaaacaggcattgggactagcaggaaatattaaccaaaatcgtgaagcagatcagatggtaaagagacataatgtgttttatctgtagaccctcatgtttgttcatctctctccctatctctcttccctagttcactcaacccccattcccattcctgtggtttggggttgcctctgtttgcttgtctgatcctgaaggccagaaccacacttagattctcgtagggacaatttatgattctgattaggttaacatgaagctagacttagctcagagtatggggatcctgccctataggatttccaaaggttggcacaatcagccatgtagccagggacaatttaattcaacttgtgagcacaggtcatgtctgggccttccttccaaactagcctctcagctccatataagctgccatcctgaagcaataggtaagaggggttttgttattctattaaaaatgagagccataataataataacaatagctaacactcataagatggcaggtgttattccgagcattttaaacacattaaatcattgagtcctaatgaccccatgaggtaagactcttttagcctcatcttccacatgaggcacagacagatgtggtactttacccagaatcacatggctagcaggtggcagagcctggattaaatgtgctctgtctgactgtccagaggtgtgcaacctcatgtccagcctgactttggcatccatcccatgtgagagtaagactctgttatctgcaggtcaggggtttcctgcatctttgccttttccagacaacatgtttgtaagcccagggtttcagctctgatcaccattttgtttctctgttctgctttagattactgacaggtttagcttgtttgagtctggcagtgtcctttaaatttttctcttctgttttgtgtctcactggtgtgtttggacagatgaaatacctcagagggtggactcccaagctgtcttgactggcagtctccagtgccttctcagggggatatattccttccttttttcctttgttcgtgtcttctttccttttcttttttttttgagatgagatcttgctctgtttcccaggctggagcatatcggcatgatctcggctcactgcaacttgtgcctcttggtttcaagcaattctcctgcctcagcctcctgtgtagctgggattacaggtgcatgccaccacgcctggctaatttttgtatttctagtagagatggggttttgttatgttggccaggctgttctcgaactcctggcctgaagtgatccgcccgtcttggcctcccaaggtgctggaattacaggcgtgagccaccatgcccaaccatctttcttcctgtcttcattcagcatttattgactacctgcctatacctgtgctctgtgacagtctgtcctcggcaagctcagtctcctgtgaagaattagatatgggcatctgtgctgtggtaaatactctcacagaggctggcggtgggtggagtgggaggacacggagaggtggggggaagacttcacagcgaaggtgccagtggagtgaatgctgaaataaaccttctccaggtagacagagggaagatgtttcaggcagggaacctacatgcacctaggctggaggcatgagcaggcgtggtgagtggagggctggccagtcagtgcaggcgatgggctgaaataacacgaggctatcaaagggggccaaacacagagctcaaagggccctgatgacctgtctagggagattggattttacttcttagataatgcaggtgccactaaataatagtaaattaattgtttattatttagatgatttattatgactactttttgagagagggtcttactctgtcacctaggctggagtgcagtggtgcaatcatagctcatgacagcctcaacttcctggctcaagtgattctcctgcctctgcctcctaggtagctgggactacaggcatgcaccaccacagcaggctaatgttttaaaaaaaattggtagagatggggtcttgctatgttgcccaggctggtctcaaattcctgggctcaagtgatccttccacctcagcctcccaaagtgctggaattataggcatgagccacgacacctggcctgatttctttttgagaatattgtattttccatttgaaaagccagtaaaatatgaagtacactcatatattctattcatatattctactgtctttagggataaacaattaaaatatggaaagacatacagtaaaccatcacaggtttgaaggactttggggaaggtggcttatctaaataagatcttttgagattactctctaaatgctttgtgagtcttttaaaacactgccaaaagccattagaatattctctctagtaaacttttcatgaatatggaaaaatagtggtttttttcaacctagagttttgtgtagttggagaatactttagaaatgatcttaaaattctagaggatatatgtatttaaaaaatgagtcactgcttattttctcttcaaatattttaatttttaattctttgttaaaaccttcctgtaacaatactaggaaaacgagtgattggaccttttactgtggcatgcaaaagagacctaatattgaaacatagtcatgttttaggagtgcgtgattatgtgaaatatatttgtgtaaaatgtcctgtgctcctggaggctccatgtagaaaatgcagcaatgtaaaagtgtaaaactcaccattctttctagcttttttggtcacagttttgaaaatgcctgtagagaactacagagtaaaacacaaaggccattgtttttcctttacatgtttacctaggttaatagtacactgtgcatagctgtaatgaagctctatatctaaccccaggtggctgaaggtcatgggctttataagccaaaggtaaaacttccgcctgtattctactgcagggaatgacaaattcttgaatcctacaaccaacaaaaaatgactttacccgaggaagcctgcacaaattacttccattgttcctgattgccttgatatcagtatcagacactttgtgaacagacattctgactttacacaaatagttgtgcacaagccaggagcccattatcttgttataatactcaattttcttcccattcttttaattgaaacgcagttgccccactgcttttgggcagcagaagtgttacgatagcctaaactctcagccatctaagggattgatttgctgtcttacccagctttatctgttacttctctgtgtgtgctacctcttgtttctgaccacagcgtgatgctattaaatgtgtactattgatccagtctgtgatgacagagcactgattagcccttttgtattactttgattttgaaattgactagtcccctagtctgtaaatcatgtattctaaaatgcctagtaatcaaaataataacattaatgattttctaccacctaggcccataaagtaaattaactggtggaaacagctttgaaaagcaatatggctgaatagacctattcttaccttgttgaccaaatgttttgtaatagtctaccaatttcaattttaggttaaaaacaccatggaaaaactctgcagttcagttagcaggagataaattgcatgatgcttgtaatcagaaaaactggaataaactcagtgttcaattaatactccagcctcttcttcctttctgatgcacctctttaaagccaccgaggattcaaggatgataattaatttttagggtaaattaaactaatctaacaaataatcagggctgattttcagctggtacctattgtagagtcagtagctacactagttgtttatgattttctaattggttaatctcagtgttcaaaatatatttacttttaaccttacagataatgctagatgtgagtttaatatatattttaactatattacattgcctgcctccttgttggctcttagttgagcaaatggaaacatataatttcttttatctttgtacatctcacaccagcttggattggtgtgatattttccaagttttgttttacagaatgatattattatatgtatgttttcttccaagtgattttcaatattgaaaaagataatttacagaattgaagaaagagtgtcaaaaaccagatcaaagccagagacctcaaaaactcgaatgagggacacagacacccacaaaattctttttgcattatccagctctaattcttctagacccttggcttcattcttctttatttatataaacttccctcatttgagaggaacatagctgtaggcagctcctggattatttccttttagcctgggaacatgagagtaaagagaactttcccttttagctttagattgaaaaaaatcacaggaaaggattctgactgatccagcttaatatcatgtgcccactcctggacctaatgtggcagggaaatcattcctaattagctgggtcacatgcctgcctcggtgttacaggggcagtgcttgttaccagaagaaagtgaattggctttgagccggtcaactatcccagtttgtgcctatcacagagtgaatcagatatataaagtaaaatgagaagaggctctgatctaggtggtccacctttgatggaaaataagatgatggtgccagaaggaagtgtgtttctatgaggaccttgggtccagcaggagaaggacggtatcctgtccttcttccttttggtccaaagggaatgccactcctggtgttcttcctctgggttgataccgaagtttgtctttgcctccattgtacttattacacatactctgataatgtgttacaaatctgcctccctgactggactgtgaggtgcttgagggctaggactatgccttattcatgtttgaaaatactcttgttatgatatgaatgcttgacacttgttgaatgaataaattttgggaagtatggcaacctaccacagataaggcactgaatgacaatatcgttagattacgcatgtcatatactctagaattgtacaacaaagcttttaaagctaatactctctcctatagtaggcagagttgcttgcacacttgaggcagnnnnnnnnnnnnnnnnnnnncctttctcccttcctcctttcctcccttccctttccccttccccttcccttctttctttaaaaaaaaaaaaccttttattttagattcaggtgcacatgtgcaggtttattacaggggtatattgtgttgatgctatggtttggggtacatctgaaccatcacttgggtagtaagtatagtacccaataggtagtttttcaacccttgctctcctccctccttctcttctcttacagtgctcagtgtctgttgttcccatctttatgtctatgcatactcaatgttcagctcccacttatatgtgagaataagtggtttatggttttctgttttggtattagtttgcttaggataatggcttccagctccatccatgttgctgcagaggacatgatttcattcttttttatggctgcattgttttccaggggttatatgtactacattttctttacccaatccaccattgatagacacctaggttgattccatgtctttgctattgtgaatagtcctgcaatgaacatacaagtacatatgtcatttcgatagaaggatttattttccttttgttatctacccagtaatgggattactggtttcaattatagttctatttttagtcctttgagaaatctcccaactgctttccaaagttgctgaactaatttacattcccaccaacagcgtataaacattcccttttttccacaacctcacaacgtgtgttattttttgacttttgtttttgcaatttattttgcatttttaaagttataacttttaggtttaagggtacatgtgcaggtttgttatgtaggtaaaccaagtgtcacgggggtttggtgtacagattatttcatcacctagctaataagcatagtacgcaacaggtattttttttctgattctgtccctccttccaccctctgctctcaattagggcctgattttttttttttaccttttcatgatagccattctgactagagtgagacagttatctcattgtggttttgatggcatttctctaatgattagtgatgatgggcatttttcatatgcatattggctgcttatatagtttcttttggtgagtgtctattcatgtcctttggccacttcttctttttttttttttgagtcagagctttgctcttgtagcccaggctggagtgcaattgtgcaatcttggctcactacaacctccgcctcccagattcaagcgattctcatgcctcagcccccaaagtggccagattacaggtgcctgccaccatgcccagctaatttttatatttttagtagagatggggttttaccatattgggcaggctggtcttgaactcctgacctcaggtgatccacccgcctcaacctcccaaagtgctggggttacaggtgtgagccactgcacttggccttttgtccacttcttaatggggttgtttgtttttttttcttgttgatttaagttccttataattcaagatgttaggctttcatttggatgcatagtttgcagatattctattctgtagcttgtctgtttactctgttgatagtttctttggtgtgcagaagctctttagtttaattaggtcccacttgtcaagttttgtttatgtttcaattgcttttgaggatttagccataaattctttgccaaggccaatgtccagaatactgtttcctaggtcgtcttctaggattcttgcagtttgagattttacatttaaatctttaatcattttgggttaattcttgtatatggtaaaagccagctttcccagcaccatgtgtcaaatagggagttctttccccattgcttatttttgctgattttgtcaaagatcagatggctataggtgtgcagctttatttttgggttctctatctgttccattggtctgtttttgtaccagtgccatgctgtttgggttactttagccttttagtatagtttgaagtcaggtagtatgacaccttcagatttgttctttttcttaggattgctttggctatttgggttccattttggttcatatgaattttagaattttttttttcctaattctatgaaaaatgatgtcagacagaaatggcattgagtctaaattgctttgggcattgtgaccattttaatgacattggctcttctaattcatgagcatggaatgtttttccatttgtgtcatctatgatttctttcagcagtgtagttctccttgtagaaatctttcaccttcttggttatatgtattcttaggtgttttatttttgcgtatggctattgtaaatgggattatgttcttgatttggctctcagcttgtacattattggtgtgtagaaatgctactgatttttgtacagtgcttttgtagaggtgagagtgggcaggcttgtcttgttccatttctcaaggggaatgcttccagcttttgtctgttcagcatgatgttggcttgtgggtttgtcataaatggcgctagttattttgaggtatgtttctttgatgcctagttttttgagactttttattatgaagggatgttggattttgatcaaaagcttttattttatctattgagatgatcatatggttttttgttcttaattctgtttatgtggtacatcatatttattgatttgtgtatgttgaatcaaacttgcatcccaggaataaagcctacttgattgtggtgaattaaccttttgatgtgctgctggatttggtttgttagtattttgctgagaacttttacatctatggaaccctttccttgaaggaaattttatgcaaagtccactttgtataataagtaaaagaggatctttcctgcttgcagggagtttgcaggacaaggaataaggcccatctgtccatgtcttatctcccccattcactgtgatgactgctgaaacattttgagagaactcagtgttctgtggcccccctcaatctgaaagatatgttgttaaaaatgtattacacattcttatgagtaaaattcaagtttttagatgtaatatagctaaattaagtgctactaaaattctcatttatttctgcatgaccagctgtcaaatcatatctttttatcccataatgcagaatttttcatgttatcctattaaattgaattttgttcatccatatttcagtttgtcaggatcattttgggccttgattttgttattaagtatttatttgttatcatttctatcctcccataatctgggtgtttggcaagtgtgctatctatgtggtatctaattatttttataagcttattgaaataaataggggtccatgagagaggcccttcttaaaattgacacttggacagtggtgtacattttttggggtccaaagacttgtacccaacatccctaaaactaaactgtcttctactctaaaactgtctatatcgcttgatatcactatctacttatgcctgaaatctagacacaatcttaatgttccccttccttttagtacatactcacaatttttcatcaagtcctgtgattttacttactaaatatttggaaacttctctgatttccacctctctaccgccacccttgtttaggttctcctttttttctccacaggcagcaataacctcctaacaggtgccctttcttctgggctttgccttctgagttttgttctgcactcgttcccaacgttatctgtccaaacaaaatctgactgtgtggttcacatgctgcaaacccgccattggcttcctgttgcccacgggacaaagcccattatcttcaactttgcactcaagtttatgttctgactcttttgtatcatcttccagcacttcctaagctgggcttgatcgctcactacattcaatggcttgtaatttcctctgtgccccgtgcgatttttttttttttatggtctcctttaaaattctccttcctcatacggccaaccaacttctttttgtcaaagcttacttgtttttaagagtcagcttaggtgtgacctttccctaggatattccttgaaccttcttctatagttggcctcctgcttccttacaagtctggcttattagtgtttatctttatgtcattgtgcataatctatctgcattttatgtgcatctctcacaagatcatgagctagttaaaggcagggtccacagttcactcattttggtataatttgcatttaagctggcatttagtagatactcagtaaatgtttgttgagtaaaataatcattgaatgaacttacttaaatgcacataatcatcacatttccctaactaaatttcaccatcctatatacaaagatatgtagattagtgagtctgctagccattatgttgaaatgcaaatattatatatgtttgatgttttcttcatctatcaaactagcaattatataaattatttcatcattaagagcttctaactgaacttctttttggctcctttccattactgtgttctttcctaaatgcatacagacaattttaaaaagagtgaatttctaattaaactgcctcactggagaacacttttacatggctattttttcccagtagcgtcaaacaattaaacctgggttaaaataacatggatttattgactactctgtgatattttaagaaattgcttctgacactaagcaatttataatctcattgggggatgacgataatgtatacaaaataggtaacattaaaatacatcaaggggtaaagtatcaacaagaatagtacagatgataagtgttgggcattttgatgaaacagtagtgatttaagcaaataaaaagtaaccacgccacataatatgaatagatagaggccacaggtaagaagtatagattatttattttgtaatcagacaaaagtccaagaaacagagcctcctttgattttgtgttgagctatttgtgaagccagtaggactattctggaaatgaacctaacagtatacctaaacttaaaaattatatattgttgggaagaggacagactattttattagaactttgtgatgaagtctgatcgccattgtcatcagataggacacctcacagagtttgtgtctccttgaaaacatattaaacatagaaaacaaataactcagctttgggaaaaccattgagtgctgccctaaatggccattgcctatcatgcttcagaaaaggaaagatgtttttacccaggttgttttttttgccaggttgttcctaggaagatatggaaaggaaagttggctagcttttcctatggccagaaggaagtacagcatgaaacaagtattttttttttttcaagaaccccattcattcattaattcattcactcacctttatccattatttattgagcactgaccttctggaaggcactgtgtcaagctatagagagctccatgttcactaaagcaatgttataaatttgatttcccttgttcaacccatcaaaataatattttgtctatcaaccagatatagcctattgtaaattaaagagcatggctggtgtaagtgaaaaatatgggtctagtcatgccttgggcaaattgttcaacaattctgttctcaattgtaaaatgaaagggttgaaccatttactttctcaagtcctctgaggctctaaaatataatgatctaattaattttgatggcctcctggtttacactttagtattggtgagtttgtttagtgcctgaacatgctgattgagttgactttgcgaacttgcaagtaagacagagttctgaaacacagtgacagcagtgtgctcatttaaacgagagaatgtccttctgtttgtaggggatgtataaactttcattccttaggtgtttgaaaacttagtgaactagtatttattatgctatagttaaaatatttctgtgcctggttaattgagatgtacgtcaattttatggcactttatgtgaataaatctttaaaaacattgcttgagtgcatggatattcctgatatttcagacatggcataaccatatatctttttatatctgttatattcgattaaattgctgtataaagtttaaactactccatcaacaaaattgagcattttagttatatgtatgtatgtgtgtgtgtgtgtgtgtgtgtgtgtatatatatatgaaattactaaagtcatgcaacaaatattatcttgaagtcatttttgaaagggagtattttaatgtgctcagtgaataatttctctctgcctgagagctactgttgtatcctgggaaatattcagaggagaagataaaattatttagatttgcagcttcttgtcatgggaggtgaaggcctttttattattattattaatgtgatgggaatagttccatcacatcgtgtctctgcacagcatcctgagaacaaccttttcatcacataaataattacagttctgttttttttaatgtctcctgctattccttccctccccctcttcaccattttccctttgagtgaggagaggatagcactcccttcagataaaggtttcctaagtattgacaaaaggcaggcacgtggtgatagtggtggaggatcggggaggggaggattgttctttgtcccaacacaacccaggtctgagctggctggaaaggactgtgtccagaaacaggtgtatatccttttaaaagcaaacttgttatatgtagaaagtgcagtaatttttccagagaaagagtcagcttctggcctgataccttttccttcttcatgggtctcctgcaaccagagctcctggcctgggtctcagaaagcacatcctgcatataatggtacccagggcctagatggggccagagtcctcttggtgatgggggtgagcaggtcaggcaagatctttgctctcagggcgtgaacattctcctgagggagacacacagcaaacctggacatagatgcagaaataaggaaaggtctgacaacagcgatgctgagaagggaatgtgggaggaaagggacctggcacccagcaacatctcttctcatcgctcccatttctgcatttggaattctgcctggatggaaggcaggccatggggcagacaacgtgggccttccataagcctccttttctgtgcatttttgcccttcagtagtgactctttccagtttctcttaggactctgctttgtcccttattgttattgagtggagcatggcctatgcagactctttggtgatttaaatgggctaggtagagccttaagacagaaaatgaagatagtggtagaagataatttttaaaaggataaggagctagtacttttgcatttaaatgaattccaggactagttcttttagtgaaaaagctataaatccctaatacttagtaatttttctgtgtttgcttctacctcagggcctttgcactggcattccctctgtctggaacagtctcccctctgatatccaatcctcaagcttttcgagtttttgttatgttttgttttgttttgttttgagacagagtattgctttattgcccaggctggagtacagtggcacaatcctagctcactgcagcctcgaactcccgggctcaagcaatccttgcacctcagcctatcaagtagctgggaccagaggtgtgcgccaccacactcagctaattatatttatttttttgtagtggcggggtctcactgtgttgcccaggctggtcttgaactcctgcgctcaagtgattcacccacctcagcctcccaaaatgctgggattataggcttgagccaccacacctggctctcgagtctttatttaagggttgttgttttcaattactactgtattgagaattagaccctctttctagcacttcatggcacttacatgataataatcctgttccttgtcactctccattggccgcctccttcccaaatgtaagtcatatgagaccagtgattttggcttgttttgttcacttctgcattcccagtgcttagaaaagtgtctttaacatgatgctcagtaaacattgttgaattaaaataagatttttaaaaactttatgttttaagttttcctaatggtaaaatcccttagaaaactctggcaagagctgtttacttttgggacttagaggttggaagaggatttctggacattttgtggtcctgggaaggactgtgtggccaagagcaggctgggtgggtcagaaggaagccagtggccaaaccatgggtctctcaaaggggaagtggtggggccagtggtgggagtttgggataggcaccctctgacttctacactcctgagatcagtcagatctaagtgtggacatggaactcatccttcctgttgtttggtgctgaaggaagtgagtataaaataaagtaagcataaacatttacagtgtatctccatttatgggctcagtgaagacaggatcataagtgttgaggatttttaaaaagtcattagaatttgagcattctgaaggggcagctccctcagatgaaatcagcttttctatttgactggctagtttactttgataatgtctaccatgaaaattttttgcattttttttcctgaaagatttcatgggaatgtggcaagcaaaataacggcccccaaagattctcactcaaaccaggatctgtggataaatgttacacggcaagggggaattaaggttgctaatcagctgaccttggaatagggagatgatcctgaattactgtggtgggtccaatgtaatcataaggtcctttaaatgtgagacagggaggtagaagagttagaagcagagagataatgtaaaaaagactcgaccacgagccatggccggctctaaggatggatgggggccatgagccaaggagtgaagatggcttctacaacaggaaaagacaaggtcacagattctgccctagagcctccagaaggaacatagtcctgccaacaccttgattttagcccagtgagatgtgcctcagactctggcctccagaactgtaagacaataaatgtgtgttgttttcagccaccaagtctgtggtaacttataacagtagctgtaggaaaccaatacagaaagagcaaggggagacctgtctatatgttttcacaacgcatctacttagcagtgctatgatttctggtattctttgggggaaaattaaaagccaaaaacagaaccagaaagcacttcagaagtgtatgattgtgaaatctagcagtggccacaacagaactagaactactaggcaaccagccccctcaagagattatgacctatgactcccacctctcctctccactctgagtcacatcctctttgtggacagtgaccacgagctcacaaaaccagactcaggatggcaagacccaagatgtgattattccatcagagcctgggttaaggaaagaaacagaggtaggaaatattcgaagttagtacacagtgctgctttcaggattcttcattagcagatgtttaaaagtcactgctctaaaatgacttggaaatgcttataaatatgaatttcctgtaattcacattttatcagaactcctatcagctgtatcacagcttgaaaaataccaaaaatgcattagaaaaatctttctgtttaaaactagattgatcccacatttacatggcaaaagaaggccattacttggcaggcagtaaaagcttcctttcagagagcttgagaaaaaactcaaaataattcacttcgacccaggccatttgacaaccgttagacttaactttacaaaataaaatgaaatcctaccacctgctgcttaaaatctccaattaatgctgtaaacagtgccttcatttaaaaaaccaatgagtaaatttctgcaagctgggtgcagacatttctacaaatttgctgtaaccttttgctcttgtctgcagtaagaagagccttccagattccaaaaagaagccagagctgatttatacctaattgtttaagagctaaactctttttgttcattagcttcagttatttaagatactgataattcacacctcatctgctgctatgtgtgtttggtagaaattgtgaaagaaaattattgaagcttgccaactttccacctatgaattaaaacaagagtaattttgcacaaactgcagaagagaaggaaggaggtggcaggcttttaagatagaaccagcaagtaggagaatcaccatcttccagcaacttgaaagcagtgagaaagttaggtctttaatctcttccttcctgtcctgataggttaattggaatgttctgagaggtaagcccctggacatctttgacctgcccccttctgtttaccagattaatcgggagacagtcattgtgaatattggtcaggcagggtcagctgataaacgggcagacggttgttgtttgcatcatgtgctgctagcaaaaccagcaggtggattctgtcattcccagccagttagcagttcaggggctagtgtggaaagagttgccaggaataatttggggctgctgtggtcggttatttctaggagcagggaacacctggcagataggacctgtgggcatggctatggcctgtctcagatctgtccagggtctctgattaaccctcagggtgctccacagtgtaactcttttgacgggtctggcttcgtctctcattcctcaacattcatctcagaagatgggtctctttagttagatttcttgataatccctgcttcttcagtggtttgttcttatttctaattcctacctggaatgtcctgttctcccatctctcttttctacagaccacatagaagggcccagtgggagtacaaattccctgggaagactttgtaattttcaccctctctgatcttaacctttcacatttacttactgagtcacaaaactggcatctcatccagaagttctcaaaaaggcacctctgttatttaatgcctaattaactcagtacatgatgctgatattttgtgggtacactgccatcttctcaaatgcccttcctttagtttttgtcatactcccgtctgctgcttttccatctttttgttctttctcagtcggagaagaaagatcaatccccttctctgtgtatctttgtgtcatgttctaagatttatatcacaagcagtttctcttcggtatctctacactccaaatctcccagaacactactctgacatcctggctgcctcccgagtatgtgaactgatgtcacaggattttcaaacttaagagattttaaatcaaattcattctttgtggatcattgttaattatatcttccctgtatattctactcagatgcctaagtgagaaacctcggagtcaccttttggcttgtgtttcttccttgctacctcccacaggatactgttcggtctatttccaacatagctgtggaatcagtttccacctcttgactctgctgccattaccctagatcatattctctctgcccatgagcattcctgcttaaggggttgtctgcctccacttttgttctcctttaatttattcttgacactgtcacaaattattgttctgaaacacagataggatcacagtcctatcattcttagaaattttggtggcttcttgttgacaagagtggagcctgtctcttttggatgcaagtcttgccatagtctgctccagttttcatccctcatgctcacataggggatggtccagccatagtagtgaccacacagcttgtgaaagccttgtgggagcctggtcagatttcagtttctctgggaaaacttcattgagcccttagaaagaatcattcttttcttatggtactattagcactttgtacacacctttattgtggcatctattatgtaaattattatgtattaggaagatgatctatttgaggccagggactgtgtcttttgttaatctttgcatccaaaatgttaccacaatacctgaatcttggagatttgaggcataggtttctgtggaagtttatgaatcaatggatgtttatttccgattaaaatataaatccactgtgggcaagtattatgttttagacatcttttatccttacataatgctgatcacacatatagtaaggaataaatatttgctgactgatttttgataaggacgcaagcaagagaaagtggtaggagacagacttgtaggctaaaatattagatgtaaatggttcacaatggtgtgtagtagtgaataattgctgtattagattttgttataatatgctgactgtttttactgttctgatattaatggaagcacatgatttttaaaataaatcaattgctatgattttttgggaataattcatttaggctgaattaggtagtcaaattaaaaaacaaaaaataatttcagacctatcaaagagctatagtctcaggacattatatttgtgtgtgtctgtgtgtgtgtgaaaactttctaagagttgttttaatgtaatatataaaatgtaagtaaatcataggcttgctgacattagaaatttcataccatttaagtgaagagttaaaacaatctgactgcctggtgttgaggactgcttaggaaggggagatggttagtacattgagcatggttgactgatttatagtcacaggctaatattcagtttttagtgttcttttgtgagctttctatccatcttcatatctacattcagtatgtatatgcagatatgcacacatatttgtgtgtgtgtgtgtgtatcaagtttaactgcatgtttttctggtcaggagaagatgtgtttatttgtgtctactgcttctcctagatggattgcacctaacaaattgttgaacatgttgcaggtgctcaggagttacttctgacagcttcattatcatcgtatatctaactgaaatggtacctttagttccattcttgaaatttaaaaaaagcacccagagtcccacagcagttatgcaatttcacattttttttctgggacttagacctagcaaccacttataaaaatctgggtatgggagggacccccaaattggaggaggggacttgggagtagacttaaacctcttcattctcattgctctttatgctggctcttacatggctctgagaggagtatttctaaagcaccaatctgatggaaacacgcacccacacatttattatgtttttaattggttgcataactctgttagatgctaaggatataaagatgaataagacgtggtcccttcccttaaaacttcctctttaaggctcttttaaagtaatatttagaatttaagtgagtcagggcattcgtagaggagttaatcagtctgtatagtctgggtggtaagtgctacctatgatagaggcagatccagcatgctgtgggatcacagaagagggagctggtagctgagagcagactgggaggccagggtgggcttcctggagaaaggaatgcttgaaggtcattgtgagctcatcttccatagtggttccctctcatccttgggcaacattcctgagagggggcttacaaagccttttaccttccggcttctgccaccccagttttgagttttgagcaccagtgcacaccacatatgtgtgtgtacatatacatgcatgtacacaccacatgcacacacacgctcaccaagtgcttcagttaaagagcactgagcagatcatattagtaagctcttcaccttaggtgtttaacagctctgtcctctgtgcaccattgtacccctggcagatgtctattagaccatgagaacacatagtgtgcccagttgcatacatagccatttccttttgaagcgcagggctctggttctttgtatctttagagtctaagaagcagtggcagtggttggtacagagttggtgctcggagaatgaacagctgaatgaatgaatggatgaatgaatgaattaatgaatgaacgaatgaactgatgaaagtgtttataaactgcaaagctggatagagagcccattcccggtgaactctggtgatgccagttttacaccacctctgactgtcagggagaaaactttcctgaatcttccttttttttttctgtcttgagagggttggcgggaatctgtgcgcctggtgggcatctgcagttgatccagattgtcacaatcctcagtgttaagagaaagaccaaggatgaggtcaaggtcattagaaatagaaactttcacttttatttcccattgatgggaaagctcggcacactgaagtttaagaacagtttgaactgttaagccctttcagatatgtaatggtcatagacatctgctctctgcatcaattgtacttttctttgtaagtaccattttggtggttacactggccaaagtggcaactgttgttagctgcagatcctcagacacatggtaatttataaagactggttggcatgatccttatccaatgccatttatggcttattctgataagctaagaaattcaaagaggtaagtcggatatgcaaaaaaatttacatggattgtttacttaatgtagaattttcttttggggattatctatcatttatgcatttattcagttattcatttgctagagtgtaccacctccagcaattcaaaggcctttccaaagttaaagtaaaattgttgcaacctgcatgagtctcacaaaatagataaactgggaaagtgagagagagtgctcgatacacaaaatatgactttctggatgccatttgaagcaggaaccacaaagcgctcttcatgtttgcgtagagttagcctcactcactcgtgtacagaaatgtcagcctctcctaggtgtcctttgtgaccacaccataaaattgcacgtggtttcatcatctagttctaaaatgtgcagcttaaaatgtacttaagaacaatgtgtcatacatttaaatgtaaaattggactgtgtgaatattcttagaattgtattcataatgaagtcaattcaggcaggcacagtttcaatgatattatgagcttcatcttaatagctttttccaaaagttttctgatataggtttgccatgttccatttaaacccagctgtggaattcattattgtgtgctaaattcatttggccactgactttttgaaaaggagaaaatcaggttttttatacacacatacccatataagagtatacactttaatcagtctttttttcttaaaagttcagctatttgctgaaaaaggaaatatactgcttaaaaaaggaaaatatattcaaataagcaaatatgattggaaataataatggctttaataatagaactttgtaacttcgctgtttaaacagttattcaattcttgtttttattttgtattgtagcgtattctattgccttatggatatgctattgttatatctgtagctcaactttttagtatgttcttatttttaacgagaaataatatacataagctttaggaacatctaaggaaaacagatggtttttcactttctttaccctgaaattaaaccccttgcttttaacttttgagctaagaataaaaacaaagttacagatgttctcatactgtgtattagtgcatgttatacccatatcccacattaacatttttatttccactgagatttctgatataatcaggtattaaacctgtggttattttggcaattatgccttttacagaaggattccaacagctaaaccctaagttaggaaaaaagaatataatttgacttcatctggaaaaaaattatcctaaaagatggttagaacattcagtaatagtttgcagtttttaaagaaaagctcacaggtaaagttcttgactgttctttcattaagcaaaaaacatgaagcttttttctttctccaaagtctcttcaaggcgcccgctagactcaaactcatcacaccttatattccatgcctgagtttccctttgtaaattaatggctctcttctctcttgttcctccaaagtttaatttgtacactgccctacagttgtgatttattgtaaagaatattctgtctttttctcaccttttccccagatgagctcaaagttactcaccctcatttgcccctgccatctctccacccagacctactatttccatttttaactttcgaatttgcttcttctcatccatgacttcagaagcagcctaaaagttcaaagtaacatagctttcccctatgactcttaaaacatgtgttcagatttggtctagttggtgtacttagcagttgagtgccttaacagtggtgatgcttcctccaaggttctgtagataatgatgggcgtaatgaaaggcatcatggagggagaaacttgggccttacccctggctcaaacacttcctgcctatgccgccttaggcatgttatttaaacttcaagttccttatccataaagtaggctaaaaatatccacttcacaggtaattgtgaggcaaggacttagcacgtagtagacatcctgaaaacaaaaacaaaactaggttgctttccctgtcctagctccatatggagtgctgtatgtaacctgaccatgttgtgtgtgatgagctttgggggaagtggatatgaaacagtgtcgtctcctctctgtagcaacatctaaattgtctgtcatgtggtactgttagggtacagagaataagtgtaaaaacttcagagatgtggaagacttctggggaggtggccatcacgttgtgtcttgaagggaaaaacatggctgtgaggagattgtatgagtgcagaggtgagaaggagctctggggacagagaagaggaggacaggcaagtgagcagacatcacgagtccctttggggttgaggggtctagttgcagagctgtgggacgtgttgttaaggctgaagtgaggccaaattctgacggtcttagaagttgggcagaggagtttagttatgacacagaacataacaaggagctaaaactcaggtaatcaaggtgccctcttaagtgaattatcctttaggatgatgaagagagaaggtctgtaccccttttgttttctccagtgtggatgatatggcttggctctgtgtccccacccaaatctcttctaaaattgtcatccccacgaggtgagtggatcataggggcagttcctgcatgctgttctcatgatagtgagggagttctaatgagatcttatcatttaaaagtgaccatttcccctgcatgtgctctcgctcgctcgctcactctctcgctcgctcgctcactctctcgctcgctcgctcgctctctcgctcactctctcgctcgctcgctcactctctcgctctcgctctctgtctctctcgctctctgtctctctcctgccgccatgtaagatgtgacttgcttccccttcgctttctgccgtgattgtaagttttctgaggcctccccagctgtgcagacctctgagtaaattaaacctcttttcttctttataaattacctagtctcaggcagttctttatagcagtatgaaaacagactaatgtagtagtgaagtggtttttcagctttctgactgtgacccatacataatatgataaaaatttacatcctgatccagaatactcacatatactgtatttgtttcatgaaataaaaattttgtgaaatgacagttacccttccagggctgactgcataatttgtggggtccagagcaaaatgaagatgtaggacctcatgttcaaaaagtagggaagaatgctgctaaaagtagttacatatgtctttttccatttcttctctgcttcttgacctgtcatggatttgtttttttgttgttgttaatttgtttgctacttactgtcattctgagtaaataaaaattaaaaatgtccattattaatactaattttactatttttattgtgcaatgccaattttaagtgcaaaacataagagcatgaaattaatgaaattacacaattggtatttcttattttgtacctgcatatgcatcttgttcttattagaagaatggaaatactgtacaaagctaactcagctgtttttattttacttcttgataggtatacattctaccaaccctctttaccttaggcttactgttgagtaaggactgaagaaaaggagcgatgggtagccttatatttcactttccttctcttttgtcattttcagtgtaagaggttggctgatataattaagaaagaacaggacagaattatccttggtcatctttatttcttagaatgccattgtctcctttcctcctcggaagcaagttctggttttgatagaaagtgtggcctctaggggctgtgagcaccctctgtactccttcaccccttgttcagatgctgacctaacacgcttgcttggtaaccacaaacacacacatattgcacccatgtcttctcatgagcctgctccagtttttcattgaacttcacttacaaagcacacaagttcaaggataaaatgattaagaattttaacgtggttggtgatagtggagcattaaatcaatgggtagggcccttcagagcagggccctgtgtgactgcacaggtcgtatacccacacagccaacccgggtactgcatttgattttctgttgtcttctattttattaaaaataaccccactagttgcaccccgttaaactgatgttaccatctactaatgggtcatggttggcagattagaaaacactggtaaattcatgaaacgcatggactgtgtgtcaggctgctgtattagagtcctgcttctaccacttgctgcctgtgaacttgaaaatatctccgtttctcgtgtaaaatgcaggttctagtagttcataaagttgttatgggaactaaattattaaatacatgtaatatgcttaaagtggtgttcattatgtaataaatatcctctaagtattaatcatcatcatcattattgacttatatcttgctgtaggtaaatgttgaataaaaaaatgtttcttgactatatcagcattcccacttatcctaaaacagatattttcttaagtttaccaacatctgtgttttcttgtgtctggaagtatataaaatataacaacaaaataaaagttaattcaactgcacttaatacaatggaaatattttaaaaattatagttcaataagaaatccaataaaagactacttttatttctgttcctcctcccagattaaaacaagtagatcattagtatttcatacttatcagttaagaaagaagcaaggatatctggaagataccatctgttgaacttaagaagccagaattattccttttcaaatgaaattatttgatgaaccccaatcataggttaaaatgcttgagaggaatattttctatcttttctttttttccccaaaggtttatttttatttatttttaaaataggccggatgcagtagctcaggccttaatcccggcactttgggaggttgaggtaagcagattactcgagcccaggagttcaggaccagcctgggcaatgtagggagacctcatctctacaaaaagcaaaagaaattagtcaggtgtgatgatgcatgcccgtagtcccagctattcaggaggctgaggtgggaggatggaggcaggaggtcaagactgcagtgagctatgactgtgccactgcactcaagccctggtgacagagtgagaccctgtatcagaaaaaaagcaaaacaaaactgacagataaaatggtatgtattttatcttttctaaaatacagcatacatacatttttattatagatagagaacaaatctacaagtcatgacatgaaaagaacacagaatctggtggatgctcagtcaatatctgttgttggagcaaccttaatccaagtgaaaaaaatgctggctggtttgttttgatctattttgaatcttcttccttgataattttgtaataaatagtactattttatggctcatttgaatatttcctatcattaattgaggctactgagatctcttttcccattgatttgatatttcatgtttgattctctcaaattgggcactaaattaacatatagtcattttgtatctgagtacaaaagttgtgtttgtgtcaattgctgatatatgggcatatttgtgttaggtcatcatcttaaaatggagtccaatagaattgcttaaaagggcttatgttaggctgtttaaataaaatttggaacatgatagatattgcagggaaatgtatcttacggaaaatttgtttttatctgccttttattggcagcagttccttgaattgcagactttatgcatagtcagaacagatatgctaaactgagtacattataacttctattttatgttaagatggaagattaaccaccagttaaagttattatatcttgagcaaggtatcgactctgataaaaatttatcatcctcttcaaacattactatggagcaaatataaacaccttaaatgctaagattcaagagatctcactttgtttaaagcaagtcaaagcacattaatctgtaaaattctagaacagttaaattgaaaacaccctcactcagatttaatgagcaattcaggcctattacctgtgccaatttagattaggtgaaaaaaatccaatccctttattcaggatgactgatttgcactgatttgcacatttacaccgtaaaccactttaccttgagtgagaaccacagtttacagaatcactagcacttgtctgagagttagattggctttgaaagtggttgatacttgctttatacttatagtagaaacatattattggtagtagttgaaagtgaatgttggagccttggattattagagatgttactcggtaataattgggatcaataacttttgaaaacacatatccagtccattttgattttcatatttgagctaggtatttaatcctttaagtatatatttatatataatttggaagtaaatatttagagaatgatttcagtcttctatcttaggtttatcaactgaagatagatttagaaaattcacaatcctgatttctctttggctattttttttttaagattctttgtatgaatttttaggaagccttctgaagctaaggagttttttatgtctctgtctgaaatgattgttagtgattatagtaaattgaatgctttcattcaggcgtgcaagtagaaggtatcttgttgcctggatgtgtgctgccctgcaggtttctcactttcttctacttcctcgcagcccctgacctcctgcaatggatttctatgttgtaacttgttttggtattttagctaaggttcaaactctaataaatatctgcatagcaagaatggtatattcatgaagtacaattctggttacattgatattgtcaaatgaagatgatctctatcggtttaacttggccatgagtgaatgggaattgtttaaatttctgtacaaatgtttgcatttcatgagacatgcttgtgcattagagacagaggtttagcaaaagctttatggtgctgacatctgtgataaaggcaggagtcagaagagatgggatttaatcccctttcatccctgactgtcttgatggcctcaggcctctgaattaggttgacaagactatggtctctctttacttcacagccaatcatcttgaaagagtcgtctgtactgcttgtcttcactaattcacctcttttcttataccacaaccccgtgtaatctgattttcatactgtactataattactgttacttaggtgaccagatcaaggggatccccaaatggcgggacactttaatactgattattcctttggtgttgacttccactttcccgcatcttccttgacagcctactcttttttttttcctgttaccttttactatttcttttcgatctttgtgagtttctcttctgcccatcccttaaatgttgtttcctagaactctgtccctaaccattttctattttcaccccaagttctgaaacccatgactttatcaatggtattctgactgttcccaagtctacatctttatcttggaactttattctaattaacagacttacatttctagccacttgctggacatttctatcagtatgcttaacaggaggcccaaaccaatatatcaaaatcagaccccatcacctcctttctaaccacccccatccccttccttctgtcgtctggccagtcttgatgaataacactgttaaccatgtagacaaccaagccataaacctgagagtccttcttcagctcttctgtttccctcaactctcacatcctggcagtcacggagtcctgccaatacaagtattcaatgtctcttgttgcattctgttaatcctggcattgccttcatccaggacctgcggtgtgcagagcagtgctgagattccaccaagcagtgccgccccctcagccgggagtggtgctgatgcagactcctatgcttcggagcgtcctgacccatcatggcatgctttgtttcccatttcattgctttgaaatctcctggctaccagcctcactgatctccaattttaatatgtattgcctttggtggcttcagtctgacccagtttcaggcattcttttctacagtcttgcctggtctcactctgccatgatatctccacctcagcaatatcagtcctaggtggctgtgggtgataacactttccatgatctccccctccacacagcctgtcatgaatcttcacctgcttctgtccaggcaactctgtttccaggacgctccctcagccccatgcaccccactccatgcttaaagtcccttagttgctcttcattatcttcatgatcaagttcaaattcttggtcacatcagacagccttatacccagccactccttatccctacagccttgctgcagccacacggatctgcctgcagttcttggaatacaacctgcaatgcctccaagcctttgcatatgctgattcttctgtccagagtgccttcctttgctccttaatgactaatttgtcttgtcttttgatttgtagcttccgtctctcacagccttctttgttctcctctccccattttttttctttcctactttatgcactgtcttaacagcttacatagacttgcatgctatgcgtattctgtgcagttgatttttccatgtgaccccccggtagataatacgtatcctgaggtcagtgccttgttcatctttctgtggctggtgtctagcacatgtgggagcatgaggaagctcagtaaacgttgcataataaggaagtagtgaacacagaattttaaaggaatttaaaacagtactatgtgtttttgttacaggcagatacttcatttgttatgatgataaatctagagtatagaagtatggctaactcttctgatacaaggtcatttggaggaagttggactaaccagaattaagaagagaaattgtcaattttaggccaaataagtaactgcaagtcactggggtggaaaaaggaacaattcaattattctgatgaactaaaactaatttgcagtgtaatttttataaggatgcaaaattagaaatgaagaattaaagctatatatacacttgttggtttaggtaaacctactcagaggtacttaattattttcagtcccacttatcagatatagactttagaaattgtatcataatttatataggttaggaaataagcattaattatacatattgtaaataatgtgctttattctttgtactctgaatatttctgattttcatgagaatctgaaatatctgtatctaaaaataacagaagtgtaggaataagaacaaaattacctgtgatctgggaaatcaatgataataatcctacttttgttttctgtctacacttagaatattttgctacacctatttaaagttaaggttaaataactgtggtgattaaaatcaattctatgcaaacagttaatagtcaaatgtatacatcaattgcataacagatgagatttaataccctgaaatgggagttggagaatagaaagaagccaaatatttcaaactacagttaagaatacttagcccatataaatgtgcggataaaattatttttatgtgttattaaaaattgccagagaaaaatatgacttgtgatattcttgtttctgtaaagagcttccatttgagctgatgggacataataagacatgtggagaagattagtgattaaaaaaatttggacatttgggttgtatcattgtattcaattagaggcactcagaacattagctctcatttgattagtttttcagtcttccttatgatgatttttttatatttaatccagaaaggtgatgcaaagaggggtattatataagttgtgacagggatcccaggagagttggctaataccctttcataaggaagtgttattacatgtgaacctgcccttcctctctacctcattacttgctaagcttcataaagaccctatcctactgggtcacctttctggaaatgctttctttaattttcaacaagatgctgtgatgacaacaatctatatctgtaaaaagttgtataaaaattcaatatatttcacatgtgaatgtagttcacatcagactaagctaatgaaaattatttttatatcaccttcttaccaattttaattttaattttgcctctggtgactgaggtgacacataaagagtattgccttataaatggattgacttttttttcttcttaggatattattttatatattgaatgtcataaactccttgttccccacattttttgccagtaccatgctggttttaaagagctacttttaaaaattaacactttgttttaaagttcattcaacatttttattatgataggcagtcttagtgataaatcgtagtaaaagagcttctagttaatagataactaagatttttataaagtatttagaactggacattatgatattagttttcttcttattcatcctcataaatctcaatcagtttcaaacactaaatatattaaaatatggattatgataccatttaagaatagtttttagtaattttggtgagaaagcaagaatggtaggcttaaattctgattatctttacttgaaagtatcattaattattgggtaacttttaaaatttgagaatgttaaataattgtaatattgttaaactgaagtactgataaattgaaacaaggaaatgctttcatttcagctgtcctagttgcagaaaagctaaaaacacacaaagcatttatttcatgtttcagtaggggaagcagattcctatttattatgaacagtacagtggtgatatgacttccctacctcagcagctctgctttcattttgtaagcaataaaattcataagggataagtgaaaaataattgaggagcacttttatttttactagagtgtttgttatggctttaccgtgtaatatacactaaaatgtctgttcacgttcaaagaaaaaaagatgagagctgaatttgggtgtagtgtgcattcaagcattgaatttgatccttcacgtagtaattgaatgagagcagtattgtgtatcaaatttatccttgctttttagtttgttagcaaatggcttttactacaaaggtttttagggcagggtaagacttaaaaaaatagaatcactttcctctggaagatgtgtgggtgtctggggttggtggtagtgttttgcacctggtaggagaatgagaaagagaagtatttacagttagggaaagaaaacaaaaggcaggaggctcaaaggagggttttctgaccactgtctttttggcaggaggagcagagggtatctgaaaggcctgtttttgcccagcaggtatctgcaggactcagaaagtggatctgtggtggccactgcagatgttctttccagaagaacgcttcccaacatttattgcaccagggaccagttttgtggaaggcagtttattcaggggcgtcgggggatggttccaggatgaaactgttccacctcagatcatgagacattagttagactctcgtaaggagcgtgcaccctagatcccttgcatgtgcagttcacaatacggtttgtgctcctatgagaatctaatgctgctgctgatctgatgggagggtggagctcaggtggcaattctcactcacctgccgctcacctcctgctgtacagcccagttcctaacaggccacagaccacttccagtccgtggccctgggagttggggacccctcctcatgcacataatttctagacacatgttgtatcattttcctatggctgttgtgacaaatcaccgcaaacatggtgccttaaaacaacacagatttattatcttacagttctggaggtcagaattccaaaatgggccttactgggttacaaccaagctgtcatcaggtctgtgttccttctggaggctctaggcaaggattcatgtccatggtttttccagtttctacaggctgcctgcattccttgacttgtggcctttccatcttcaaagccagcaagggtggctcaagtcttgtttgcactgtatcagtcccactctgggcctccttcctctttttcactcacaaggacccttgtgattatattgagttcacatgaataagccacaattctcttcccatctcaaggtcagctgcttagcaaccttaattccatctgcaaccgtaattcctctttgccatgtcatgtaacatgctcacagtttcttacgatcaggatgtggacatcttgggggtggggggcattattctacctaccaccaataacgtaatttgttgatccctttgtaggttgtacctcaatctgtcttctttctcgtcagttccctttgttctcctctctaccctccatccaaatgctatactgccaagtgtagccagattggggcaacaccctgtaagaacatgaagaattaatgcactgggctagtggctaagttgttggctccttacattctacttcaatacagcaaatatgttttagtgctggggatggaacagtgaaaaatacggacaaactgcctgatctcttggagcttacactttggtggaaactgacaaacacagtaagtgcaaggcagagaattaaaccagggcactatgaatgaatgagtggctactggaattggaacaaggagggtttcctgagatctggctgacggtgtgaaaatggggaaagaactttttaggcagagactctgtgaagaacaaagccatgaggcaggagagagttttctagtgagaaacagaatgaaggtcagtggagcttgagtttaatgtgcaaggaaaaagatacgaaatgcagtttgaggaggagttaagtgccagatcacatctctgtaagccatagtaaggaacttggattgtatatgtgatggaacaatgttggagagtttctaagctgtggaattaaacactttttaaatgatctattaagagcacttggctattgtatggaggatgattatgagctagcaagagtggaagaagagggacactagtttgtaagctgttttaacagcccatccaacagataatggtgatgagaccaagttgggagtggagatagaaataaatgaatatatttgagatacattttaaaaggagattgaattgagaagattgacaatggaatggatatagaaactgaggccaggaggaaataaagataattcccagattttgggattgagaagtggtgccatttcctgggttggggaatctgggggatgagcagtttagggtggggaaccagagttgtgttttgaccatgttaaggttgaggtgcctattggacatccaaggtgaagtgtcaagttagacagttagatagatatatatgttttgggatctataaagaggtcgaggctgaatatacgtattagagaatcactggcacattgatggtactcaaatgagattaatctagaaagtgtgtagatagagaacctgatccacaatgcagctctgaggtgggccaatatttagaagttgaacagaggaggatggattggccaaggagacttaggagaaacttctggtaaaaccaggagggtgaagacagacaggcaggcaggcagacagacagacagacagacacacacacacacacacacacacacacaccctgatactgctgcattaaaagctgctaaaagatcaagtaaatgagataataaatattgtaatgatggtcattgataattttgacaagaataatctctctggggtgctgttatagaagatagattagaaagagctggggaaagtgtgggggtgaggatgagaccgtgactctagacagctaagcaccaggtgctctgcattctgagatgatgcgccatcccattattacttttcccaagagctcacttttactacctagagaagagttacttttatatgatacacaggcattctgttattatacttgctgtgcccaattagttttagaggaagcaaaattgctaaaactcaagacgtttcatgagcagttgaaaattatactaatgctcagtaaaaggggactcagaactcctgaatgtgtgcagaactattattggcacactaaaaagttcacaggtgggcagtgtgtggcaaaaaggatcacttacctgttgacattagtatgtagtaacactaagttcctgtttttatgaaaatcccaagtgacactaaaactgcttctgtgtctcattggggacaaaacacctcagccctagttgtcactcacccttcatgagtcgtggtagaatagctgatgttgctgtagcaataactagacaaccatggcacataataacgctgtcatggtctaaatccacaaatttactgtgcaagtttaaattagtagtaataaagggaatatggtaaggttttgaagtgctcaaataatgttgcccttgataaaaagggtaatacttttggaaatttctcatggaatctatacttgcaagcaggtgttttaaattttcaatgttttatctttgactttgtccatgaaatgtgtcttcagttgctttttacgatggcatcgacagaggggaaacatattcttattatatcattcggattcttttccattgtattttggccttgttggcaattctttggcatcaaatgattttaattttctaatttaaggcctaatttacttttgaacactcacattggcccacggatcttggccctggatgaagtgtatatgaatacagattgtattacaaataatacttgcagacaatgccaaaaatttggtgtttatataatgctttgtattgttagttcagtttaaagaacatgtcaaaacctgttaggaggctgacattgtgctaggcacaggacaaaaattgtggtctatgcctaaaggagcttgtggtctagcagggaagggggcagaattggtaaaagaaattgattaaagtaagtgtgatcatgaataaacgcagtatgtgggaggaaaaagtagtgcagaggggctgagcacagtggctcatgcctgtaatcccagcactttgggaggctgaggagggtggatcacctgaggttggagttcgagaccagcctaaccaccatggagaaacgcttgtctctactaaaaatacaaaattagccaggtgtggtggcacatgcctgtaatcccagctacttgggaggctgaggcaggagaatggtgtgaacctgggaggcggagcttgcggtgagcggagattgcgccactgcactccagcctgggcaacagagtgagactccatctcaaaaaaaaaaaaaaaaaaaaaaaaagtagcacagaggagggagctgttggttctgttttgttgtggggttacaggataagatcagaggagattttcatgaaacattgacagctgagtaagatttgagccatgagtaagtctgctgttgggccaccacccagggacagggtagaagtggcaaactagacatggaaggcatagggtgagacatgaaaaagcatagcgggtccgtgacctgcaggttctttggtcctaactgcacatgggctgtgactgaaatcgctccatttgatgaaaatgatcgaaatcaaggtgaaattgaggggatgtcaatggagttgaagagtcagggtatttaagggtgtagagtggctcatcacatggtgttgaagttactcagatggtgacatacagggttggttagatttcctttaaaatgaagtagaagaagcattcaaagaagaggccaaggattcttttgaattaattgtatcaaaatcaggatgcccatgagataattttggaagagagaatttaatactgagcagggtgggtgaggacacgtgggtgtagggggtgtatacagcaggaggggaatcaacgtgtgagaaagagattaaaccggggcttgtcttttgtcttacatctaataaatattaactgaggacttactctttgcagtgcaccatgcttattcttggaaaacaaactcctaagataggaaaggagctacagggtatgaatgtggaagagtaaacatcgcatgtctctgtgatggtctccatgggatacaaaaccctcaccagcagcgctttcatattttccagagtgactattatgcagtagatcttagtgcatatttacccatcaatcagatgaatagtatctattcattaaaaattcctattttgcactattcattattgtccattaattaaagcatggtactgcaacatgcagctatttattatgttttcaagtaacatttagtgacatgagaaatgctcatgatatggttttaaagaaatgattttaaaaattatatgtacaataagatcccagttttacgagtgcatgtgtctgtgtgtgtgtgtgtgtgagagagagagagagagagagagagagagagagaaagatagatggagtgagggagggaaggaaagaattgtcaaaatattagtgatggctgtctctgggtcatgagattaaacatatttattttttcaccttccaagttttctaaaatgcatataaacaatttataatcaaaaatactatttaaaatagttttctcgaaaaattaatattctgcctttaattttatataatgtttatggtaaaaatgaaaattctagtaggcctatcacaaaggcctttctagctgttctgcctttttttgatcactgtttattcttacgaattcctttctgatcttcatttcttgctctgtgctgttaatggcaatggcttaaacattttggttcactgataaacacatcctccctccacacctgaggcaaccatttaaaaaaagtatttatattctctttgtgtcactgtgcacagcgttgagctttgctgatttgtctctttgctgtttatatccttatggttgtcattttccattccagtgccctttcaattttattttatttgttgttatcgattgtattcttcttttctggtaaaatgcttattctaaaacacatctgcaaaccattcgtagctccgcttggatacagttaaacatttcattgaatgtgagtattaagactgtattccttttgtatctataggcctgcctttgtagtctcttagtaagcaagtgcaacatttggacacaaaatgtcatccaaaaagtcatgtgcataggtcataactgtagtctactgagtttagcatctgactatgatggttgtttttcaaggtaatttcagaaggtagaaatgaatgtcaaacatacctatttttcttcactcttttcctcccttcctgtttccatccttccttctttccttcattccttcctcactgggctgtatattttcagcttccataatactctgctattgcccttcctcatcattcaccttattggaagtatgtttatctctgtctcctcattggactggaagcaacttgagagaacagtccacatttcattcatatcttaggctgtctcctgggttcacatcctgccttgcatataattggtcctcaacaagtgtaaaaatatattttacatttaattaagagtgacttcatagctttagcaatacgaaagattattagataaaataggttaaataattatgctctgggaaataagcttccattagagaaataaagggggttttaaggcaaaagataaaaatatattttctagactgtaggggtaatcaaatattgtaatagattaccagagaaggaggtaaaatcgccatccctggagagccttaaaaattggacagagaaaacatctgtgagaatggccaaagcactaaacctgtcttgaggcaagtagatagacagaatgacaaatggttctgcaattctttgattacttggcctgaagaagagaaggctgaggggagacattaaaactacttcaaatatgaaaaacagctattattgctttccagaggaaagcaagttgaaggagcttaacctaaagtcagagattgagtttacatttgatagttaaggatttaaagtcataggttgtgaaaatcttgtggagatctgcagaataaatgatactgattttttggtgagatatggaaagtcaactctatgatttggctgcagtaaaaacattttttataatactctgaatagagagaattattccaatacattatattgaatgcatagcattctcttgggaaaggtaaatttctaaaagtagtattttaaagcagcaagcattttcactgttttgtgaataggaggggagaactgggatgatacttgtgaatttcttctcatctcaatgcctgtacaaagggctatgttagtaaatcagtagccaaagggtgaacaggagcttcgacagaactttaccctgctgggtcagccttgttttgaccactgaatgttttctcaatgaaaatgtggaacaactgggggtggtgtggtggtcggaggagggggtgcacaaaaatactatcaactaaaaagggaatccaaatgtctattaaaaataagcatttgattgtaattccagcattcagccacacgatgtcacaattggattttgattttcactgtgtgtttgtctcaatagatgaaggcattttcaaagctggagcagagaggtctgaaacacggggggcagcagaagtccaagaagatgaagatactcaggttgaggttccagtcgatcaggtaatctccatgccttaaaaaatatgtgtaagacaattatagtgttttttttccaagttttgtgttatctcctacaaattgttcctatacctgtatgaattaaaccctctaaggtactatgtggctgatcaaccttaaaaacataacaaaacaccattctttctcctagtattcctgtgaagaatagccatttagaccaagtctttttaaataacagcaaatggtatttccttaataaagagcattgaagagcaagatgggatgggattaggtatgagataaagtgataaagtttgatataaaaaagagtattggtttgggattttcatctggaataaaagtacttacccacttagaaaagcatttttaaaaaattatactttaagttctggcatacatgtgcagaacgtgcaggtttgttacagaggtgccatggtggtttgctgcactcatcaacccatcatttacattaggcatttctcctaatgctgtccctcccctagctccccaaaccctgacaggccccagtgtatgatgttcacctctctgtgtccatgtgttttcattgttcagctcccacttatgagtgagaatgtgtagtgtttggttttctgttcctgtgttagtttgctgagaatgatggtttccagcttcattcatgtccctgcaaaagacacgaacacatccttttttatggctgcatagtattccgtggtgtatatgttccatattttctttatccagtctatcattgatgggcatttgggttggttccaagtctttgctattgtgaatagcgctgcagtacacataagtgtgcatgtgtctttatagtagattggtttactatccttcaggtatatacccagtaatgagattgctgggtcaaagggtatttctggctctagatccttgaggtatcgccacattgtcttccacaatgttgaactaatttacactcccaccaacagtgtaaaagtgttgctatttctccacatcctctccagcatctgttgcctcctgacttattaatgattgccattctaagtggcatgagatggtatcgcattgtagttttgatttacatttttctaatgaccagtgatgatgagcgttttttcttatgtttgttggctgcataagtgtcttcttttgagaagtgtctgctcatatcctttgcccactttttgatgggtttgtttgttttttttcttgtaaatttttttaagttccttgtagattctgaatattagccctgtcagatgaatagattgcaaaaatcttctcccattctgtaggttgcctgttcactctgatgatagtttcttttgctgtgcagaagctcttcagtttaattagatcccatttgtcaatttcggcttttgttgccattgcttttggtgttttattcatatgaagtcttttcccatgcctatgtcctgaatggtattgcctaggttttcttctagggtttttatggttttaggtcttacatttaagtctttcatccatcttaagttaatttttctataagatgtaagaaaggggtccagttccagttttctgcatgtggctagccagttttcccaacgccatttattacatagggaatcctttccccattgcttgtttttgtcaggtttgtcaaagatcagatggttgtagatgtgcgatgttatttctgagaactctgtgctgttcagttggtctatatatctgttttggtaccagcatcatgctgttttggttactgtagccttgtagtatagtttgaagtcaggtagcatgatgcctccagctttgttccttttgcttagaattgtcttggctatatgggctcttttttggtcccatatgaactttaaagtagttttttccaattttgtgaagaaagtcaatggtagcttgatggggatagcattgaatctataccttactttgggcagtatggccattttcacaatatcaattcttcctatccacaagaatggaatgtttttccatttgtttgtgtcctctcttatttgcttgggcagtggtttgtccttccccttgaagagggccttcacatctcttgtaagttgtattcctaggtattttattctctttgtagcaattgtgaatgggagttcactcatgatttggctctctgtttgtctattactggtgtataggaatgcttgtgatttttgcacactgattttgtatcctgagactttgctgaagttacttatcagcttaaggagattttgggctgagatcttggagttttctagatatacaatcatgtcatccacaaagacagacaatttgacttcctctcttcctatttctatttgaataccctttctttctcttgcctgattgccctggccagaacttctaatactatgttaaataggagtgattagagatggcatccttgatctgtgccagttttcaaagggaatgcttccagcttttgcccattcagtatgatattggctgtgggtttgtcataaatagctcttactattttgagatatattccatcaataccttatttattgagaatttttagcatgaaagagtgttgaattttatcaaaggccttttctgcatctattgagataatcatgtggtttttgtcattggttctgtttatgtgatggattacgtttattgatttgtgtatgttgaaccaggcttccatcccagggatgaagccgacttgatcgtggctgataagctttttgatgtgcttctggattcggtttgccagtattttattgaggattttggtgtcaatattcatcaggtatattggcctgaaatgttcttctgttgtgtctctgccaggttttggtatcaggatgatgctggcctcataaaatgaattagggaggagtccttctttttctattgtttggaatagcttcagaaggaatggtaccagctcctttttatatgtctggtagaattcagctgtgaatctgcctggttctgggctttttttttggctggcaggctattactgcctcaatttcagaatttatcatcggtctattcagggatttggcttcctggtttagtcttgggagggtgtatgtgtccatgaatttatccatttcttctagattttctagtttatttgcatagaggtgttcatagtattctctgatggtaatttgtatttctgtgggatcagtggtgatctcccctttatctatttttattgcatctatttgattcttctctcttattagtctggctagtggtctattttgttaatcttttcaaaaaaccagctcctggatgcattgattttttgaagggtttttcgtgtctctatctacttcagttctgcttggatcttagttatttcttgtcttctgctagcttttgaatctgtttgctcttgcttctctagttcttttaattgtgatgttaggatatagattttagatcttttctgctttctcctgtgggcatttagtgctacaaatttccctctaaacactgctttagctgtgtctcagagattctggtacattgtgtgtttgttctcattggtttcaaattgcttatttatttctgccttcatttcgttatgtaccagtagtcattcaggagcaggttgttcagtttccatgtacttgtgtggtttttcatgagtttcttaattctgagttctaatttgattgtactatggtgtgagagactgttgattatgatttccattattttgcatttgctgaggagtgttttacttccaattaagtggtcaattttagaataagtgtgatgtggtgctgagaagaatgtatattctgttgatttggggtggtggattctgttgatgtctattaggtctgcttggttgagctgagttcaagtcctgaatatccttgttaatgttctgtctcgttgatctgtcttatattgatagcggggtgttaaagtctcccactaattttgtgtgggagtctaagtctttttgtgggtccctaaaaacttgctttatgaatcttggtgctcctgtattgggttcatatatatttaggatagctgttcttgttgaattgatccctttacaattatgtaatggccttctttgtcttttttgttctttgttggcttaaagtctattttatcagagactaggattgcaacccctggtttttttttttctttttttctttccatttgcttggtaaatattcctccatccctttattttgagcctatgtgtgtctttgcacatgagatgagtctcctgaatacagcacaccgatgggtcttgactctttatccaattggcagtctgtgtcttttaattggggcgtttagcccgtttacatttaaggttaatattgttatgtgtgaatttgatcctgtcattatgatgctagctggttattttgcccgttagtttcttcttagtgtcgatggtctttacaatttggtatgtttttcagtggctggtactggtttttctttcccatatttagtgcttccttcaggacctcttgtaaggcaggcttggtggtgacaaaagtctctcaggatttactcgcctgtaaaggattttatttctccttcgcttatgaagcttagtttgcctggatatgaaaatctgggttgaaaattcttttctttaagaatgttgaatattggcccccactcttctggcttgtagggtttctgcagagagattcactgctggtctgatggacttcccgttgtggatcaccccacctttctctctggctgcccttaacattttttccttcatttcaaccttggtgaatctgacaattatgtgtcttggggttactcttcttgaggatcatctttgtggtgttctctgtatttcctgaatttgaatgttggcttgccttgctagtttggggaggttctgctggataacatcctgaagagtgttttctaacttggtttcattctccctatcacttttagggactccaatcagttgtaggtttggtcttttcacatagtcccatattttctggaggctttgttccttttcattattttttctctaatcttgtcttcacgctttatttcagtaagttgaccttcaatctctgatatcctttcttccacttgatcatttcagctattgatacttgcgtatgtttcacgaagttcttttgctgtgtttttcagctccatcaggtcatttatgttcttatccaaactggctattctagttagcaattcctctaaccttttttcaagcttattagcttccttgcattgggttagaacatgctcctttagcttggaggagtttgttattacccaccttctgaagcctgcttctgtcaattcatcaaactcattctccatccagttttgttcccttgctggtgaggagttgtgatcctttggaggagaaaaggctttctggtttttggaattttcagccttttttactggtttattgtcatctttgtggatttatctacctttggtctttgatgttgctgaccttctgatggggtttttgtgtggatgtcctttttgttggtgttgatgttattcctttctgtttgttagtttttcttgtaacagtcaggcccctctgctgcaggtctgctggagtttgctggaggtccaccccagactctgtttgcctgggtatcaccagcagaggctgcagaacagcaaagattgctgcctgttccttcctctggaagctttgtcccaaaggggcacccaccagatgccaaccagagctctcctgttatgaggtgtctgttgacccatcctgtgaattttctcccagtcaggaggcacaggggtcagggacccacttcaggaggcagtccatcccttagcagagctcgagcgctgttctgggagatccactgctctcttcagagccagcaggcaggaatgtttaagtctgctgaagttgtgcccacagccgctgcttcccgcaggtgctctgtcccagggagatgggagttttatctatgagcccctgactggagctgctgcctctctttctgagatgccctacccagagaggaggaatctagagaggcagtctggctccagtggctttgaggagctacagtgggctccacccagttcgaagctccccgtggcttcgtttacactgtgaggggaaaaccacctactcaagccttagtaatggcagacatccctccccccaccaagcttgagtgtcccaggtcgacttcagactgctgtgcttgcagtgagaatttcaagccagtagatcttagcttgctggggctccatgggggtgggatccactgagctagaccacttggctccctggcttcagccccctttccaggggagtgaacggttcattctcactggcattccaggcaccactggggtatgaaaaaaaaaaaactgtagctagcttggtgtctgcccaaaatggctgcccagttttgtgcttgaaacccagggccttggtggtgtaggcacctgagggaatctcctggtctgcgggtcacaaagactgtggggaaaatgtagcatccgggctggaatgcaccattcctcgtgacacagtccctcagggcttcccttggctaggggagtgagttccccaaccccttgtgcttcctgagtgaggcagtgccccccaccctgcttcagctcgccttctgtgggctgcacccactgtctaaccagtcccaatgagatgagccgggtacctcagttgggaatgcagaaatcactggccttctgtgttgatctcactgggagctgcaaaccagagctgttcctatttggccatcttcagaaaagcatttttttaaaatgccagtatattcttgcctttagggtccttgagattgttttggttggaatttgtttttcataaaggaattgcctgtataaatgtaagtcaaatatttgctttgtgtgtattgattttctttcttaggccagtagaacactgtacttctaggagttgtgtgtgtgtgtgagtatatacgtactcacatgtgcttatagaatggactaagtagtgttaattttctctaaatgatggaagaaataaaagtcagctatgctttttaatataatacatcaagcttccttacaattctaagtggaggattggagtttaggtgaggagggggaaatgataatcccagactcaggaaaggggagaagtcactaggaactaccacttgtcctctgactactatatgatattttttttctaaaagcagatttcaccatctgacaaattccatagatgatcttctcaattgtatttgtcttaacagtgcagcagtgaaattgctgcttgatgattccacaggcattttctgcaagtgtcgtcttcctgatgaaaagcctaacgtggtaaaaatcacgcagatttcaaaaatccaatttattatccaggattagctataactaataatttttcataaactccagttataggtattttttcctgagggaaagtgaaactttaagtcttctgtgaagccataattaaatagtatattttaagacaaagaagagtgatcatcatgtatatacaacacctgatagctgcagaaaccaagactaatttatattccaaagtcaaaatgtcaaatattaagagaaaatcatagccttattagcaaaggagaaatctctctgttaatcacttatttaacaacttgcaaatctgtgagatatttctttactttgacattcgatgatcctcaggaaggggagttgggagggaaaattgatctctgataatgctcgaacagccttggatgcatctgcagggcttgatttcttatttaacttgtgagtgctagcttatcaaaatgcaggtatgcaggagatactgagaaacagattggtaaaagctgggcaatatcaacaaattggtatgtgcttgaagaaaccaaagccaggtaaccaaaggtactttcttcttggactctcttggtcataacattgggattgcctagtttatttgttcgatacgaggtgcttatgaagtcaggttacagccattctctatggtctgctgacgtttacatcctaagcagctatattataaatatggaaaactaaaagtgtggagaaattcgttgaaagcccattagtttcattatagtaagaccaactctgcaacagcccacaatggtgatctgcattaaacaatagctaccattgattaagtaactactgagtgccaggcactggactaaggatttttatttctttcgtttaattatgaaaacaaccctgtcagataggtcttattggagctgggtgtggtagctcatgcctgtaatcccagcattctgggaggctgaggtggtctggatcacctaaagtcaggagtgttcgagaccagcctggccaacacggtgaaacctggtctctactgaaaatacaaaaaattaaccaggtgtggtgacaggcacctgtaattccagataatcgggaggctgaggcatgagaactgctggaatctgggaggcggaggttgcagtgagcagagatcatgccacctcactgtagtgtgggtgacacagcgagactctgtctcaaaaaagaaactggataagtcttatcagtcttattctatctacctacttatctatctacctatctataaatacacaaaggaagtgagctcatgaggtgaaattatttgctcaaggctgtaccatgttaattagaggaaatgggacttaaatgctgtctatccaacttaaaggcagacaagtgatctgaggagagagtattgcataaaaaaaaaagccaattattaacccagaaaggaaaaaaaaaatcctaattaagaaaggaaatatagtcatggtatactacttgtcttagctagaaaagatacttaaatacactctctctaaggccattagctagttaatgtctttggactgttttcctgtcatctaaatgatctgtgttgtaattttagtcagagggccttgaagaaggaagttgtatgtgcctgtgtgtgtgtatatgtctatatgtaagtatcttgtgcaaattggccaagttatttatccattcttgagaagcagattaagttttagaagtctttgctttcattgggaggcaattctccatgggtctgttgtgattctgcccatcttgtgagcagaggcactgctggcctttgttctggaccatctctttaggtatgtttgtatagtgaatggccttggaagacagagagagtgatgtcttccagaacaatcattctcaacttgtggtgattttgcctccaaagggatatatggtgatttctgcgaccacttttggtgtaacaactgggggagtgctatgggcatctagaaggtggtggccagggctgctcctaattatcttgtaatgcacatgacagtcttcacaacaaaaaattctgcagcccagaatgtcagtagagctgagattgggaaactctgttctgggacaaaggctgggtctctttattgtccagtatgataaagacaatgtctccctatggtgcaaaggtcaggcaagtttacttcccattgtgaaagatttaatcccattgatttgtacacttaagagtggttaaaatggtaaattttatgtaatatgtattttactataataacaatatttgaaaaaaagagtttgggttccctaagcttgaggttcttctcctaaaatgcaaactaatgtgtgcataactagcccccttctcattgtgggaattgggtcttgggtgcaaatgctattttggctactgctattgcgtgagcaataaagtcctttgtcactgactcattggtctcatgtttcctgccagcacccatgaaactgtggcatgctaacttgtctcttgctagcagagtgcagcttcagaccttccatagtccttgatagcctctcctggtaccatctagcatgcatgtttgtgtgtgcacatacaggggtatttgcatgtgtatgttacgcattgtggactaattccagctaagaaagagtctgagctctgccccaaggtccagactcttttcattagttacagacaaattaatgatgatggacctggtagtacttccaaacccatggaaagacagaagaatgttcacattcttgcatgcatttagggaggccagaacaaacgtgttttctcagaggtgagtttaggtctaataagcctaagatactctttcaaaactaacctgttttgtgtatgcatgttccaagtcaatctggggttggctgtcagcagtggaacaagtgcctgattagcagatgcctgtgattgctctggcactgatgaccctatgtcaatacgccccatttatatgatggtgcttttccaagctaaggaagtaagaaatgagtctgctccattttaattaagtaaactgcccctagtaataaaggatcaggcaagagaattcaccatctcagaaacacagaccagtaactatgaaataaccaaatacacaattgtatttttagagtttgtttaatttgacagaaccgagtggaagatggagatagtaactttggagtgattttggtttgttttattgcttttcctatttgtagttgattttgactaataaaataatgagaattgaaaaatgtttttatgctaagtagtttcattaaatagcatttaacccagcatcatgaacattaaaacagtaaaataatttttttaaactggaggttgtgatatatactattttcttatttatttaaaatttatttttaatcagaattgtacaagtttttaaaagtcaatcagttcaacaaagattgtaacaaaatagcagccatttgccacacccctcctcaccacagttcctgtttcatacagttacctgatttgaactagtttagctatttctcatggagtactgctatattcctaatcccctctcccattttaatacatctgaggtgcttggttcttacaagtgatggcatctcatagtttaatttaaaattattttaaaaatgattttaattaaactttaatttaaaaaattcttttattttagatgacataaaagaatggagatccctttcattgggtggtatctcaaatttgataaaataaattttgattttgttttgatttattaacattctggatttatcttgctttgtatttatcttgatttattaactttttatgtaattactatggaagatgattatttagattttttcccaaactcgttccccctatcaaaaatagggccacatacatacaaacacatacagatacctttccctttcttttttctttccactataattttgtaatacttttggttaatatctatacattatttctactatgtaaatgttattcttagttgaaccatttaggtgtactctagttacatttcctttcttgggtaaccctttttccctgttgcctaggttaataattacctattttttcacttgctttgttttatatgtacctgttactaagccatctccaaactctgcaagaacttactgtcctcttgatacattcacatacattcagtgatactgaaatcttcattttatttttttctcaatccctccagtcagctgcctcaagctggtaagttgttctctagatctgcttttcagagttatcctggtatttttcttcaccattattttgagaatttcctttgcttccttggtggatggttctcttctttttttggattctatgtcttcctctatcttggttacaccttcaatttttgtggaactcacctctagttgccttcagagaaaagcttcatgggagacacatttttctgagactttgcatgtctgaaaatatcttttttttttctctaatcaaacttgactgtaagtatggtgaagtatacaattctaggtttgatataatttctctcagaattgtgaggggattcttcaattttcctttccattcagaatggtagttgagaagtttggcattctgtttctttaaatgtaaccctttttcctttctctgaaggcttttagactattttctttgttcctggtgttctggaaatttccaattatgtgtcttggtatgggcctttttgcttattggactgggtactcaatgggctttttaattcttaaaatatgtgctttcagttttggaaaaaaattgtttctttgataattttcttctcttcctttccctactgtttccagaagtccaggtatttgaatataggacctccccaagtgattatctaattgtctctcctacttttcatctctgtggatttttaactttctcactgaaaaaaaataaaagcctcaacttttatcttcctttgattatttcctagtcattttatttttaacatctaagagctctttcacattctctgaatgttccttttttagcatcctgttcttgttttataaatgtgatatcttccctcttctctgaggattgatgttctattattttacactttcctttcctgcactatgtttttttcttctgaggttcttttttgttttctttgtctctatgttttgatctctgtatccatgtcagagtcgtttcttggctgtctggttagatttgagagtgaggtattaaggacacactgtgtgcataggtaggggaggtgtcctgtagggtgattcgttttggccatttcattggcaggcctcctccaagtttcagtatctgtaagtattgctcttttggggtctatatcctttgagaggaatctttcagtcttttgccttgttgataagaacctagctgtcaacattttgggatctgactgtgagaaagaggcatggatcaagagatttattctctgtttcagtatagtccccttgttctgagctatacttgagtcgtttccctaaggttcaacatctccagataataaacctcccatatttctcaagggaggtgatctcaggggatctatttgcttcttttaaagactctgagccaatctacctatttttagccacagttatctatcccccttatttcagaggcagatggtgcctccatccccaagccttctttaggtttttaagcacgcaaaggcttgcttcttggcttccctttctgcagtctcacattttagcttcctcaggtctgctgtcatccatccatttgccccacatccatttgctttactctcccaaattttgtggttgatattccctttccactcttctgtgtccttatgggttcatcattttaaagttgtcttaactgatgcttcagaggagcatcagaagggagctaagaaaaaactcccatttattcaatctgctgtgttcaaccagaaaccactttcataatgatccatcagagctgttttcctagaatccgcaatagggatggtagcctgtgggcagattttctatgagggaatcttctttggctggcacagggctaacaacatctgtatctctttagcaggccatgtgttcttcagacttccacaggctgtagcactccctatgcctatcatctgttttcaattataaatttatgttttttgacctgtccctgggatcatttgaacttgtgaccattggtctacacatacataatataatgtgattttaaagaaactgcagcttagaggctgtaaccagaaataggtttaaaaaccaaatatgcctgttgccctagttttattctccatgttctgacttggtctcatcattgactctacccccaactaatggagaattagcagctacctgcagctcctcttgtgaaagttaagtaagatgaagaacttcttgtcttgcttttccatatacgataaaatatgcggaaagataaaggaggctgttttctgtgacaggttccccaaatcgacttcaatgaaatgcatttactaaacaattataaaatatttagaaccagaagggaacctgacctaagcttcttattttgccattgaagaaacaaaaccccacagtggagaaagccattttccctcagagacatgatccgttggtagtagaattagcacagcggtcctgtcttccagtttggtcctctccctgtacatcttaaagaagagaagtgagaagatgaggggcttctaattagcccataaatggcaacatattctgagggccactcaaccttcactgctgtctctgaactaaaagggattatgtgtaaatggtatatttatcattattttcaagtcatatactcttattgaatcatattcacattaggcattaacaaacattgctcatggctggaagggttagaatgagaatgatcagagttcttaatttatctatgcattgtcagtaaggctttttgtggcgtcacgtttgtagacttgtatttaaatgatagaaatggtgttaaacattaaaatgtagccatcagggatttctgatataaatgaaagaaaatcaacatttacttctaacttgagaaaatttaatggggaacttttttctttttttaaatatatttttattatactttaagttctagggtacatgtgcacaacgtgcaggtttgttacatacgtatacatgtgccatgttggtgtgctgcacccattaactcatcatttacattaggtatatctcctaatgctatccctccccctctcccccaaccccacaaggacaaaaaaccaaacatcgcatgttctcactcataggtgggaattgaacaatgagaattttttttattgatgattaaatatattcatgccatctaagtatgttttcagtttatcatatattctcatttgggtgtcacaggaactggtggggcttaaagggacccgggtgagacagcttccaggtgactggccacagcttcactcttcttctgtacttacagggtcatgtctctgaatataaccaccctttttgtaggtctttgtggcttcaaatcatatctaaaccttttttttttttttcggtgaaagtaagcctctgaaagctgaaagcaagaagtggtactttgccatcataaaaaattgaaactgattatttcaaaacacctcattcaacttggataggagatgattttagtttccatgggaacagaaataataaaaacaagtacgataacttctgtattttcaacatctatgcctgaatgctgccataaaatccacagaaatatcttctaccccaaaacctgtaacaaatccacacactttcccaaatttgaaacttcataaatgttacatggaaaaaatggacatctaaggtagtctttttcatttttattgatctccagtttctaggtctaggttattttagggagagagaactaatgggtggcaatgaggaggagggttgggtggtgagacaggatatcttcactaaaaaattctaatttgtgctgttatttatgatagtatatgccttaaacattaaaataatatccctcaggaattctgatgtaaatataagaaatatcacatttactgctaaagtgggctggacatgagctgtggtctctctttagatggctttccccgtttttaatttttgttgctgctgttactgtcagaggtgtgatatgagtttaaagtgtaagtcatttgggcagccccatctgcctgtggaaataccttccaagtaattgatgctttcagtattttgtggcttatttccatataattttcatattccatcttctttccccttaccactcaggaatcctgagttaaccttagtaactgcatgcatattctctagaaaacctgaatacttaacgatttcccctgagccccatccctgctaggatgtagccagaggaaataactaccagaccttttctgtcttcccatacaaatcaaccattttctcagaatgtcagttacaaaataaatagcaagatacacatggaggcaaactcaggcaaaatacactcaaaatgccaacgctggtgtcgaggagaaaagctggtacagcttttctaataataaatattacgagcaattacttataattaataatgtgttttttaaaggtagaagtcctgtcttataaaaacctctctgtttaagggtacatattgtctgtaatcgtacatatatttttaatatgtgtaacatgcccgttaatctagttgcattctggatgcgtgccagagaggctgtgaggctggaatcatctaggtttaaatgacttctgcgatcattgtttataccattatgtacatcagtttaatggggatttaagatagagtataatgaatacccttttttgcctccggcgaaacagaagaattgtgctttataaagagtatagcattccacaattactcataggcatgagctagtcctgaaatttcaagatgtatgtactccttagagaaacaatttctatctgaaaacaggttctcttaaaaattttcatcacaaaattgactgaaaattgacgtaaatgtcagggagatgaagactttgagcataaaatataaaaatataaaatataaaaaaacctttctgatttattgcttttgcagtgatgggtttatttttatgacattgactcttaaacagtggcatggtgatgtaattagaataaatcttgtagaactgtctttatggccagaaatcattttgtcaacagtcagtccttccattgtcttccaactttcagtaaattggtaacttttaagataaaaacaccaccttcatttaaagaggcatgatttcagggcactattacagtgagaactgttaacccaaaatgattttttaagtggcatattcatgagcatattgcattatatgtgatttacagccctactgtgcacagtgtcatttggggaccagcattgtcagcatcacaggagctgagagagatgcagaggctctgaactcatgactcacactttgcatttgacaaggtccccaggtgacagtgaggcactggtcttggagccactaggctggaagtaactcttgaacatacattgaatttaacataaatatgtctttgctctgtactttatcttaggaaaatagttattacaatccaatggtcaaagaattcaaatccttttgtcactacttggagaattttggacaagtttacctaattccctgtgcttcagtttccttatctgcaaattaggatcatcatcgtgtttttcttaaataattgttgtgaggttagtgtaaatatgattatgcatatgacgtgcttaggccatagcactgggtacctggcaagctctggataagtgtgagccttatcatcagtgccttcctgaaggcacatatgaggctgacttttatctgtgggaggcacatttgtgtcttatttaagacgaatatccagagtcagtggtgttgggaacaaagatgaataacaaaaagcccttacttcaagaaacttccagaagacctccatagtgccagggctgatatttccctgttattctataatcattccaaatattttgggggtatctactcaatagcaatttatgttcactattttttttgcacataaatagagaataactgcacagtgtggttagaatgtactagaggtatcttagcaagtattaggagggcacaggtgaggagtgacggccacctgagggagcaggaaggctttctggagaaggtggttctacccatggggaaggaagggcatcctggatgaaggtataaggaacagcatgagtaataggatggcacagcccgtggcccagggctcttttcagtttcttccacagaggactctccccactccaaacttatgtctgggaaggtctgggtttggccttctttccctgccacatccagccatccctctttccattgttgaggaacccaacttccctatttttttaaggaaatagaggagggatgggagagtgagggtgttgggaagggaggtgaaagagtattagtatgagcatgtgtggggctggggagggaaggtattagtatattagtttgctagggctgccataacaaaacactgcagactaggggacttaaacagcagacatttattttctcacagctctggaggcccaaagtctgagatcaaggtgttggcagggttggtttgttctcaggcttctcttggcttgacatgagtcagattggattagggccaccctcatgacctaattttaacttaaattgcctccaaatacagtcactttatgaggtactggggttaagacttcgacataataattgtgagggacggtacagttcagcccccaaaagtgagaagatggggtttgtctctaatttgatgctgcttaacagatggataatattcagggagtagagtcagcttttcaagtttgagtccgtaagaaacatgatcagtgatgagtagagcggggagaaaagcagagacatggctcccagctcagcccagcagcccctctgcctcattatccattggttatagattagaggttggccttagccacgtgccttgttaccatggcgaccagtttttcagctactgaggggaccactgttcttcaataagaagtgtgtgtgtgcgcacatgcacgcatgtgcacgcaggtatgtgtgtttgtgatgctgatgaaagatattttcatctactggccatgtaacctttggcaacttgctttatgtctctggctcaatttcccattctatacaatggaagtaataatcacatctgcccacaggttgggaagataaaatgagaaactgcatgtgaaagtgctctaagaagcacaatatgctacctaaatgtttggcattacatattacatccataactggctactgccaacctgtcattccaatggaagatagagtcatttgttgcttaagcgcgtatactaatttatggaaattatccttgtttagtatgtcttgtttgtacattcgtattacttctgcaagtattaatagctagcagtttggaaacaacaaaaagctattggatggtaaatgtgttgtgaaaaatggatgccaaagaacttggaagcaaagaataaacataactgagagtgaggatgattagtccatatgaatcagacccaacagtcttaatggactacaagttcccagggctggtgatagctctgagtttgtgtgagtggtaccagattcctcttcagtagttttgctacagcacagtgagagaggagtgaaggggatggaggaagggtgcaacttgttcctcctttgcctcttgtatttcttttttatcctaaagaatagttacatagagggagtgcccttttccttctttgcagactgtcaccatggtatagattttatctgtgtgtatgtgtgtgtgtgtgtgtgtgtgtgtgtgtgtgtgtgtgtgtgatgtgtatggatgggtgtaaaacccggtgttccttctggggatgatttgattgatgtgtacactggaaacatctttaataatttaatgtctgcttcaaaggagattacaccaaaaagcacattgcttttcatttattcattacagatctgtcatagcagcatttttatttttttgccctgaattgtagtgtcgttgtaataataaattttgttccagactcaggatattttaaaggtttataagccttttaactaatgttaccgtcttatttaaattgatcaaattggcatttcaacacgataatcttgcatttcttaaagttgaactaaccagatgtggcttcatttgatgactactaaaatagctgtgccgggaaagtctaatagaaataatgggatgaaagcataatactgcttgttagtactggtggtaataatgactatgagacagggcctgaatttagggccagttgtcttctttcctagaaagaaattagggtatataccagccgtttgcattaaaaggagaaaaaaatgtataagtgtttgggaattctggataaagaaagaggtaaggctgagaaatacaaaactaaatactaatatgttattattttgcaatttttaggtataaatccagatgtcagaagaggaaaatagacattttcttatttaggtgtgattgtcttaacataattcagcaagcactggtaatatgttctcagagaggcgaggaccatatccagaatcctaaaaagttacagtaaattatgagttttttgttattttattaaatgctacacaacttctctttaaaactaaaacaaagttgttctgaataatagggcaagtttaggcacagtaaggatcaaaaccatttctaggagagtgatgtataattatccaattttcagaggtaatttaaaaagaaatctgttcctattggccattagtactgcagtattttgggagttttgttatatactgcttcaggtactctgctagacaattcttataataatgtttccttcctagatcacaccaaaagtcagtgatagaaattcccaaaatattttgttttcaggtcagtaattctttttttttttatttttattttttgagacagagtctctctctgtggcccaggctggagtgcagtggtgcaatctcagctcactgcaacctccatctcctgggttcaagcaattctgcctcagcctcctgagtggctgggattacagacatgcaccaccaagcccggctaattttttgtattttagtagagacggggtttcatcatgttgtccccagggtggtcttgaactcccgagctcaggcaatcctcctgcctcagcctccaaagtgctaggattacaagcgtgagccaccatgcccagcctcaggtcagtaattctttaaacagtaaaagtaatgttgcctactgcagatctcatatgttctggccattgaaagtacacgtgagtgtccttattgtagcgacttgtttggttattaatttaaggaaagatactaggactttgggacaagactgccttttgtttacaccctagccctacttggtcacttgccctgtgatgtgggaagtgtgatgcgatttctcatttactctctttgtctaatgggtataagaaacaactcatagggctattgtgagagttgcatgaaatgctgcgtgtgatgtttggcacagagcggtgctcagcctttgcacttccatttgccccgcctttctcacctgtcactacctgcaaacactgtagacacagagttgtagaagtctctatggccaaacaacccactcctttcccgacacatgcccttaactgcttctcgcctcattccacattgtaatgtgatttgtttacgcatctttcctgcctattgtgctctgctctgcgctctttgatctcggagacagtggtatttatctccgaatgccgggaactctcagtactgcttaacacagatgggtgcccttggcccaatcactgaagtcataaggcgtgagagtcccttatgtgtctctcagggtcccacaatgaccatgtatgttattctgcagagtccatggaaggaaacttgtctctgggccaagggtccacagggcttttcctggcttcttctgacttgttcgtggggaaccatccgccatgttttctctgagctggtttattataccttcttcccccttggaagtcccctctctgccttagtgtcttggtaaaggaaaactctcgacttcctggtgtgggctcctttcctgaactccctagaaatccttgctcttcagcgatgcagaatgtaatctttggctcagtacatttcctctgctccattttatttctttttgtggtaatatactcataatggcatatttaccatcttaaccagttttaagtgtacatacagttcagtggtatgaaacacattcataatgttgtgtaaccaccaccaccaaccaggtccaaacctcttttcgtcttgcaaaactgaaactccatacccattaaacaagaactccccatttctccctccctcaacctggcaatcagcattctactctctgctctatgattctgactacatacctcacatgtagaatcatacagtatttgtctttttgtgtgactggcttatttcacttagcataatatctctgtttcatgcattttgcatcagaattttctttctttgtaaggctgaatgatactccattgtatggatatactgcattttgattatccactcatcttttgatgaacacttgggttgcttccacattttaagctattgtgaataattctcctataaacttgggtgtacaaatatctcttcaagtccttgctttcagttcttttgggtatttacccagagggtggagttgctagatcatatggtaattctattttgaactttttgaggaatgaccatactgtttttcaggtggctgtagcattttgcatcccccaaaatgcccaggagttccagtttctccacatccttgtcaacgcttgttttcttctgttttttttttttttttttttttcttgtcattataatgggtgttaggtagtatcttattgcagttttaatttgtatttccctaattattagtaagttgacaatcttttcatgtgattattggccatttgtatatcttctttgcagaaatgtctattcaagtacttcgcacatttttgaatgagactttttgttgttgagttttaggtgttccctatatattctagatatcaagcctttatcagataaatgatttgcaaatattgcctcccattctatgggttgcctttttactctgttggtattgtcttttgatgtacaaaattttaaaatttttatgaagtcccatttatgtatttttttgttgcctgtgtctttagtgtcatatgtaagaaattaccaccaagtccaatgccaaaaagcttttgccttatgttttcctctaagagttatatagttttaggttttacatttaggtctttcattcatttgaagctattttttgtacatatgttaggtaaggatacaacttcattcttttgcatgtagatatccaattttcccagcacaatttgttgaaagactgtcctttccctactgaatggtgttggcacccttatcagaaccatttgaccgtatatgtgaaggtttatttctggactctctgttctattccattggtctatatatctgtcttaattccaggaccactctggttttggttattgtagctttgcagtaagctttgaaataaagaagtgggaattctccatctttgtcctttttcaaagttgttttggccactcagggtcccttgagattccatatgacttataggatgggtttttctatttccgtaaaaaacaacagggattgcattgaatctgtagatcactttggataatattgacctcttaatgatattaagtattctaatacattaacatgggacatatttccatttatttatgtcttttaaattttcttttggcaatgttttgtatttttcattgcacaagtctttcacctcactggctaactcctaagtgttttattccttttgatgctattgtaaatgaaattgtttctgtaatctccttccagattgttcattgttagtgtatagaaatgcaactcattttcatgtgtgatgtattctcctccgttctgtttttataatgacaacacccatctttcccttgccaagccctcctctccttatcacctcaagtgtctgtatctcagtgccttacttagcttgttctctttgaggagagggtgagatgggtctggtggggcagattggaaatgttattctctttgttagagattggagacttttctcactttcagtcatttaggtcacatacattaaacaccagaaacttcttaccaagcattgtgagttatgttcataaatcttttgccttttagcaccagctggcagatccattcccctctggacctgagtttctgtccatcattctgcctttgtgagggacccaccctgacgacatgctgagggatagttaggactctccgctatttgaccttaagcatccgaataaaatttgaacagcctaggctcacggtgtcttttaatctgcataatgacaaacattgtggttttttcagtatctaagaacaactagttttttccttcatttaaaaaatacacatttggtatcatgtaattaaatctgagactttatttttgacagaagataagaattattactagttccaactctttcttcttaaaaataatgtgtggaatttttttctgaacttttagtcttgtccccttcatttccttccttacttccaaaactgaaagcattatgttaacttttgtaatgacaaaaagtttggtcagttgtttggtcagttagaagagatgggcttctagagttggaaaggggggtcagggctaactgggttccaaactctcattttacagggaaggagaattaagtgacctgtccaatgtcaggtagctagaaagaggcaataatgagatcttaacaccaaataaatcattctaccctatcattgaaaaaaaccctgggctgggcatggtggctcatgcctgtaatcccagcactttgggaggctgaggcaggtggatcacaaggtcaggagatcgagaccatcctggctaacatggtgaaaccccgtctccactaaaaaacacacaaaaaatttagccgggcgtggtggcgggcgcctgtagtcccagctactcggggggctgaggcaggagaatggcatgaaccggggaagcggggcttgcagtgagcagagatcgcaccactgcactccagccagggcgacagagcaagactctgtctcaaaaaaaaccaaaaaacaacaaaaaaaccgtgttattttattgatagcattgaagaaatatggtggctccaggagagaatgtattgtaacaaatgggaagggatttccatgttttttaggatctgtgatgtgccagaaactatgacactttatataacttttctctaatcttcatggaagttttgttacgttcccattttacaaatggggaatctgaaactcaccaaagttaggtaacagccagtaagtgcctggtcaggacttgaacctgggtttttctccaaagtcttggctctgaaagctggcctcctgttccctcccccaccccttgttttttttttttttttttttgagatggagtcttgctctgtcgcccaggctggagtacagtagcactatctgggctcactgcaagctctgcctcccgggttcatgcaattctcctgcctcagcctcctgagtagctgggaccacaggtgcccaccaccacgcctggctaattttttgtatttttagtagagatggggtttcaccgtgttagccaggatggtctcaatctcctgacctcgtgatctgcccgcctcggcctcccaaagtgctgggattacaggcataagccaccgtgcctggcctcctgttccctcttgaagcagatttatgtgtatcaaaataacagtagaacagtgaaatgcttgattaaggtttatgaaatactttagtatttattctttttttttttttttttttttttgagatggtgtcttgctctgtcacccaggctggagtgcagtggcgcgatctcggctcactgcaagctctgcctcctgggttcacgccattctcctgcctcagcctcccgagtagctgggactacaggtgtgcaccaccatgcccagctaatttttttgtatttttagtagagatggggtttcaccatgttagccaggatggtctcgatctcctgacctcatgatctgcccgcctcggcctcccaaagtgctaggattacaagtgtgaccactgtgcctggccctcagcatttattattcttacagagaggacatatagtttcttgaccttagatctgcaggaaaatcagttattgtgtttagagagaagctgtcagcttccttaggcattgtggggaaagctgtctacattccacgtcagaaaacatgaattcacagcctggtgccattgccctcatccttagccttgaggatgacaatctttccacaaagactttttttttttaaacctcttcctctgggccaggtgcttcactagacagtggccaaggaccttgcggtttggctttctatctgccatgggggttacaagcactggttctggagtcacaggcctagttcaaactctggctctttctgtgggatcttgggctccacctgtttagttttctcatctgcaaaatgggaatgataacaatttcaaaggattgttgtgaggattaaatgagggaatgcttgtaacatgtggcatgtggtaggtactcagtaaacgtaagtgtattctatactgtaaagtactatgcaaatgtaagaatgttttacttgactgtaatataagtattacattactatgatgtgcagtggaaatgttctgttatgcttcttacttttatccattattccttttgatccatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggtatttctattgcttttgcttgcttatgtgaatgcatgaatatgtgtgtgtgtacatgcgtgcattcagagaattaatcaagtgtttaggacttgtattgaaaccacttgtggttgagtaggaaagatccaataccatttaatccctttacttactagttatttcaaccatttaacaatactgccattgacctgacagtttgtgtctgcccttctgccattcatacatttagccattgacccatccatctatttacctcctgcctaattttacaagaaaatgtacagagccttctaagaacatacataatccaagaaagaaatataaaaaagtaagaataagttaagaccagagaaggtagaaaccaaaaaagaatatcaagaccagtgagacctagacatgaaataaggaatactttctctattatgagtgatttctttgatctctagaagtactgaagttagtttgcttttttctactttaaatagattaatcaaattaagcattcaacacattaggcacttgggtagtatacagttctatttattatacagagaggataaagaaatatgtggtgaaaataagagaacagaaaaagtaatatctggtgaaatctctcttttcctagcctgttcttctatgtctgatcctggagttggatactcatcagtcctggcattcttccacgggacaatatgatcctgttgctgccaggctcaagttgagtctcacagcataagaggcaggatgttctccataacattctcaccatctgcttatcccatcccttcctgtctatccgtcagttcaaggtccacctccctcaaggctgtaactgctgaagtgggccttggactactcattcctaatacccactatgatcactgaggtctacttgattatttattattgatgcatctgatttatcttgcttagggaaagcaagtttagcggtggcaaaatgcaaaatgttctggtggccaggtttcagtaacagtacgaagttatctgcaatccactatatgagttattcaaaatgttcttaacatctaaatgaaaatgctcagcatgtctcttatcttttctcaaggtgagataatcatagtcctattctataagaaattccccatattagttctacatagtcctcagcgtcatttatatggcacctgtaatagtaggtttcatacaactctttgttgtagtagcttttgatgaaagcttacaaaatgaaatcaaagtgtaattctgtgtgggactagatagtaagatccaacatgatttttttccagtggtctagcttaattcaacatatcacataaatagattttacagaaatgaatggattgcctgtccttccatcttccataaatataactttaaaaaataatcctgtaatttgcaatgacatgaataaacctggaggacattatgttaagtgaaattagccaaccaaagaaagacacataccatatgatctcacttatatgtgtaatctaaaaacagttaaactcatagaagtagaaggtagaatggtggttaccagggactgagtacagggttggagagatgttggtcaaatgatacaaaatttctgcgagaaaggaggaataagttcaagagatctattgtacagtaaggtgtctaacgtataataacaatgtattgtatacttgaaaatcactaacagagcagatttgaagggttctcaccacaaaagataagtatgtgaggtaaggtgtatgttaattaactcaagccattccacaatggatacatatttcaaaacatcattttgtatgctatgaacatacaatttttatttgccaattatgacaaatgaatatttttttaaaggggaaaaataggcttttgataggaattgggcatccgtcaagatcaaggttatgtaatttggcattgacctgtggtatgtaatgagagtgaatctaaattcttgggagttcaaataaggaagtgcctagtttgtgattttttttttgagacaacatctaattagggactttttttttgtgacaaggtctcactctgctacccaggctggagttcagtggcgtgatcacagctcactgcagctttgacctcccgggctcaagtgatcctcccacttcatcctcctgtgatagctgggcccacaggtgccaccatgccaggccatatatacatattttttaatatggaggaagtctccctccctgtgttgcacaggctggtttttaactcctggactcaagcgatcctcttgccttgacctctcaaagtgatgagattacagccacgtgccaccatgcccggcctaattagggattagtaacagagcagttactcacaaagagatttaatcttatttgactcatctctttcttataacaatgatatattttatcttgttctccctaacatattagtataggtatattttaagcataccgaaatatatgagaaaccaaatttatgtgaattgtaagttaaaaatgaatagttaacttttacagaaggactgtctactaataaaatgactagaaattctgttcaccgtgtaacattttgttccatgtaacaattcttgtacaaagcgagatatgattgtaggaaaataccaggaaatacagagaatttacaagaaacaattgacatttattgagattgaacttgtactatattcaagataccatttgagacatttcacaaaggaacagtgtgaaataagacacggcaccagtcatatatatatataatttcttcaaagcatcagtcatggcctgtgtggtttggggaacctggagctactctgtcccccagactgggtgcccttgtgggggctgtggagcctctaggatttcatagagcagactttgcaaacctgctggttctaatctcacccactcagttttcagtgtagtcggggaaaggtgagttgtacatgagacaatgtcattattaacaggaaaaacccaagtggcaggagcaatagttgttgttggagaaatgctgcctccacattttgattttctgtctttttcttatctacttgctacttgatggtacttggtaccatattcacaacgaatttgtgaattctaggaggaaactaaaattaggagaatgtccctgaattttttcttcctttgtctctgaaaatgctaaactgaaaagtataactaaattgaagaaaagctcaaagagaaatcaagaaaaaatgagaaaaataaagcctgcagcatacaaaatgagtcagggcctttcaagcactagtagattatgaaccccaaaaggacttttgtacaagtgttgagaaaacagtatgtccactgggtaatgatagacaaaaaaacaaagggaaccccaggaactctttttagttaaatatttatataattaaatagaatcttgagtaattttttctttataaatgtcattacctttgtgaaccaaacagctgaatacctttgttttgatctattttcttctaggctgatgtagaccctcaaagaccaccaaggccagaagtaaaaattaccagtccagaagaaaatgaaaacaaccaacaaaacaaggactatgctgccgtggcttagaagatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttgctaggcaaatagaccaattgatctttattattattattattattattattattattttttgagatgaagtcttgctcttgttgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaa

SEQ ID NO: 12777 - DNA, 828152 bp, Human
  misc_feature (1)...(828152): n = A,T,C or G
atcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagagggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgagcctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagagaagggctttgtccctggccccaaagactcagggagaggtttactggccaggtagaaagggcgtccaggtgaagggaccctggttcagtgatctccaacctgcacgtctcatttgtgaggaagccgtagggtgtggacttttcttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcgtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcgtagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccagctacttgggaggctgagacatgaaaatcacatgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactatctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaagataaagaaatactttgcaaatcagctgagcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatttattaagagaatggatattttcatgtcagaaattataggaaggatacagttatgggatgaggagcaattcttttttttttttttttgaggtggagtctcactctgtcaccaggctagagtgcagtggggcgatctcggctcactgcaaacctctgcctcccgggttcaagcaattctcctgcctcagactcccgagtagctaggactacaggcgcgtgccaccacacccggctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgtgtgtgtttcggatcccaggttccaaacctgcactaaaacttgttgctgcatctcacctaatcgtgtagtgagccaggtgagctcatctgtgaaatgcagacctttctggacgtaccacctcgtggggtgaagggaaagaaatgatacaggtgtacatcagggtataagctgtcctagagtctggattctttttatccagaagccattctttcagcctgtgcctttttgtaaataccataccccatctatttccacaaaggatttggggcattagcgagtaaagggggaatatgttctagaagaagggcgctcacctcagtaaattgatgggtgggccacaaaaatcatgtcacaagatcttgttgatgtgcatgcattcattcattcaacaaatattattgagcatctaacataagccgggtgctttgctagggacagaatgctgtacaaggtccctgtcctcatggggaccgtatgttgggaagacagatgataggcatggaaatgaagagacaaaccactccgacttcagcccaggaaggagctttaatttgagtaattgttttcactaattcatcttcacagaaagaaataatatgatcaccttcggttagtaaacaaaacaaataggcaaacaggtttacaggctgaggtgggctggatcacttgaggccgggagtttgaaaccagcctagctaacacggtgaaacccttctctactaaaaatacaaaaatattatctgggtgtggtggagctttcctgtagtcccagctactctagaggctgaagcatgagaatcacttgaacccaggaggtggaggttgccatgagcagagatcgtgccactgtactccagcctgggtgatggagcaaggctctgtcttggggcggggggcagggcaggggaggggggaaagaagagaaacagctttacttacgtttttgatgagcctagcctttgctgtgctttggaaaatgggctgtggaatttggctgaaatagtcaaatgcgtagctggctgtatgtggactgataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcgaattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctctgtctcccaggctggaatgcagtggcattttctcggctcactgcagcctccgcctcccaagttcaagccattctccagtctcagcctcctcagtggctgggattacaggcatgtgctactacccccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgtaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaattagtcggaggcggaaggaaatgcaaaagtggacatttactcgagaaagaataaagaaaccatgcaggattccatttcacaaacctctacagctgttgctggggagtcagtggaggggtactggaggaaggcagactttgttctaagctacttagcagccaaggaaagcagaagaaactattattattatttattattattatgtgagttggagtctccttgtgtcatccaggctgaagtgcagtggcatagtctctgctttctacaacgtccacctcctgggtttaatcgatcctcctgcctcagcctcccaagtagctgggattacaggcacccaccactacatccagctgacttttgtatttttagtggagacagggtttcaccatactggcccagctggtcttgaactcctgacctcaagtgatctgcctgcctcagcctcccgatgtgttgggattacaggtgtgaaccactgcttctggcctagaaactattattaatagaagttctgggacaacggccctgctctcattacttgcccccaatccatgcaatgaaatactggcctgtgagtatgtggtcccttcagctcattttctgaagctgaccaaaggagcacagtaatgcataacgggggagtaaaattcctcaagacgagcaaaaaaggcagaaattaataaaactctatgtattagttatctatcactgcataacaagttacctcaatatttagcaggttaatacaatgcacattcattattttatagcctttgtagattaggaaccagccattgcttagctggaccatctgctttagagtctcacaggctgcattcaaggtgtccactgggctggggtcaacttcttaccgacaaagctggtgccccaaaagaatggggtcttatcctgttgggtgtcatgaagccaacacacaaaaccgaaagtagtgtcaagcagtacaggctttattcaatggccatggaattgagaagcaggagcatggctcacaaattcacaaatcagcttctccactaatgaggggtgaggaagttaaaatatagactttgttgttgttgctgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgcttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatatgtaatcctaggatttgttgttgttttgttatgattttttttaagcaggaagctaaaaaaaataaccacccgttactttgctgcttttagaaaataggtttgagattgattttgaatactaaagtatagttttcatgttataaagccaaccatgttaaaaatgtataataaagtatctaatttagcaaaattcaaatttcccctatgaaatatcaagctctttttatgcttcttcacatggcaccttgtgtagaatttgaaccactttaaacattgcatccttgagttgcatatgatgggatctcttgaatcatttacattttgaaaaaagaaagtgaaatattctttaagaagccaaagtaatccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatatttgccggatccaaaaaaaatactgtgtatcaactactgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctataaatataaaagagcaagtaatgaaattaccatggctgaattctgaatattaacccagagcagatttcctctaagaaagatcataagaagatgcttaaaagaaaacattatatttcaaaagaattaggttctgaaatatacccaataatgaaaacaatacaattttcttctgctttttgtccttcctgttccaagcactgggaaggagctggcatatttcttatgtatgaaaagtagaataatatattggattcctttatccctaacccggaagagtctttcttggactgtggtttgctttcccgttatacttaagcttgtttattgcatcttccgatgtcacattatctcattgccaagctaaaggctctgttgggttcttagttgaacccagagtggaggccgatttcatccaaagccattttttttaaaattagaaattaaactcacctttggcaagtcctcctgaccagggatgggtcctcatgttagtctgtaatgtgaagatatgaaatgtatttgatacaataggagattcactgtgattttcactgaatgagtatacattctgcagaactagaagataaagataataaaacaattcacatttcttaggactaatttattttccacagtccactaccaacatggtgggatggggaggagctgagaagagcatatttggctgagtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttgctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggtcatattaatgcaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcataaaaagagattgcgtaacaccctttgaacaaatggatatttgagaaccatcctgtcttcagatttagattttttcaatttttttttactgtcatatgattcacatgctagttactgattgctatcatgcagtctgccagcagaccagatggcagatcttttaattagatatgtttgtgtgtgtatgcatgtgtgtgtacatgtaatcacagttcatcaaggacctaataaatacttttttctctctctctctttttttttttttttttttgagacggagtcttattctgttgcccaggctggagtgcagtggcggatcttggctcattgcaacctctgactcccaggttcaagggactctcttgcctcagcctcccgagtagctgggactgtaggcatgcactaccacacctggctaattattatgtttttaatagagactaggttttaccatgttggccaggctggtatcgaattcctgacctccatgtgatcggcctgccttggcctcccgaagtgctgggattacaggcatgaaccactgtgcctagccttaataaatacgtatttatgtctttcgatctttttctgtttttctacattccgtttcccctatggctgctattgttttccagtgagctatttatatatatatatacatatttttgagagggaatcttactctgttgcccaggctaaagtaccatgtcaagattatggctcactgcagcctcatgagcctcaaccttcttggcctaagtgatcctcctctctcagcctcccgagtagtttggattacaggcacctgccttcatgcctggataattttttgtatttttgtgaagacgggtttcatcatgttggccaggctgcagctatttatatcttatatgtgtatttgtaaaaaatttattcctcagccctgtgtggtagctcacttctgtaatcctagcactttgggaggctgaggtgggaggattacctaaggtcaggagtttgataatagcctggccaatatggtgagaccctgtctgtactaaaagtacagaaattagttgggcatggtagcggtgcctgtaatcccagctgcttgggaggctgaggcaggaaaatcgtttgaacccgagaggtggaggtggcagtgagtggagatcacgccacagcacttcagcctgggcgcatgagcgagactatgtctcaaaaaaaaaaaaaaaatttcttattcagttgatttaagatggtttataaagacaacatgagctagcggtagaaatgcgaatggacgcttgtagacagtaaggactcaatacgtgggtttgttcaagttatattgtgcagacaggcatatgcagttagaaaatctgtctagggtagggagagataaaaccagctacttcagccctgctatttttatcctgaagattttttttttactctgtttatgaataaaacattttaatcagtgctgtatcaacactgatcaatttttttcatggaagtgtaatacagggtgaattccattaagtcaattaaatacttagatccagtttttaaacagtgcgaagatagttaagctcttcttttattgaaagcctttttaccaaaaccatttttttttattttatagtgaagatttcatgtatctgttttctgtacatgccaagttttacagctttttgtatcatgagttttcttttgcatcaattatttctaccaagtccaacttgtagattgggcagatctggatttcaccacacctggtttttgttgtcattgagtttttgtgatggggtgatttcagtgagaaatatatgccattaatttgatgaaaaatcagtatttatttattaactaatacccaagaaattccccagcaagcctcttccagtattctagagtttctcgtttcttgaggattggtctccgggcatactcctaatctaattgtttcccaaactttcaatgttttggatgactttggaagccttgatttctgtaggctgtagcaggacaaattctgatggacagatcaagatgttctatgttgctctaaaacagcatctctcaaacttttttggaccactatctaagttttttctgttaaaacccaatacatttatacttatgtatattcgtgtgtgtgtgtgtgtgtgtattatatgcatgtgtgtgtatttgtctgaaataaaagttttacaaaatgatacttttatctgagcagtgtcctgctgttttttttcccctaggttgtgtttttgtgtttttgtttgtttgtttgtttctttgtttgtttttgagacagaatttcacttttgttgcccaggctgcagtgcaatggcacgatctctgctgaccccaagctccgcttcccaggatcaagcgattctcctgcctcagcctcttgagtagctgggattacaggcatgcgccaccatacctggggaatttttttttgtatttttagcaaggttgttgatcaggctggtctcgaactctcaacgtcaggtgatccatcctcctcagcctcccaaagtgctgggattgcaggcttgagccaccgtgcccacctgtgttttttgttttgtttttgtgtatgtgccaatgatgacccagtttcaataccaactgttgctttcaccacccactattggtttcaccaccccgctagatcacagtctgttctttggcagtcactgccccaatactgtttgatgtgctcccctctgataaatgttcattgagtgccccacatgtcaggtactgacttaaggcatagcaaatgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaaatcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggctataggccaggacctgtgctatgtagcttatctatttctcatgctgattctacttttgttactaccgaaggagcttagagggaatcagtgacgtggacaaggctatgtaactaaagggggtggaggaggattcaagccccttgcaacggactgaagtgcccaagctctaaatccctgccacccacagcctctgttggccccaggttgtgtctgagattcagaggttgtttttatagcagcaacacagtaagttgggaagagggacacatttttaacatagacaccaaaagagaggctggaagagttgaccacttagaaatgtcacgagtgtctgtgaatagtgttgggggctgagaggcaagagaagaaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctctttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacatgatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctacttgttctcttggttccttcaaagtaatgactaagtacaggtctttagatagagagctgcaccaaccaggtattgcttcgtgtcttccacgtacgtcctgagaaagcgaaggtgaatttcaccaattggtaggtggaaatagaaaaactgttgattctttttttcattcaccaatcttttttttccccaaatgctaagctttatttggggaaatcttaacagccgtttttataagactctgcatttacaacatttgtgggggctgcagaggacgcacatgaaaataacatgaactggccatgtacggtggctcatgcctgtaatcccagcactttgggaggccgaggcaggtggatcacctgaggtcaggagttcgagaccagcttggccaacatggtgaaacctcatctctactaaaaatacaaaaattatagctgggcgtggtggcgggcgcctgtagtcccagctacttgggaggctgaggcaggagaatggcctgatcccgggaggcggagctttcagtgagccaagatcgccctactgcactccagcctgagcgtgagactctgactcaaaaaaaaaaaaaaaaaaattagctgggcgtagtggcaggtgcctgtaatcacagctatccagaggctgaggcaccagaactgcctgaacctgggaggcggaggttgcagtgagccaagatggtgccactgcactccagcctgggtgacaaaaaaaaaactttacctgggcttagtaagttgcctgacttctcatcctggagttcgtatccccttgtttctagaagagaaatccctcagatgtgaaggtgtgttccatgattttgtcgaacttgccctacatactgttttattatatattctgcccacttctattccctgccaattaattaattgtttcattggtatagtttttttttttttttttttgatacagggtcttactgtgttattcaggctagagtacagtggcgtgatcacagctcactgcagtcttgacctcccaggctcaagcaatcctctggcctcagcctcccaagtagctgggactattggcaatgccaccatgttcggctaatgtttttaattttttatagagacaaggtttccctatgttgcccaggctggtctggaactcctgtgctcaagccatcctcccacctcagtctcacaaagtgctgggattacaggtacaagccaccatgtcaggccattggtataccattgtttttcttaaacatttatttattttcttatatttacagcatatgtggtcatttaaaattattttatagcatataaaagtaaaaagaatataaattaattttttagcattaatattagggaagataatctgacatttaaaaatacatgtctatatgtgtatacatacatagaagtatatatataaataccagtactagtgtctgctaataggtggcgccactttttatctgtgtgtgttgggggtggaattagcatgtagaggttggcaaaggggacaggagactgtgggatgattagtatattcttatttggcctgggagggaaaaaaaatctttcatttccaacaatattcattctctgtgtcacctcagcatttaatttacttccgtcacaaaactacttgaagttgtcccaggctagttggtcctattaattacaacctagagggattctattagtaaactaatggattacagtacctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactggatatttccgagtggcctacaagtggagcgtgatttcatctttcatcaagagaagcagcttttcctcctcttgtatccgttttcttccttttctaactatcaaggtcatgcggtatctgccattttgcatattcttgctttgcttcatgttttccttaaactctgtgcacatgaatatttgtggtatatggcttaattgtaagcgatcaggcatcaatggctttttatgaggcaaaatctactttctgcatttgcgtgtgccattattatagattgctgatgtttgccaatggatattcttggaagtcgtcttctggtttaaatgcagttaagtatttaaaaataataccagtgacatgtttgcatttacattcagcctgaaggcctacttgatgctgcaactgaaaaattgttagactagattttattttattttaattctttttgagacagggtcttagtctgtcacccaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttccctcccttccccaccctaaagagtctcgctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagaggcggagtttcaccaagttggccaggttgttctcaaactactgacctctcctcggccttgcaaagtgctgggattataggtaccccgcctggctgatactttccttagttgttttcagtgtaataacctgtcttcagtctactctttgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatgggatccacaagatggagtgatctttacgccatcctcctgaccataaatactaaatgaatactctatttcagttgagtttttagtttgctctgttacgtgaggacacatcacttgcacctcagtgtgagtttgaaagtgttttctctggagaataattctgaagaaataggccctccagatatcagtagtgacaggggtatcagtaatgttgattactaagttcttgccacaggtagaagccatgctactgcacaagtttcatacttgaagagtggacatctgacacagtgttggtggttgttgaagtgtatgactattactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatcctgtatttgacacagcccctcccagcattctgagtcatcgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtggaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcaaaaaccctcacaggtcacgcctgaataccttcaatgtgccccatgtaaaaatacactgcaagtcgattggacatgccctatgaattataccttatttatgatcgtcgagccctcccttttcccgtcatgctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagcggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacgaggcagcgggcactggggcagccacatagacaacatctaaatttttgttgctttcctgggtcttgccctgtccttactgtttcccttgggcacgctgttcaccccttaggacatactacagtaaccttttcccaccaccgtgggaggactgtgattttgtaaatgtcctctgatctctcctctttgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccgtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccagttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttttgtttgcaaatgatcacctggtaatttaagagggtgagctaaacttcctccttttctagtatggacctttggggctcaggatgaggatgttcaatttgtactgctggtggagctgcctttccattaagtgagtctttctccaagggaacagaagtcttaggttgttgatctggcggtcagaacctaggacaggcaaggcagtgggctgttgtagaggagatgaagctgatcagagcacacccacaccagtgacaaccggtcaggacctgggaagggctctgacccattcatctgagagatgtggcatgaggaacactgagacctaatgcttattgcttaatattgtggacaagggactctgtgggttgtctagtactaagcagaatggaagggaaggatggaaggaagagagggagagacggagggagatggaggatgacagggagatggagggaggcaaaaagaaaaagggagaaggaaagagaggaaagaggggaagggaggaaggaaagaagagagagaaggaggaagagagggaaggaggcacagaggtagagaggcagggagataatggagatcctggccaaaagttaatgctccgtttctagtagtccacagaaagcaccttgaccaagtgactgaatacaaatcgtatcacaaactactaggatttcttgggtgcttaccatgtgccatatttccttgaatcttcatgacgatccttcaagggatccttgttttctaaagggtaaaggtgcaggttagaggctatgtcagaagcaagtcaggatttgaaggcagatctgtctgcttttgcccctctgtaaatccagagctgctgcctcatttcttacgttgcccccacccgtgcagcaattcttcctgggaggcctcattgttcatattcataaagggccccattcagtctcctttttggagaaatggccactgcaactctctgttctgacctggggggaaatgttagaccctcaataaggagaatcagagaaagaagaaataaaacatattactccattcccatacttctgtgaagaaatacccgagactgggtaatttataaagaaaaagagatttactgaactcagtcgtttcacctggctggggaggcctcaaaattatggcagaaggcaaaggaggagcaaaggcacatcttacatggcagcagacaagaaagcgtgtgcaggggaactgccctttataaaatcaccagatctcatgagatttattcactatcaagggaacagcacaggcagatcccatggctttgactcagttacctcccactgggtccctaccatgacacatgggagttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataccttttcattagtaactcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtatggaaagcctgttaatgagtacaagtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatcgtgttacccaggatggtctcgatctcctgaccttttgatcagcctgccttggcctcccaaagtgctgggattacaggcgtgagccattgcacccggctattgggtacaagtttcctttggggtggtgaaactgttttggaactagaggtgatagctctacaacactgtcaatgtactaaatgacactaaattgtacactttgaaataatttatgttatgtgaatttcatctcagcaaaaagaggctaacacataaggagacatattttgatacatgtggcatattaagctgctgttgttgttttttaaatattccagctgcgtgcagtggctcacacctgtaatcccagcactttgggaggctgaggtgggtggatcacttgaggtcaggagttcgagatcagcctggccaacatggtgaaaccctgtctctactataaactccgtctctactataaatacaaaaattagccaggcttggcgctgggtttctgtaatcccagctacttaggaggctgagacaggagaatcacttgaacccgagaggcagaggttgcagtgagccgatatctcacctctgcactccagcgtgggcaacagagcgagactccgtctcaaaaaaaaaagcacaaaaaatttttttcttccatctgtatcacacagttgcaacgttgtagcatgggcaggaaataattgggttgtatgtaatgcccagtaaagtaaacagatcttagagagggacaccgatccctaccctgcatggggttattcacagagccatggggacactaaacgtaccttatctcttgaccatgctattgattagttatgtgtttgcctgtgttattaataatgtatacattgaaaaatctatgtgcattatagtctttgatcttgtcatgaatttcaaagccaaagattccattttccttctttttaaaaaaaatttttcaaagaggtaggctggaagtaaatttaaaaattttcccctttctggcagagggcttttttctgatcaccacccatgttaattagatatgcatgtatgtgtatgtatgatgtatatacccatatacacacagtctatatatacatgtatgcgcacatacacatattttaaggaaagaattataaaatgatcaattcaagcttactatatgctagaggtgaggaatatttgaatacaagtcttatctagtagattaaaacagaaattaaagactgtagactaaggcaggatcaaaggacctcttttcattgttcttttattgtttattgacttcaaaaaagactttttagtttaaactgactgtaatgtctcttgaatggtcttttgtaaaatgactttgaaaactcggggataatgtcttcattaagtggagaaaaatcttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatacttcatacaaagctatgaagcatattggaagattttaggtgccctgtcttcctggatataaaatgactccaaactcagtgatactgatcaccctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacattttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaaccccacgtattgttgcaacggcaaaaaagagaattgcacagaggaacaccacctatcagagttcacactgagtttgcagattcatccttttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattacaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttgttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcagactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacaaccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatgtaagatccataatgactcttgccaattagcaggctgctctcttccaagtggtaacccagggactcaagctcttttcatcttgtggctcagccgtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgatgtattgtttgtttaaaatcactttggattctcatttaccttttccccctcaagatctttgtttttgactttggagataaccagaaataactaagcatgcttccttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcctcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgattgacctacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctggtattttcactcttccttcctaccctggatgctgatttgatgcttccagccttagcggttttcttgcttctaggactgaacagggaagagggaaaagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgattgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatataagcaatagtccctgaacatcatttggcctgaactaggctagagtttctcttaatcaaaataataacgatgatttttccatgccaaggagtggtgtcatatcatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgttacctaattccaatgtttcactttattcagcgaagacattcctttgattattctggttaggtgttatgatgccaatttgcccacacattttttcttaggcgcctatgcttgcagtagacagagagttgaggaaagctcaaggttaaaacaggaaaaagtaacacagtaaatacctatttttgtgcataattcaaattaaaaccccaaccacctagaagcaccaatacaaggaactggctgcatattgcattcctgtgacctgctgtcttaatgatggaatgactaacgaggatcagagggaatgtggtcagcctcttatctcataagccaaatgctgcatattccaagcctgtcaattctgaaagcccttgttcatttttaaataatgaaaaactttggggccttgttcattgtttctaaaggaagacatttagaaaatttagaatataaatttctgttagtagaaactaatttctcttgcttttctctaaagtatacttgatttgaaatatgtgccctgaagttttgctatgttgaaaaaaatgatgagccgggcacagtggctcacgcctgtaatcccagcactttggaaggccaaggcgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaaaaaaaaaaaaaaaattatgtcatttcgttgtcacagcgtcagcagaataaatcttagatcaagatgggattactgcgccactcccttcttcccagtctgtggtttagcacgggaaaaagcaaactagggcccttgggccaaatctgatctgcagcctgtttttgtgccgcctgcaggagaacatttttaaattgctgaaaaaatatgaaaggaaaaatatttcaaggtgtgtgaaaactacatgaagtttaaacttgagtgtccttaagtaaagttttataggaacacagtgttgcttatcttttatgtaatgtttgtttgctttgagaccgagtctcactctgtcacccaggctagagtgcagtggtgcgttctctgctcactgcggcctgcatctcccacgttcaagcgattgtcctgcctcagcctcccaagtggcttggagtatagacacgtggcaccacgcctgggtaatttttgtagttttagtggagacaggatttcaccatgttggccaggctagtcttgaactcctgacctcaactgatagacccacctcagcctcccaaagtgctaggattacagacatgagccgacctttttatgtattgttgatacagtatgacaagggaagagttaactgattgcagcaggttagagcacagcatgaagagctgacaatattgaccgactggccctctcagacaaagtttgccaacacccaggtgagcagatacacttatctgtgagcagacgtgattcaggggagattgttgtccctcctttcctaagaaaatgtggaaagatgagaatgttgccaccagtgctgatatggagcgttttttttggaattgtcttaaacaagtcccaaccttgactttgcctgtgtaccctactctttactcccaggtctttgcaaggtaagctgtcaggtgttagctgaagatacggcagcccaccagtggtcccctgaatgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaattttaagtgttaacattgttcaaattttcattactaacacctctcacattgttagaaaacagttttatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccctcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccgctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgactttcatcttgatggacaatgagtactcactctacttttttagtttatatttttattttagttcatttcatttaagacagcgtctgttacccaggctggagtgcagtgacatgatctcggctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatccaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtggatgaagctggaaaccatcattctcagcaaactgttgcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgtaacaaacctgcacgttgtgcacatgtaccctagaactgaaaatataataaaaaatacatattaaaaaaaaaagaactggagcatcgactttcgttttcatttcaagacccgtcccccatgatcacagaggatgaaaagtctgcttaaattataagctagctaattgcttcttcagttgaagacctaaatgagttttaaagtgaaatgcatatctctaagggctaagtagccaacacaataggcaattgagataggaaagactaatttagaaaaggttgttttgttcgtttttctttttccttccctcccttcctgatttcccatcttcttcctccctcttctctcccctctcccccttctcctttccgtccttcctccttcagttccctctttcctctttttcacccttttatttaacattataaatacgatgggattgtgtctgcgcttttgttggtaattaaataaattatttatacatttaacacaatcttgaattaccaggtgatcatcttaggcactcaaaagcataagagcccttgaaagcaatatctaagcatagatattccatagcacgtcttacaatctaaatattgcttttagtgtaatcgaagcagcaagagtagtcacagcagttgatggactatttttcaaattgatttcaaaaatgtatttaaggggatgatcttctagtctagattacctattgatttttaatatgaaaagctcattatgtaagcagtaaccgcatataaaaacctagcaaacctttgcataaatcctttaattgaatttccagagcctgtggttctactttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagtgttcatgccgcaatgcacttatagcttgtgtgataggattatggaaaaaataataaaactaatttccaggggagaatttctaatgtgagattttattttttttcaatttgataattaatagtgaaatcatatcatatatataaatcatattttagcctataaactgaaatggcaattaggaaagataatatatacttgatgtaaaaccatgttacgtgcggataatcttttagcactttaattttttaattgtagaaggagagaattatgaattcaagtcaaacacattaaatggtgggtttcatccaaaaaatctgattcttttactatgtactgtattagtggatttataatattagtgggaggaagtataaaagatatggaaaaagatattctggttatgttcgtgctaaaatgtgtgtattagaattaccaggggaaagaaaaatataaaagctgcaataggtttttctattttttaatacctaacatttgttattttaaaagcaataaaatcccctaaagaaatattcgtaatcaataagaacacaaaatatggaatatattaactgagttataaaaatgtttgtagtatagcacagaatgaaaaacacagcaaggtatgtacggtttaaagtgtaatcaattttgaggttgtatacaaggatatacatgataaatacaagtagtagcatttttagtaaaggctgttacaaaatactgtatttatggcctattccattctttttatagctcattaatgtagaaaacaaacacagtgtatccatcttctcagacggtttaaaattcccttaaatgatgtttttaaatgtaaataactgagctcatttgatctggttcttccttaagccaatgttagcatgaatggccatatttaccaccccggggttccttttcagactccggaaagaaaaagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattcttccaggccacaagggggccgttgagttactggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagccttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcatgatggtatagaataagatattttcatagtgaaaatggagataagacatgtcccattccctagaatagactgtcactgctctcgttgcctccaaggaggaaactgttataggaatgattgacatggaggttcatctgtagaatatggacagccctctacaaattgggaacaagggccaggacacgaaatatagtgacagcctctggcctgggagtctagacagtggtgaaaggcaggattcatggagttttccaagataagattcaagacccaaactatgaatgaaagccaggctgaggctggcaccaagtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatgtaaattaattaaaattaaaagttcaattgctctgaaatagcagccacatttcaaatcttcagtagccagatgtggttattggctaccatattgggtagcaccgatatagaacatttctaccatagtagaatgctcttttggatacatctgctttaaagcattagtccccaaagtgtgaaggatgaaccacttgggttccgagaggaaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccgtacttttcaatgtaagcatattggctctcaatttaaaaatgttattttttacagatagtacacagatgcactgacacaggtaccctctccagtcctctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcaagacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaagttttgatgggaactttgcaggatgttcgtttgtttatcattagccctgggagagtcatccctcgcctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagagagaacctttccttacccaaagatttcgtaactttctcacatccttggttaaggctgagctgcctagctgtctgcatttctgataggttttgctttcatacacatttcaaggacttaagaaatctgtttctaaagaataacttagaatgtgcttgttatggtcccacctattctggggaataggtggatattatacatttatttaggtggaatggtgggtcagatggcttcatgtctttttacatcacagttccacagccctcattagtgaagcagaggttgaaggaggtcacttgctttttatcccaatgtcaaataactccataattttttttattattttttgagacagagtcttgctcttttggccaggctagagtgcagtggcgcgatcttggctcactgcaacctctgtcgattctccttcctcggcctccgtagtagtcaggactacaggcatgcaccaccatagctggctaatttttgtatttttagttagacaccaggtttcaccatgttagccatgctggcctcgaactcctcacttcaggtgatctgactgccttggcctccgaaagtgctgggatgacaggcgtgagctgccttgcctagccaaataactccattatttaagaaaaattaaccagtatttattgaatacttactgggccctgtgctaagtgctttccatgtgatttctaatttcctgaccattctatgaagtggctactataattatcctgatttcccaggcagagaaactgaggcttagagagttgaagtaatcaactgggtgttaaaaagctggtaagtggcacagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctcttcaacctaccttttgttggcttcaaggttatgccatattttgcaaagtcaagttggagatggctctcgatatgcatgagtgtgttagactgcttttcttctattttttaaaaatgcacccaaatgtaaaagacacttttacctttttgatttgatgttgaaggtcatttgaaaaatactctgtctttattctttgaaatggatttactctcaagaaagttgcatgtcactttacttggaagagacgggtctcagtgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcacaagatactaattctttttttcaaatgcagcatcgcttgaagctgtgataaaatatcacacctttggaaatcaaggctcttcttgtttatttatttaactcacattaattagccttaatttaaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatggcttaccttactttttagacataatttttgttttctgttaaagggtcagttatagataagtatgctcccttgcaatgaaatgaacccactttatcaattttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatatattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacctggcaaggcacgctctgctctgccctgccttctgatgagctgactaacaccttatagatgaggttcccttagaaccaaagatgccccatgaaactccctaggatgaatgttggaagtccttccaactgggattcccagccggaaaggaaacagttcatctgactacagggtttaggtttacatgtactttaaaaaaaaaaattaataaagtttatttttacagtaattttaagttcacagcaaaactgagtgggaagtgtagagtttcatatactccctgtcctcacacatgcacagcctcctccagctatgcacattttcaatgaaactacatgttcattgaaaatgatcttttgggtggttgatgttcgattttggctctgtgttgggcctgcccagtgaggtccttttgactccctaaggaaccctgttttgggtttcttttgaggttgaagatatttcagactctttccccctcaacttccataggaaccaaactctctttcttcctcccgtttggttggaaagttattttgcctcactgcgtgatttttctactgcaccaactcccctttcaaacgttattccacaacatactaaattaatgtatactgtgttctttgggtaatggggaggggagcctgtctcacagcacgcatttgttcagctctgtgttgaaagagcactgcccgccgcgtgaaggacatctgctcacaagtgagcaattgtgcttctgatttggggcagcacctttgcttgaacgctggctccagatgaaagaacagattgccgcggagccgcttttccaaggatccctctccccagcatggggcttcatatattattgagagcaaacctactttccaccgccactcctggatgcacttattttgcgagccttattcagaatgtcagcatggatcacttggcaacaaaggcctaaagggcaagccaggaagcttccatggatacgttatttatggtgtttaattattattgtacagatttattaaatgactctgttacctaggagtccatgtagttgctgaaaagagtttgctaactttgaatcgtagatgttttatctgaaaacaaaatttccttgtgaatgctgttaccatattcctggtgtctatgtgagggggtgtgtggtggtatgccggtaagtgttgaacaacctgctctgttggcgggaactaggggaaacaaaccctgttttgtagtatttgctgattactgtggtgtaaatactcacaccttggctgatttcaagttgcagcttggaacttggagttagaaagagatgtgtagtcccataccattttatgtatgtaaagtatttgcactatgccgactaatagacataaataacctcatgagcatagataatagtcacatctactaagattattcagaagtattgagctttgagtatgttttacctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttgaaacagtctcactctgtcgcccaggctggagtgtagtggtgtgatctctgctcactgcagcctctgcctcctgggtttaaggaattctctgccttagcctcccgcgtagctgggattacaggtgcatgccaccatgcccagctgatttttgtattttcagttgagataagggtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcctcccagaaaaagtagatgcatcagcagagttgagcccctgggcattatttccccaattccgtatcccatctactaatacaaactaatgagatctattaaggatgagtccacaagtttgaagggagtctcttactaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcatttgtactgggcatctgtcctgtatcttggagatgtttagtaacatccctgacctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagggatctcacaggaaacttggtaatgtagattttggaggacttgaaaggttcctgctacctttggctggggatggagggaacatggaagatgggtctttgtttagaggaagctctttatcctggtacgctggaagttggcatagtcttagcagttagtccagatgtgaatttcaggattattctgtgagtcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgggtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttctttatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtatctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgaggttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacatttgtgagctcttttttttttctaaccactttcccagtgagacttcagttttcattctccccttagcagctttcaaatatgtacgtaacacaaatgttacatgtttgagcatttaaactgaatttggacagggcttctatttccagaaccttctaactctatttctttgtgacctgatagtcttgctctccagggtaaaagaagaggatggaaatggctgtggggcgcctgaggtgggccctggcatgatggcaagttgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaactgttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaaattttttttttttttttggttgtggtggcgttggcttttacttggggttgacctttccttatcaaggacatacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggacggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagttcgttacttagactaggaaatggctccgagaagctcacccatcaccatttgctctactgcaaaacaggactcattagcaggagctcataaaatgaaactggcagtgagctcatatggaagaggcatcacgggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtcagctcctacaccatgagtgcttttgtatggtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgtgtatttaagctccagtggtactcgatgtgttgttttctttgttcttttttttgagacagggttttgctgtcacccaggctggagtgcagtggcagagtctctgtgcactgcagcctccgccttccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaagactcccctttacacattgccgttcccttgccttctactcctcttttcattacccttatcaagattctgcagcccagggtgctgcttgttgatggacatcttcacctgactttctccctggtccaggtgcattttaagcatggaaggtgacacttgccattctcaatggacaaagggagtggggagtgtgggggtgtgctttggggttagtctctgggttttcgaaacttagcattctcagattcccagccaactggtttcacatgacaagtaaatgagcaacctggaagatgagtggcgtttccacacacagggaagcagatagttccattaggtgacagtgtgtgcacagtttatggaggatgaagcggaaaacctgagccacaaggcagtagaggttggacgagacactcattccgaaggcgggtgtgtatgtgcaaactgtataatttttttcttcttttctatctgctagcaaagtgggtaagttgacccatgacatggtccactggagggaccacatttgtgactctagcaattaagcctcccttctcatctgtggataaaactgacctcccagtgtgctggagtcaaacatattcagcatccaatccacattggactgtttgcatgtaacgtacagaacactcattcatctacatctaggaccataacagcgagcaggagacagtccctgaccctggggactaagcccaggacctgccactaggagatattcatggaatcactgtttctcctccttttcaaagaagactgaatttatgatgaaactttcttcgtatattggctttgagaaattctgttttggtgcttatgtgctctggataattctcaatgactttcaaagttatgattcagggagtaattggttctgagagaatatgcataatcacatcaaggtgtgtttgttttccaccatttgtagccttttgacaaatttctgggggcctcatgcctgctaggccgaatacttgtgtcccttgagcctggagacggcaagtacccagtgtgcatgcatgcactcccaaagtcctttattcacgacagacatcactaatcaatcagtcatgcttagcatactactccaagtagtcattactaatcatctctagtcagcatgggagatactctttaccatcccggtaaagtgacgttttgatgaaaacagcatggatcttcctgcagagaacagactagccccctgtacagcacacaactcggggaattttaggtctggtgatttactgctgttggagcctggccttcttcctgggagaaggctggaaaaacttcaagtcagttacttaatggaataatacatgtttcctgcttccattgtcttcctggacctgacactcactctttaaccataagcagaagacacatacaaaaatgtcctatgttaagaatctttatttaagacaggtggctagcattatttgggtccagaagcttccctggaaagaaaggattcactgcaagatcgacaggcttacccagttcatttaggcgtggctcgattaatgcacacaaagctttgggaacatatcagtcacatcaagctaggtccacctgtgtgagtaagtaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgagaataatgagctaatatgtatctagtaattgctatgcacttatatgtatagaagcgtataatccacagcactccttctgaatacgttacgtaaatggaaccctcgcaacagtcttatccccattgtagagatgagaaaactgaggcatacagaagggatggaactaggccaagagcatagaggtggaattgttgtgtgagcctgtagagtccgtgttcttacccactgcatgatgtctgatcatcgtcaattttctttccatttggacagatgaatggtaacacttccctactaggtagagcaatgattccagaagtttataataattggaaagtgtattagtcgattctcacactgctataaagacattcctgagactgggcaatttataaagaaggaaggtttagttggctcgtggttctgcagactgtataggcttctgcctctcgggaggcctcaggaaacttacagttatggcagaaggtgaaggggaagcaggtaatgtcttcacatggctggcactggaggaagagagaaagtagggaggtggtagatgcttttaaacaaacagatctcaggagaactctttcacaagacagcactagggggatggtgattagaaagcacctcatgatcccgtctacttcctgcagagaacagactagccccctatgcagcacacacctttgtgaggtccctcctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaaagcattaagcaaacaaaaggaaataaaaacggcaacaaataaaacttctgtgctttttgaaattttgtttttggcaggcaacattccaaagatctttttcatttaaagtccaggagtcttctgtgtgaaccccacacaggtaccttggaaagactgcatctcctggattttgcatggttctggcttaatggacaacatatcagtcattttttgaggaaaataaatttaaggcttggttatcggtccttgagtcagcacattgagcgttttgtcaattagctcctccccccatctgtatggtatggcttttcctgtaattacagtcaagatcctatagccggaggaaggcctgtcaattgagtaagaggctgatgttcatcgcacagtgacagcccattcggagggttttaggcctgtccttagagaggcttgttatttcctctttcggtactttgttgcaacctagttcaccgccatcagatgaatggaggtttcttatgctgtggcgaaacccagggggtcaagcccctcggacatgacgtactgcaaagtgaggatgtttcattgatttgtatttttaaaattaaaaataattatttaagctgcatctgtgtgcttataagaaaagatatagaaagattagtagtagactgttgtgttctttttttttttttttttttttttgagatagactcttgcctgtcgcccaggctgcagtgcggtggcatgatctcggctcactgcaacttttgcctcctagattcaagcgattgtcctgcctcagccttctgagtagctgggattacaggcgcccgccaccacacccagctaatttttgtatttttagtatatacggggtttcaccatgttggccaggctggtctcgaactcttgacctcaggtgatctgccctccttggcctcccaaagtgctgggattataggcgtgagccactgcacctggccagtagtagacttttgatagggtttttttttctcaaggtgtaggtttggctaggaagtcatagaaaatgctctttttttttttttggagatggagtctcactttgtcacctaggctggagtgcagtggtgtgatctcagctcactgcaacctccatctcctgggttcaagtgactctcttgcctcaacctcccgagtagctgggactacaggccaacgccacggcacctggctaatttttgtatttttagtagagccggggtttcaccatgttggccagggtggtcttgaactcctgacctcaaatgattccctgcctccacctcccaaagtgctgggattataggtgtgggccactgtgcccggccaggaagatggtcatgttttactttgaagcaatctgtgcttggtttatttttttcagtgagtgtggattacgtttataattttcagttactagttaggtaaagaatcaaaattaataaacacatttatagttctcagagattccttgagagaggaacatctttaaatggataaccacagtcttctaaacacctgaaagggtgtcttttgctgaattatggagttttagttttgctttagaatttttggatgattagacttgtacttcttttaggctatttttccacctggtactatttggctttactgactgccctcattccccatacaccaccttgttttgttcagattcccctaagtcttcattctcgtcccacctccccatcactcctgactacttgaaacacgacttctgtcctcagaaggcagcagtgttccctcctcccgttcatttttcattttcccgttgcttaaaaaaatcaagcatatgtttgcagtcatcactgatgttctgcctcctcttctaaagttatagatgagtgccaagttggcagagcatgtagaaagatcactgcagatgtccttgtcgtgttgaccttattggagaatttcctatctgtgatgacctgtaaatggaatttaagggaggaatcacacgtgttagcacggggttggcattgcgtggctgttttcaattaacttgaccactatcataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggagtccctttagacaacatcactgacaactcactatgtaaaaccaaacaaattattagctttcttactgtgtgtttgcatttgctgtgcccagggaaatgggaagtgcattgaggaagaggccccaagacaaggagaagtcactccaactttccgggaacaccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggccaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatctctgctcatgcttgagagtggtggtgtttggaaagactcaatagcatatgcacatgaggaagttgaccaaatgattccacagcgcatactcattttttgctctgattctagcttttcctccaattttattcagaatttgttcttttcttacctcacaccatatagaaaaatcaactcaaagtggattggagacttaaacataagatctgacagtgtaaaattagtagaagaaaacaaggaggaaagctccatgacactggtctgcacaatgagtgtttttgtatatgaaccgaaaaacaggtagcaaaagcaaaaatagacaactgggattacaacaatctaaaaaatttctgtacagaaaggaagcaatgaacagagtgaagcagcatcctacagaaagagagagaatatttgcaaaccacacatgtgataagggattaatattcaaaatgtacacacagcgtaaatgcaagaaaagaatctgatgtaaaaatggcccttccaacatctagcattattgtgtgttgaataaatacttgttcgattaggtctaatcactcttcatgattggatttccaaaatgtggactctcagcagtacattacagggacagtggttgggtctggagatgtcacccttagctgtttttcacaatgagaggttgttttatcataaataaatcaataaatggcagattatacaccggagttactgagaaatataaaaaaaaaaaaagcccacattttaaagggaatttggtatttttaacaaagcatcagggggccgggagcagtagctcacgcctgtaatgccagcactttgggaggccgaggcgggcggatcacaagatcgggagatcgagaccattctggctaacatggtgaaatgctgtctctactaaaaatacaaaaagaaattagctgtgcgtggtggcgggcgcctgtagtcccagctactcgggaggctgaggcaggagaatggcatgaacacgggaggtggagcttgcagtgagccgagattgtgccactgcactccagcctgggcaacagagcaagactccatctcaaaaaaaaaaaaaaaaagaaaagaaaaaaaagcatcagggttgtcaccatgaagcaggaggagaaaaataatgctgttagacttcttaaagcgtattttgtggtttattttattgctctgtaaattgcaggctgtaattcatggggctcaggccagtgatttcacagttgatagaccaggcacatctcttcccaccccttccccacctaggggcaaggttttcaggaagagccccttttctaaaccacacatggcctgctcacaaatcttatgataaaactctacccactgagaagcacaaggtgtgaggctattgatgaggagttgaaggtgacagagactgagaaagggctgcacacctttggcctaaagggtaatgagcaacacacaaggattgggagatgttcatggcaagaaaaattcagaagggacattgttgtttcactaattctgtaaaggagagcagcggcatttacttaggccgattccccattctctctttctgtttttaaacagagacagatcttgctctgttgcccaggctggagtgcagtggcatgatggcatgatcatagttcactataatctcgaactcctggtttcaagtagtcttcctgccttggcctcccaaaatgctaggaatacaggcaggagccactgttactggtctgtttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggcccttctctttcctcgtgatgcacggtgatagtgcgtatctaacacttgaaggtgtccacgctggccctagctcagtgagatggctttgctttgggggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctaagtggtcaggtgggactcatggagattttccgttctttggagactagcagcgactgcagattactcatcagctgtctccttgagtccacaatgccgggcggtggacgggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttcttccttcctccttttcttctttctttccttccttccttcctttctcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctttctctttttttttttttttttttttttgaaaaacttttttggagcagcacctgcatgttgtaaaaacacaaaataaaaaaaaaataaataaaagcagaccccttggttcagatatctttgtttgtgtaaatgttttggcattctttgtgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctggctctctttcaaactgtactgctcactttgggctgtacgttagaaccacctgagaagttctttttctttcttttttttttttgaggtggagtcttcctctgtcacccaggctggagtgcagtggtgggatcttggctcactgcaacctctgtctcctggcttcatgccattctcctgcctcagccttccgagtaactaggattacaggcatccgccaccatgcttgggtaatttttgtacttttattagagacagagtttcaccatgttggccaggctggtctcgaactcctgacctgaagtgatccacccacgtcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagttaacgtagaaggtttctgggggcatggacctgagtcttatcccctttgcaaaagtaagaattgtatcgtagcctgactcagggttttagccaacttctctggatgctaatgctattctcttctttatacttgtcttccctcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcgtttgatgacatgtcttggcagtgatgtctatgacactgggcaagtgtcttaaaatgttgtgcatcagaaaaaagtcatcattgccaaggccagcagatctcgaaaagggggctgggacacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcttcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttgtcagaggtgcatgctgagagcatgatgggaagatggagtcttccatccactggtaaaatctggaatctgctctcatttcattttcactgaactgaaaataaggtaacagaccctcaggtctacctataagtaccttccaactgttccacttttgtaaatttagttcaaataatacatatgctgaaattcctatatcccccccatactccagatcttcagtgtggaatttaaatataattccttattgtaaaaaaaaaaaatttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataactgaaataccaggtgtatagaaatgcatctgtggaaaaatgaaatcatatattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcgtacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatgtctgtgcatcagggaggatgggagaattaattccagtttctcaattgcaaaagtgaggctggtcatggggcttggaaccacgccacggacgcatgaagcctccccgtttacatgccaaatccagagcttaggcatccatgctcagggctctctgtggtaggcaacagctggattatttactttctagaatatctcgagttcttaatctgagcagtttcgaaaccaagcccacattaattaatataaataatgactgggaaacgttgcaggactccccggaaaagaatgtataagttgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcctcagcctctagaatgcctggagtgagaaaacagaatattgttcttttctgtttatattatttcatactgagttaacacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcgagcactggatacctagactctgctgggctctagagaagtgctgggctacagcgcccagtgccctacctcttggggccagccagcctcaccaaaaaatcaggcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatgtgattctgtagagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagccccttcccgacccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcctactcacatgtttatggcccggtgagaccgcatcctccctttctctatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgttttttttttttttgtacagagtcttgctctgtcgtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccgcctcagctgcccagggtgctgggatcacaggcgtgagccaccgtgcgcgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaaataagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcattttacagctctggcatttctgggtaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattagaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggcctttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctagacctcacacccagtccctattcttaggttttatttctcaaaccaggttttgcctgagaaattacagcaaatgattcagagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgcgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggcaacaaagagagatcctgtctccaagtctgtctgtctgtctgtctgtctgtctgtctctctcggaaatattccttcagtgtattagtaaagaagttacttatgagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgcacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatgcttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgatatcaccattgaggggagcaagatgacatgtgcctaccccacgtgtccagcagcaaagccacctggcatagtgggctgctcagcgtgcctggttcatactgcgtatttatagtcccagggtgttttcagagagtaaaagtcctttatgattagcaaattgcaggtcctcccctttctgatatttacagcccttgcaaccgcctgtacaaaaatcgggaaaaggcagaagacggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcgcgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttagcaatgcaacttgcacttaattttaaaacgctggaaaaataatgataaagattgtgtgatcaagtatagcagccctgtggtgtttcctcagaatggtgtattacagaaaaggaaaaagccatatacatggagaaaaaactcccgatatttaatattatcaattgctggttcctgtaaatttgcatttatggatcacattataaaagcaattactcttatggattgttcatgcagaaatgcattatgatgataatatacttttaaaagtatatttatttccagaattcaatttgtaagaggtttgagggaaaaataatactgagttttgagtgtttctgattttaaaaatgtgttcagtagaattaaacgtgttcaccaaaacccattttatccctttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttactttgcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttcaaagatgctaaattatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcaagtatcttactgtatgatggttgcttttgggttgaattccaccttgggttcaattcaacatgaaagttaaccttttggtgaaggaatgatccacgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaacgggagcgaatagtattttccaaacttacgtcaccacttaccatccacctgcatactttacacgtcttggaatcaaccttacagggaacacttggtcgaaaaacagtgttttctaaatttatattacagttcccactccccccgcccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccgttgagtgtgtgcatgtacaactgcttgaaaacagcttgtgagttcactattaggtccatgaaatttttctccttggcaggttttcactattaatttgcttgacaaaggatagatacattttccatgtgtggaggtaaaagcagtgcagtgagctaaaaagttagcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggcttgcaatttattattaagtggaataagcagtttaaaaacagtatgtacagggtggttttctggctatataaacacacaggcatagaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagcctggccagtgtggcaaaaccccacctctactaaaaatacaaaaaaaaattagctgaacctggtggttcacgcctgtaattgcagctactcaggaggctgaggcaggagaatcacttgaacccgggaggcggaggttacagtgaaccgagatcgtgtcactgcactccagcctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcaatcagtctctctccttccatccccccttgtcccccttttctcttctctccccttccctgctccctctactttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggacacgtgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgagcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttgttattattattaatgttattttttgtttgtttgttttttgagatggagtcttgctctgtcacccaggctgaagtgcagtggcgtgatctcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttataattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctactttttgtttagctgtttttctaatttaatcttgtacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatggtaaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaacctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatcccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgttgttactgctgtaagccactttcttctccctctccgttaaaatgcaacttaattggtaaagtttagttgactagagatttcatttatttatttatttatttatttatttatttatttgtttgtttgtttgtttgagatgagtcttgctcttttgcccaagctggagtgcagtggcatgatctcggctcactgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggtttttttttttttttttaaagaatgcgttgattttgtttttctttcttttttttttttttttttgaggcaggccttaggtctggcacccaggctggagtgcagtgacgtgatcaaggctcactgcagcttccaactcctgggctcaagcaatcttcgtgtttcagcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctcatgccattctcctccctcagcctcctgagtagctgggactgcaggcgccagccaccacgcccggctaattttttatatttttagtagagacggggtttcaccatgctaaccaggatggtctcgatctcctgacctcgtgatccaccagccttggcctcccaaagtgctgggattacaggcattagccaccacacccggcccaaattttcttataaagtcaaatgggagatacttgtttgcaagaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgtattttatggttgcagagcacacgtatcatcctatctgcttctgacacccagtaagcagctctggcttttataattttgatgaaagaagtttcccaacagtatttcggtgtgcatgctcacacaccagccctggtcgtcagtgaacagattcttccaggtcttcattgtggcggaagaaagtgagatcagagatcccgaggaagggcttcagtttcaccagtagtggagctagggagtaggggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacaggtgtcccccagattggatcctctgctctaggacacattcttgtcctagagcaggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagctagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtaggaatgaacagatgaacaaccccacacaacctaaggacaactttgaatcaattcttctaagctggtagcagaagccacctttccatttgacttgtatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccacccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgctacatttaatctttatggtagcctcatgaacaggctcttatttagttcagtggttcttgatcaggagtgatattgcctgccagggaatgcatgtcaatgtctggagacatctggggttgtcagttcaggagggtagaggataggggggaaaaggtgctactggcatctagtgggcaaaggccagggatagtgctaaggatcctgcagtgcaaaggagcatgcccaccacaaaatatcagcagtgccgaggttgggaagctctgtgccattgtgcaaagattcaaggtggctatgtcacaggactggtacatgtccttttttttttttttttttttttgagacggagtcttgctctgtcgcccaggctggagtgcagtggcgtaatctcggctcactgcaagttctgcctcctgggttcgtgccattctcctgccttagcctcccgagtagctgggactacaggtgcctgccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaacctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttaggtaggggtttgaggaaaatgaaaaggcctatttgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttcctttttcttttcttttctttctttctttcttttttttttttagggagggtctggctgtattgcccaggccggagtacagtggcacgatcttggcttactatagccttgacctctctggctcaagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccgtgggctctttttggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttccgtgttgatgaagcaggaaatttccctgacccctttgcaggcaggaagtggagtgcggatgctggaactagctggctgctttggtgccagtagaggtgaactgcactctcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttcagtggagggtcagcgtgacagccttttgcacccacatctgggttcttgtccagtgtccaggaggaatgaggtctcatgagcaaattttaaggatggcaaatgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcataataatttttaacattgattgagtgtggataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcgtgagtcttggcatctttttggtagagaaccttgctaggttctcacaatgtagaaattaagcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggaggctgaggcaggtgaatcacttgaggtcaggagttcgagactagcctggccaacatggtgaaaccctgtctctactaaaaatacaaaattttttttgtattttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactatattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcaattacctcccacctggtccctcctgcaacatgtgggaattcaagaagagatttgggtgggtacacagccaaaccatatcaaaaaccatttacaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccagattcaaagttgtcctgggccgcatgtggcccaccagccatggtttggacaagcttagtctacaggttcttcaagaggggcttgagcatttgaaagacttctagtgggagagatcacaaggtacaagtagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtagccccctcccgaatgcgtcctcagaactcgctggttctcgtcctcgccctcagcatacttgctcattgtttgtttccatctctatcatctctgtgagccctttgaggatggatgtgtgtccatcttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaaaataaatactagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaaccctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtggcattttggcatgattggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttattttattttattttttttgagacagagtctctgtctccaggctggagtgcagtggcacaatctcagctcactgcaacctccacctcccgggttcaagcgattccactgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcccccaagttcctgtccgctggtagaattcacaaagctggttttatgtctccttctcttcctcttccagtgttgtcttttccctgcattgagatagcattgcatggagatccttgtactcctcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaacaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgcgtagcttcatcatagatctcagcttaaggacaatgaaagtcgtttattgagtacttagtatgtgctggttgcagagccaagtcttttttttttttttttttttcctccttttttgagagagagagtctcactctgtcacccagactggattgcagtggcacaatctcaactgactgcaacctgcacctctcaggttcaagcaattatcaggcctcaacgtcctgagaagctgggactacaggcatgtaccaccacactcagctaatatttgtatttttagtagaggcggggttttgccatgttgtccaggctggtcttgaacacctgacctcaggtgatctgcctgcctcagcctcccaaagtgctgggattacaggggtgacccaccacacccagccagagtcaagtatttcaagtattagagttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattactgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcaatggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaagcggggcaaggggttggagaatgttcatatcacattattttggatgtctggggttgcacctggaagctcagatagcaatatctaggcacggctgccagtgctctatacattcacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctgtgtttgacatcgagatagaatttttcataaccctttactagtaataaatttgattgttaagggaccgggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacaggtgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttcccctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacggcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagagcatgttttccctctaaagagaggcagctgataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatccgattcagtacatatttataaaaccacacttacatttaaatacaggcctttcccatttcacagtgtttctagctcccctttccaatacatctctctctctctttctctctctctctctctctctctcacacacacaacacacacacacacacacagccaaatcagacaccaacataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagtgcagtgacatgatcataactcatggtgacctcaaattcatgagcccaagcgatcttcccacctcagcctgagtagatgggactacaggcatgtgtcaccatgccaggctaatgtttaaaaatttttcttagaggtagagcctcactttgctgcctaggctgatctagaactcctggcttcaagtgatcctcctgccttgagctcccgaagcgctgggaccaatagagatttctctgagaattaggtcccccactattaataaggtcattgtcagctgagttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagagcccgccactgcactccagcctgggcgacagagcgagactccgtctcaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacaaattgttcatcaggtgtatctccagccctccgtaaacactgccggatggatgaacctacgtaatgatctcctggtgccattttcctgactgtagatacttgggtaaggaggagactttgactctagatgacatgatgtaccctgtgttctgcaagctggagaacatcatgtagaatctgaaaattaggagagagaggcaatcagaagaagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttcacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagatccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcagtgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttacctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatctatctctacaaaaaatttaaaaattagctgggtatggttgtgcactcctgtggttccagctactcaggagactgcggtagggggatcacttcagcccagaagttcaaggctgcagtgagctgtgatcgctccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacaccagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaattcacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaacaactacccaaggcctgttggaatgtctgccagtttcaacccacggggatagggtgagatgaacattgattgagcctttacatcggagacactataacaaatgctttgtgtacatcagctctttcaaattaatacaattctactagaggggacactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgctatgtcctcatatcgggggaggggcaaagggtctctctatctggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaattcaacatacgaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcagatatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcagagaaagttggatcgaccattaatcatgctatctcgacttctgtgtgtctcctttttgtccatctcttaaatcagtcacttggcagcagcaagacatgtggccactccagaccatttgatcgaagagctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaagcctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgtcattaaaagttctcactggatcattccatttatactcagagtaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataaaccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgtgctggggatggcagcagagtggggtggttggatgggaaggcgggaaagagctagcttggagatgatacgcttttccatccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccactgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgtttgctcttcgcgcctgtgctttgaatggtgaataccctcggcgggaggcaggcacctgatgccactgcccccgccccacctgcccccgccccgtttctcagatcacacaggcaggctgaggagcgcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttacctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacatgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcacgcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacaggtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaagctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagttgttccacagatactttgagtgcagtacaagttggtaatgggtaacaggctaaaccatgtggcaccccttccctcttatcagcttcttgctaccatgcagaaaagtgctgaaggtggcctgccctaaggcagtagcactagagcagggatggggaggacttggtggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacctagcatatgaaaacagttctggctgatgggttggtagaagtgatagatatagatacatatatacacatatatgcacagtaatagatataggtaaagaccttgatatatgtacatatattgtatgatacatatccatgcatatacgtgggtgtacacacacaggtacacacaaatatatatgtgcctttggacaaaaaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcataggcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccactttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagtgcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattgtcgcacctcagcctcccaagtaactgggattacaggtgcccaccaccaagcccggctaatttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacgtcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttctacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaaccttcagtctgagttgggtaccttgcatcctcctttgttcccatactaacccctacaaccatggtcattttgtggttatctgtttaattctctgctggctattccaggctgtcagctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctctggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttaatcgtgtgaatgtattgcagaaatggacaggacaattctcagcccattcatcttacagacctcaagtgaacaggcacaaaacaacaggctccaccctccttcccccctctatctcatactttacctcaatttatgacttggcttacaatccgttgcagaaagcctagctccccagcttctcctgaatctacgtttttctattttgtctgaactagccaaggtctctggagtttgctgttatattgcttcagagaaattagtgacattgaaaggctgttgtcttttttagtgtacttttggttgttaggagaaatttacaaggccatttttttctcccgtctctgcagttcaggagattatattagaaaatattctatacaaaaaatatgcatagtagggcttttctccagctagtagctcagaataagtcagtactactgaaacaggtaccttttgtggaattgattctgaaatctgtttggatctgaaatctttctttcttgcctttgagtaagatacggcagagaaaaacaattacactagctgctggtctgtatttactggttagaatagaatattattaccatcaagaataacattagtggccaggtgcggtggctcacgcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgcctgtaatcccagctacttgggaggctgaggcaggagaatcccttgaacctgggaggtggaggttgcagtgagctgagatcacgccattatactccagtctaggcaacaagagtgaaactctgtctcaaaaaaattaataataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctctagctctcacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccctaacctcccaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatcgctcccctgaatggaggtgaaagcatgcaagctaggagttaagatctttaactcagggaagaccctgtctatggaagtgctgagctcttcagtgtcatcacagaaaagcatgagcccctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagataccaataattaatatctatggttgattgtaaaaatggccaccaattcttccctgtcccctgcatatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttctgggtgcgaacaagcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatgaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaaggcaagtagaaaacgaaaacaacatcaaaggatacactacacaattgttggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcagtctcacctggtcaagatgtcagtagggcttgttccttctggaggctctaggggagaatctgtttccttgcgtttttcatcttctagaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagtagagaatataagctttatccagggggccactcagtgatgggagtcttccttatgaagctgtcccagctccatctctcaggactgaaatgtgggtaagaccatcacatttttcatcccccgccccccgcccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgcctgcctgaggctctctttctggttcccagatggatgcctttgtgtgtcctctcatggcagagagaggaaggggtctggaacctttctcttataaggatactaatcccatcgtaccccgtcccccatgatctcatttgaaattagtcacctcccaaagccccacctccaagtactgtcacactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgctgccttgggcctgtggcttctcctccctgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgataggtgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccagggtggtctcgaggaggcccattaccggctggagtgacagagtgtgtcaagcctgcagctcgtcccgtgtctaatggaacagaaacaagcaccctgctgcccttgttttccagtggctcaccggggctctgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgagggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctccgcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctatcagtagatgcatctaataatcctaacactgtcatccttatacttgaggtcttattgtccacttctaccttagctatgtaaacagatgagtaacctactctggatttacccagatagtgctgttaggcaccacacacgatgagattggaggcacctgggtgtcagcctcttgggctggctcattacaggccactctgtctgaggaacactcaggtttgcaaaccgtttcttaaaattacaggatacctagggacctgttggggtgggagggaagaaccctatgggcagaaatgtgactttctgtagcaaagatgtactgtttcccactgagaagaatcaaaaatagaaaagtgcttccttgtctctctatattgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgtgtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttttgggtagaaggaacagaaagtgaaacggtgccctggcaaggcaaagattattcattgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttacataggagaatatatacagtatgattcaatttatagaaagcttaaagtataggcaaagctaaacattcaggatatttgataaaactataaagaaaaccaagggaatgaagaatgcaaaatatgagctagtgttttcccaggtgtgagggacggggcatggttgggaggaaaacagaatggtgccatggcgagagatacacaggggaggtattggaaagttctgtttcttaaaatgagtgacaggtacctaggtagtcattctatatgttattaaagtgtacacacattgcttatgtgaagtcttgttatatgtggcacatatcacataatctgaaagaatctgcttcctgtagtaaaaattaaaaaaattatagccgggcacggtggctcacgcctgtaatcccagcactttgggaggccaaggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtatcagatacttggctgttttgttttttcttcttagccattttgacctgtgagattttatgtgatgaaaacataagaatgtggtattacaccctgtgatttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgctgactgttggctgttggctggaggtacccctcagctcctagaggcatcaacagttcctgaatatctgggcttttcccacaaagcagcttccttcatcaagccagcaacaagagtttctggggcaagttggtcaacaagatggtgtcttacatgcccaatgtaatcatggaagccatgtatacctcatcacatttgccagatttctgctgattaataccaagtcagaagtcctgcacacattcaaagggaggacactgcacaatggtgtgaataccaggtggtagggattatgtggggccaccttacagtctatcagccacaacttgaagtatcttctctcctctttgctgccaaataatgtctctgaagactgtaagacctgaatcctatctaaagttgtcggtggttgcttccttcctgaaagcaacaagaagcccatgaatgtcttatggcctgaagatctgccttcaaagactactacctgtgttgtcacaaatggcaagatttcatcctttttatggctgaataatatttcactgtatatgtgaaccacatttttaaaaatgcatttctgaacctgaaggacattatgttaagtcaaataagccagacacagacagacaaagacatatgatctgactaacaatgtggaatctgaaaaaaccaagctcatagaatagaaacagagagtgagaatggtggttgctggggctagggggtcagtgaagtggggaggtgttgatctaagggttcaaacttctcgttaataataaaccagttctggagatctaatgtacagcatgagtggtgatggatgtgttaattaattcgattgtgataatcattacacaatgtatatagtaatcaaatcattactttatagaccctgaatatattcaatatttatttttcaattatatatatatatatatatatatatatatatatatatatatatatatatatatatatatatatatatatatatatatatatatatatatatatatatttaaagctgtcatggaaagccttaaagttaaaatacgaagatttttgagaaaaactttgcatattttaattgctgtctggaatcctccttcagctgggatgagaaatcatctctgggttagttctgtccctggaggtgagggccagacaacacatcaaaactgactttttattttttttcaaagttgttaagactatctaagattcagatctccctaatactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtctgatttcaccccatcctaagatcttgtgacttcagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgttgcatagaatgactctcctgtatgaatttttaaaagaaacttcaatatgctatgcatttgaaagggaagaagtaatcaccataatcttgaggtatcttttaaataggcttcctgcgcagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagctatgatgtgttttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcaggagcatcacttgaggccagaagtttgtgaccagcctgggcactatagtgagaccctgtctctactcacataaaaatattagctgggcatgatggctcataggtgtagtcccagctactcaagaggctaaagggggatatttcttaagcccagaagattcagactgcaatgagctatgattgtgccactgcacttcagcctaggcaacacaacaagaccctgtcccttaaaataaatgctgccttgggtatcttaatcctttctcaagattccttctaaggctaacatttctttgccatccccacactaccatctgctcacttttatatatcttgaccattttatttttcatcccatcttcactccatgtaattagttagctattgctgcagaacaaatcaccccaaaattcagtgattagtttataggtagccccatttcacccatctcattctatagctcaggttgaaagttgagtcatgaattggggaacattcttctcttggtgtaaattagtcaccagtgtctcatagggttgggctgaaacttaacacatcccatcactttgattggctaaagtcagttacataaccaagcccagcttcagaagggaaattgtatgccttacaaggaggtgagaggatggaaaatgaatatttgctgaacagactttctgtccagtttgttgtatttggtggtggtgcagggcaaatatatgtttaaaaccttgttcagatttttagctttcttcagaacagagcttttaaaactgagcatttgtcccctaaattccagcactgcggccatgagtaaagggtgccctgaccacgagcaaatcatttagctggctcacctttcatgcaaccttgaattcaccaggaaggaagttcatgcagccctgggtatgatgccctaattttgagccaagccagctagagttcaagtccaaaccattccacttcctagctttgggacgatgaacaatttacttatgctttctgggctttggttcctaaattatttaaatggggatgattacatacattcatcattttcaccttctcaaagaccttctggacaattccccaattcatagctctgggagacagtgtgttgacactctatttgaccacatcttcctagcagtcttgcggaaggtgccactttgcgaacgatctgttgctaggtaatgtcaatgacatgactttcagtttagcacatgtacagatgaccttgtttgggcttgtgccgttggtaattcagtttcaggatttccgtttgacagaatatattcaagggtggtttcttgctatcagttgtacccttgtggccacagtttttccagataaccaagactcactaatattttcacaagaacatttgtcacctaggtccagatttcagaggaaaaaagtataccgccattgttcttgtataaactttataaaatatttggggaacatcactagccacctgcttccgaaagtacttagatactgtgtcatcttaatacaagacactatgcactaattaagctgttgttgatgcttttttgcctttttgacaattaaaaataatctcataccactggattagtctcttgcctttcaattttatgtttatatacaaatatatgtgcataccaaattttatatatatatatatatatatatatatatattttttttttttttttttttttttggtcggagtctcaccctttcacccaggctggagtgcagtggcgcaatctcggctcactgcaagctccgcctcccgggttcacgccattctcctgcctcagcctcctgagtagctggcactataggcgcccaccaccatgcctggctaattttatgtatttttaatagagacagggtttcaccatgttatcaggatggtctcaatctcctggcctcgtgattcacctgccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattgccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttcggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgaatataaaccagggggtaggaaacaacatgagatgaggctggcgagagagaaggatgccaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactatgtgtgttttcacttcttctttctttagagaaaacaaatatcatctgccttgctaggtagttgtgagaaatgaggagataatatctttaaatctcctacggtgatacctggaacatgatggtgcttgggaaatgtctcttcttctgaaatgaggctgcctcgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctcccaagttcaagtgattctcctgcctcagcctcttgagtaggtgggactataggtgtgtgccagcatgcccggctagcttttgtatttttagtagagatggggtctcactatgttgcccaggctgacctcaaactcctgcagtacagtattgcaccttcctcggcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgagcaaaagacacagaaaggatttctttatcgtaagcacacttctctacattacctttataatccaacaactctgctattagtaaattatagaaacaacttttgtaacactatcttgtttgcagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttattaaatgactttaatcatatgaaaatcagccatcagccttattagagtggttgattttttttttaatctaagagctttcttggttattttctgttcttaatcattgttgtatatccttaatgcgcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttattgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgggtttgtcatcctctatttgaaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcagtctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctcttgaagaagatgggagttaggagaagtgaatcttttgttttcgaagcctttgtccttgtgagtctcttaattggggtgtcttgtaatgcaaagtctttaaagatgtgtgttcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctcttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatcaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaaaactgaaacagtaattcccatgtgctgagtttgctgtgaggattaaagacaaggactgttctaagcccggcatataacgggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagttagcttaccagggggtggtgatcttaaaggggcaggaaggagccttgtggtatgctggaaattttccattcatctggtgatgtgatcacttggccgtgtgcacgtgtaaaagttcaagctatatgcttaatatttgtgcacgtcggtgcgtgtaagcaatatctcaaaacatttgagagaatttcccattcattgacagaatttttctcccgcctcggtcaaagcacacagtgggttttcccaacaactgaggtgcctgagggttgggtgccaaagaggcagaaaggccgagatgaccgcttgacctaattccctattcagctgaggcctccacccctggcctgttcaaaggcagttacggatcttttactcaaaacctgaacctaaaaagaaattctttagccatgtccgtgtgaactaaattcagcgtcagatgtacaaggctgtggttctgaccacccccgggctatttctgaccacaggacagcttaaatggtgtggcccataaaatgtaatctgcaaactcaggctgaatgttgatctatttagggccaagagaagaccaggccttggcagcagttctccctgaggtaggatcttaggtcgaatggagaccatcaccctggctgccagccccaggaggctggaaattcgttagcattctttatctttggggatcggccacttacttgtggggttgactcttacagcctttgaccacctcccaaaagctggattcactgatgggcccccaactcaactttcactggccaaagtacttggggttaatttagcaaaccccaggatccccagagggtccctcggtattgtggttttctcctcgcttccaccttatagtggctccaccaggacctcttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggcctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggtgggaggattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcaccctgttgcccaggctggagtgcagtggcgtgatcacagcccactgtagccttgacctcccaggctcaacctatcctcttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaaacgtgcatgaatctttcaagataagtgtcttattgattatcctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggatactgaggctcagagaaagtgaggtcattgagtcacttgagttcttgttgagtgttctttcctgctgaggtgtcctaggtgcctcttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaatgtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtccaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggctttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagagaaacacatataggataggaaaatagcttgccatgtctgatagatattaggcattcagtctctctctctctctctctctctctgtttattatagatagaaataaaaaaattataaatagaaatttatttctcatggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgacgtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggaccaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgagtaactgctctctgaaggtggaggctggactgcttcactggacagggtggcctggggttattctagtgcagtggtagctggtgacaaaactcaaagaagatgtaactagagaaaaggtactcagtgcagcctctgtgagctaccaccactgcctctagttttccagaaaaccaccactgaccactctctgtacagatgcgctcaagcgaccataaccaccagtgttcctaacaatgcgcctattgacttcttatttcaatagatatccagatttattatccctcaaggtaagcatcgattttacctttgtctcagtcaatatttacctctgaggtcaatacgtgtggatattcacctcagctgcagtcaatatccatttcgtattacaatatatgatgtgcatatgtgaaaataaagaacagcatggtacaaaaaaggtctgctaggcaaagaagctttttgcaaagcggatgtgtttttgttttattttttgtttgtttgtttttactgtgtcactttttagaggtcagattctatttcactaaataggacatatgtgtcttctgccaagatgtggaattttggcaaggctagcatgataacaaataaacattcaagcagtcacttaatgatattgaattgaacaccatttctcagaagttcctgtattaaattacaaccataagaacatacacaagcatgcagattgtaagtgtgatgagaatggaaacattccataggacgcagagttattcctcaagcccctggactcgcagagaatcaggtgtatgaagcaagaggaagaagacaagaatcaggaggcaaagagaaggaggaagaagcctcagtggggttgcttctttttatttcttagagccagagctggaagacaaggcctggcatattttggcaggcctggatcagagcctaggtgtgtaaattaggaattgcatttggctgctgctaacaaggacccaaacatggtggtaaattcttccacataaaacaacagaaaataagttgttttctggccctgggctggggtggccactccaccgtcatcgatgatccgggctccttttctctttctgctttgtgacattgcttctatcttcatgataactcgctgcccagaatgaccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcttgatgggggaatgagcatatatcaaaccaggacagtccaagtccttccggggactttgctgccacagttgacagggggaggtatttgcataacttcaccacacacagctaagctggtgatcctgctgcttggcagcatcttcccagcgtacaacagaggaaaactgcctgttgtagttaaaaaaaaaaagagagagagagagagagactgatacacaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacacttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtcaagaggcttggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttcctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagataattagcatagccatcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgttgtttctgctcattttttatattcaaaatttctaatcatgtgtgactatatatgtattatacatggtaggacttatttttttaatgtgaaagaatataaaacaaaatacgatattatcttttgagtgatatcaacaaaacaaaacatgatatccaaagtcaccctgtatggttggatactttgggtttgccatcttttcttttgttcatttgtttcatgcaatagaaacgttttgagatcctgtctggctgggttctgctaggcctgggtctacagcagtttgctgtcaaggtcttggcccttcaagagcatgtagtgtggtggggaaggtgtacatcagtgaagaggtaatccaggtcacggtgggatgacacaggctgctgtggcaacccacagcaggaatagccagtcctgccccagcagggcgtatcaggggtgctaaggtgacttccaagattgaggttggcgagttcgtgacaggtgtgcaagatggggtgttccaagactggggacaggacaggtgtgcaaggaccagccagctgaggtagaggaaacctagacctatggaacatgctgatttcaaggtccatttgtggggagaacacggactgtgtcattggaagccagcagggagaatcagttgagaggtaagccgggcctagtagaaagtaagcgaagccctttcattaagtgaacgaagggtgcatggtgagtacacagccatgaaaataaaatgatataaatcagcacggtttcagctgccctcccatctttctactgtgatctcagcagtgatggggctggctttgagggttggagatcacacacacacaatcagccagctctccaaagcaagccccacactctcttgatgctatcctcaataaacatgcggtctaaacagtaaccatgttctagctatgcagatgcagtttaaagacaaatcctttgagcctccagcatgcgatcccctcccaatctcattgctgctcccctaccctcttctgcgtagaagcgctggagccaggtgcttacgacctgggtgctagtatctttgtgaaaactgctcctgacctattgctttgtttattttagccggtgcctttgtagagggaaaacagcttagcaagcatttagtaggtagatccaaagtccccaggagctgttgggaagtccataggtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttggtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtatatatatatatatataaaatatatttccatgaatatactgaatgctaagccctccccactttttttttcttttttaaattcagaaatttctagttgtgtttattcccctcgtcagcatactttatcatatcaaagccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcaaacgttttgaaaagaaatctcctttcaaaaatcacagcactggttgaagcaggagcatctctccccttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattcccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcccaaggctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatccgatctcgtgagacttgttcactatcacgagtaaagcacaggaaagacttgccctcatgattcagttacgttccaccggggccctcccacaacacatgggaattgtgggagcgacagttcaagatgagatttggatagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatctccattttaagtattcttttctttccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggactcagatgtcactgtgcaggtgactcacgcctagaatcctctgcctatcgtgacagggagaagcctgtgtgaccctgtggccatctcagtctctgcagggcatctgtagctttggaggtacctgggcaagagactgcctttcctactagagcttctgccatccctctgtcactatttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgtaaacactgaattctataaactgttggagacagattctggagagacactcaggcttagctctagaaagaaacgggtaagacagaggaggttcagggcaactgtgttgccttccttgactggtgcatgggaattccccagcagagagaaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctggatagattttttttagacagagtctcgatctgacagccagactggagtgcagtggtgtaatctcggcttactgcaaccttcacctcctaggttccagcgattctcctgcctcagcctcctgagtagctgggactaaaggcacgtgccaccactcctggctaattttttatatttttagtggagacggggtttcactatattggccaggctgatctcgaactcctgcccttgtgatccacccacctcggcctctcaaagtgctgggattacaggtgctagccaccacacccggcctcttctcgatagatcttatttggctgacaacgaaagctgttgtgctggtagcatcatccctttgcatgcaaaagataaactgaaatctgaagtagccatatccttccggccaggtttttcaagtggttactctgttctgatcattgtcatgacaggaatagtgaaaataacaataaatcatttttctttaacgatccatttactgtatgctgggcactgcacaaaatggtttacatggtttatcttgtagcgttccatttaagtctgctaagagtagatgctatcattctctccattttacagataagaaaattgaggcttagagaaattgagtaatttttgccaatcctgagacttgaatctccgctctgtcttctgcatacactttttacttgtcattgctgattagctttctctttccatctccctgatcagaaccattctgcgttcttagattcaacaaaatgtaatactccaccttgccagtatctagcgtgttttcagaaattgtgaacggggtggaggtggagtactaactgcaatcagatgttttatttgtttatttatttttccttcttgcgttgctcttaagcccccactcttgggcaaggctctgtgctatgctgttttatgcacatcatcttctaacagcttctctgccacacctggagaagtgccaatatcattttcatggcacagataaggcattggatgctcatagtttaagtcatcaggtggtgactggaggagccagaaggtccctttgggcctgtcctctcaccagcatcaactgcaccaaaaagatctcattctgattatcagggatgaacccccccactgggtgatcaggcaaactacatgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacctgtagtcccagctactcaggagactgaggcaggagaatcgcttgaacccaggaggaggaggttgcagtgaactaagattgtgccactgcactccaacctgggcaacagagtgagacactctcaaaataagtaaataaatataaaataaaataaaaaatatgtcctgtaatgaaattgaaagagaacactttgtttcttatctagttggaacaagtggggtggggacagacaagtgactgaccactctccatctgactcagtgtcagtagactctctcaaaaattagaagctggctgacatagtggctcacacctgtaatcccagcacttcaggaggctgacgtgggaggattgcttgagcctaggagttcaagatcagcctgggtaacatagggaaacccttctactacaagacatagaagaaaattagttggccatggtggcacacacctatagtcccagctactaaggaggctgaggcggtaggatcgcttgatcccgggaggtggaggctgcagtgagctgtgatcacgccactgaattctagcctgggtgaccgagaccttgtctaaaaaataaataaataaataaaattagaatctgaattttgaagacacaaattcagatgcatgtggatgggcccaaaatactttgtttacatgtactccaaatgtaactcctggggcacccttccttattttctctaccacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctccctccttcccttcccccctccctccttcccttcctccctccctccttcccttcctccctccctccctccctgtcttcttccctccctccctcccttctttccttcctttctttccttcctccctccctcactccctccttccctttttccctccctctctcccttcctcccttcttttctttcctttttaaatgctgattttgttttctttttaaagccctcagttggcaaacttaaaagttgttaagtctgtgttagcctggctagctttttttttctctactagaccttcaaagtctaggaatgcctgatgtatctgtatcctgtgagtttgccacttcatgatatttgatatgtcattgtttccccataattttttcattgttagcgttgtctctccagcctcctgcttcctcttcctctgtctccctcatggtgtgtcttgctcaggcatgtcttatataatcaatatttagtgatttgacttcttaagtccttaaaaaaaaaaaaatccaggtgcaaaacacaaagacagggctcatgtcaagggagggaacctcgctcttctactctcagtgaaagaaaggcaagaccactccagcctattttttttttctttcccttggcccttgtcaaaagggtagccagttttctgttaccattgtgctaactgaagaatggaaaatatgcccagagtttaaaaaaaatcaaccaatgcctgccctttctagagcaacctaattaacaacccaaatgttaaaatttctttatttagaaactcagctatccagaattacaactccgcctctcgtgcttggaggcatagttctttgtcatattcctgagtgtctacagatgatgaaaatagccagttatctttgcccttcatggaaaggataggaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcacatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaagaaagaaaaaaaaaagggtgcttgatgccctgctcctgctatgtccgggaatttcttgtacccttcatatgagcccctctgaacaaaagcaaatcctgttgacctgtcagcttaaaaagacaagaaatatgccacattccgcaggaataaggagaaaagaatggtgcgaaaatcagtgacacgaagttgaatatgtgaacacatccagacaaatgtgaagccagcccgattaggacgactgaaagggcatttccccagaattgcagttttttttttttttttttttttttaaataggggacgctattgtcattcagaaagccacaggctgttctgaaaacaggcaaaaatcaatagcccacttgttgaggataagtgaattagcctgtgttgaatgtaactgagtacctgaacacttgagtgggcagggattgttggggagaaaagacaattgtcttttatgtccacagcggttcacatcgctgattaattatgtccaatgatcatttttgtgcaggactaatgggcagactctgtttttgtttttgtctgtctgcccacaacctggtgaactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttctttttttttttttttttggctgtctacagagaaggaggatataggggcccttaagagaaaaactggagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcaggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgggagatggaaccattttagtgcatttgatatgatgtgatgtggctttctccaagcctgagagtgcctgaaacccagagaggtcgtacgttgaccatgccacggggcccttcctggtaaatctaagcagaaatacaccatgcatgagacagaacaaagaaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccgtgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacgggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttactatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttttttttttctttctttcttttctttttttttctttttcccagactcctcatacccctcctaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagccatctgctaatccctgtgatttaaaaatgtgcgtgtttttagtttctgtctaatttcaaccttttcttgctttagtgattaattaccaggtttctctattaagagcttgtgcgtgtgtagggggtagcatagaataaacaggctcagagcccccacccccacccccctttaagtaacagtgacgcaaacgacctttatttagcagaaggtagctctgcgaatccgctgaatgtccgattgcgatctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacagaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgttcatcatttaattagagatttgcttattgaaacgactgaaataggtagttgaaattttgcccttggacaagggagtaatttgtgatttgctacgttcatttcgtgagacttttggtgaaagacatctccttctcatatgtttaggcaagcgttgatgacatcaacctagccttttattttaaatcccctgtcaacgcaattagataatacaaaaataacaaaactataggaggttgaggatggggctgggggccaaggagattacttggtttgaaatgaataaattgtctatcgtaagggaattctttggtgcattttattgtgtgaaatgagcctggtcatatgactgccctgcctccctggaggcctccctgccctcctccttcccacagacacttatgggaggtactggccaactctgtatggccagtactgccctaagcaagaccaagaagcttagtctcaatttcagagagttattttggcaacatatttgggaaaatgatagttagatgctgcgttagccagcctctgcatgattttttacgcagaacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggcccttgaaggtttgtgaaggatggcaaagtgacttggatgttgatttctaaaggaggtaaaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtaggactacagttgtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaacatgagtgctcaagaaatagtaaattttagtatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactgtttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctccactggttcaacacacctgaattccggattcaagatgcaatcaccactactgttgttgtgtaagtattgctagagatggctgcagaatacctgggaaagctagctaagcagtgactggaggaaggccccagctctttggaacgaactttccagccgagaatgctttccaaaatgggaacaagatcccaaccccttatcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcgtgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagatgcacaaagcagagggaatcaagtagaataacatggtttatttgtgtgtgtattgttctgtttttggtaaaatcatgcttatcatatcttcaatgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgcctttttgatactaacgctacatgaagagggacggggccaacagcaggctcttccttgacgtgttttatgtacactccagaaatattgacagagttgtctttttgttttggtttttaaatgtttttttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgtgtaaaataatttgtacaagtttatatttttagctaaattaaaatactcacattcccattattttttagaggttgtaagctaagtaataacattctagaaactctctgttttttgaaagggcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcactacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgaggcggagtctcactctgttgcccaggctggagtgcagtggcacagtctcggctcactgtaagctccgcctcccgagttcacgccattctcctgcctcagcctcccgagtagttgggactacaggcgcccgccaccacactcagctaattttttgtatttttagtagagacagggtttcactgtgttagccaggatggtctcgatctcctgacctcgtgatctgcctgccttggcctcccaaagtgctgggattacaggcgtgaactactgtgcctggccaggataatctttaagaagaagataacattagctattcttctcacttcctacgtagaattccctaccctgtgtctttggcctggaaagggtattggtagcaattgtcttcggctttccctgccatgtgtatgcattcccacggccacacaagcacacacacacttttgtggttttttttttaattatataagcaagtaggatgtttgtcttagtttttttgggctgctataacaaaatgccatggactgaataatatataaacaacggaaatgtatttctcacaattccggaggctgagaagtccaagaggaaggcactggcagattcagtgtccggtgaggatttgtttttgatctcataggtgtccatcttgctattttctcaactagcagaggcaactctctggggtatcttttaaaagggcactaatggccaggagtggtggctcacacctgtaatcccagcactttgggaggccgaggcaggtgtctcggtggatcacttgaggtcaggaggtcgagaccagcctggctgacatggtgaaaccctgtctctactaaaactaaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctaatgacataattacctcccaaagtccgcacttcctaatgttaccactctggaggttagaatttcaacatataaattttggggggacacattcagaccacaataatgttttataatgttccttttgctttaacaagagacacatgtcagatagtagacatgatctgagaagacacaaaacccagcgtggtgattttggcagccttgccatgcatctctaacatgcacatggccagaaaaatagcttggacattctgttcaaccctccacatcaactggtcagtttagtctttaaaaggtgataggcctgttgtggtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatccacatgttgcctccagcatcccaggaactccgttaatgtttatttgaatgatggaatgaaggtgtcttgctatattttgacatttctgtcaaaatatgaatctatctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatgactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaccatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgctctcataagagacctcttctcaacaggatccatgtttgatccgggggaataaagctagagttgctttcttccttgtaatatgtataatgactcatgagagaattccccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattccagcactttgggaggctgaggtgggaggatcactggaggtcgggaatttgaaaccagcctggccaacgtggcaaaaccccatttctactaaaaaaaaaatatatatatatatatatatatatatatatatatatatatatatatatatatatatatatatatatatatatgtagccatgcatgggggcctgcccttgtagtcccagctacttgggaggctgagacatgagaatcgcttgaacctgggagtcggaggttgcagtaagctgagatcgccactgcactccagcctgggcaacagtagcaagacgccatctcaaaaaaaaaaaaaaaaaagtgtaatgcaagtagaaaagggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtaaaaagaaccatgtgaactgggcgtggtggctcatgtctgtaaagccagcacttcgggagtccaaggtaggagggtcacttgagcccagcaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaaccaagtgaaagagaaaatgagactaatctctaacctcagcttccttttctgccaaatggaagatcatctctaattaataatgagttagaatacctaggacagtatttggcacacagttgatgaggatggtgtacctagtagctaatggtgagtaggatgaataataatactataccttttggtttctgaaatgagaaatctaaggaactggcttaaccaagaagcagcaagctgttttaattgtgctgttaggagggctgtttgttaaggtacagaagaggattggcccatggctttctgctaagaacctgctgaatgtctgtatagaatccctgcattgtgcctcctatcaatcaggtgcttaggtttgacaagtttcctccaacagactcgtgtagaagtttctgtatcaactggaaaaaaccatggtgcttgggacattcaaggccgaaacttggtccctggatgggagaagatagctgtatcattggcagaggtgccttggtcatgtaccctctccagactagacactagatagtgggtagggtgggacagttttatgtcctctgccaccttatctgggactcttgtcccctgagaagtttgaaaatttggcacattttagtatttgtcagtgtacttcctgcttcttgatgcacttgtactgcacaagaattgattttcaggaaatatggtttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttgattttttcatgtccaggtcactacgtattgcgtatatttggttggaattttatttttgagcaattcatttacccagattgtgtttctggagattaaagcatctcactgtatttttatttttttctacattgcaatttcaaaataatccaactcaaaggctgttgaaaggctccttctgtttaaggtaaagcctgtggcagcctttaacttcctttctcttctcctgctgccaccttggtccacaatttatctttgaaaatgctgggttttaatgggcagggtatagtgcagaaaccagatggttttaactcacacctgtgaaaatgctggggatctgcgaaacattaaagttaatggccagaataaggctgccaagctcggtggaattgtacttaactggcatatcattctggttaactgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagttgcttattcttttcttcttccagttgcatctctccctctacttagatacacatttccattttacttctatttggtagtctcagaacttggcttttattggccagtatattcaatgattcacttgcacctttaaccttgtgttgttctaatctttttttttttttttttttttttttttttttttgagacagagtcttgctctgttgtctaggctggagtgcagtggcaccatctcggctcaccacgagctctgcgtcgtgggttcatgccattctcctgcctcagcctgcggagtagctgggactacaggcactcaccaccatgcctggctaattttttgtattttttagtaaagatggggtttcaccatgttagccaggatggtctcgatctcctgacctcatgatctgcctaccttagcctcccaaagtgctgggattacaggcgtgagccaccgtgcccagccttcttgttttaatcttttagacaactggacacaggtttgtctttgaaattgtcctggtttttcttgatgttttagtgctcctggatgtccaatgtcattcttgggctagttgaaggaaagttttggctacccagttgttagctgctgaagtttaactgtgcattctaagcacaccagtattttattacatcatacctgggcagcagataattttagtaaaaccttgaaaagatatgactattgggaagaaatttgggattctatcctttttctctccattcttctctcctgcaccaagtttctaagctcgtgattaaataaattctgaccctactctgataaaagtgaacccttgtggctggtcgcagtggctcatgcttgtaatcccagcactttgggacgccgaggcaggcagatcacctgaggtcaggagtttgagaccagcctggccaacatggtaaaaccccacctctactaaaaatacaaaattagtcaggcgtggtagtgtacacccataatcccaggtacacaggaggctgagacataagaatcgcttgaacccaggagacgggggttgcagggagctgagatcgtgccactgtactccagcctgggtgacaagagtgaaactccatcttaaaaaaaaaaaaagtgaacccttgtagtttcttcctctgtttgacagacggaccctaagacggccccagtgataccccacctcctggtgtccaaggcctgatgtgatcacccttcccccaccttgaatgtaggtgggacatgggacttacttctgaccaatagaatatgaaaaagataataggatgtaactgtttagattcggttacactatatggcaaagcaaagggattttggaaataccattaaggtcttacatgagacagattttgagttaatgagcagggggatcctcctgggtgggcctgacttagtaaggggaaaatcccttaaagaggagctaaaataagagagtctctctctccattgctggctttgaaaaagtaagctgccttgcagtaaggaactgcatttggcttctaggagctgagagtgccctaaggaagccagcaagaaaatgaggacattagtcctataaccacaaggaaatgagttctgctagcaacctaagggagcttgaaggtgattgaccatccccagtcaagcctctgatgagaccgcagccccactaggcaactagatttcagcatggtaagaccctggatggagaacccagctcagccatgcccagactcctatcctatggaagctttaagataataaatgtatgtggctttaagctgttaagcttttggtaatttgttagatggcaacagaaaatgtgtacaccctggatagtagacagagactgcatctttctttggcatttggctgcacagcaagttctaagttactcaccaggtttcagaggagagatgggaatttgatgatcttataagaaacctgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttacagtgagtgcggtggcagctgggacattaaccaagttgtgaaaggagccatgatgttattagctgagtcatgtcactgcacctccagcctgggcaacagagtcagactctgtctcaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtgacaaagtctttgctctacaggtcaagttgggacttactgaggagaaatgaggggacttcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctcaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatcttgccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtcttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaaaagtaaatgtgttttttgctattaaaagtaatgcggttttacttctgcagtttttttgccatttgccaattacttttgcagtttttgccagtacttaaaagtaatggcaaaaactgcaaaagtaattggcaaatggcaattgcggtttttgccgttacttaaaattgcattacttaaaagtttttaagtaatgcaattacttaaaacttaagtttttaagtaagtttaagtaaaatttgcattacttaaaagtaatcgcagtttttgccattacttaaaagtaatggcaccaacctaatattgttattactttttaccaacctaatattgttattaactaaagtccatcgtttatcatattgccttaggtttttaaaaaattttttacctaatgacttttttgtgttccaggagcccatccaggataccacttttatttattttttttttctttttgagatggagtctggctcttttgcccaggatggagtgcagtggcgcgatcttggctcactgcaacctccgcctcgcaggtttaagtgattctcctgcctcagcctcctgagcaggtgggaccacaggcatgcgccaccacgctcagctaatttttgcaggataccacattttatttaattgtcaggtctccttagcatcttcttggctgtgacagtttctcagaattgtctttgtgatgaccttgacagctttgaggagtgctggttgggtattctgtaggatgcccctgtgttgggatttttatgatgtttttctcatgagtttactggagttaatgaatttcagggaggaagaccccagaggtctgttttcatcacatcgtatcaagcattccaccttcatcatgactcttcactgttgatggtgactctgattcacctggtcaaggtagtgttcattaggtttctccactgcacacttagtctttccctctactttccacactgctgcctttggaggagtgttgctgtgcccagctcatgcttgtggagtggggatttaatgttctcactcttcgagggtagagtatctgcataaactacttggaattctacatggaatatttgtgtcttctcccccatttatttatttaatcatttatttatatcacggtacactcatggacatttattttatgctttatgttataatcctatactactttatttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactcttccccctgtgccccaggtgtgtttgctaccatacctccccaggggatagccctccaaacctgattggccacctagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctatgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgatgcaaatcctgggaagactctggaacaacatggaggcacctatgttaactctatttcattttggaaaagttgagtagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttgagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttttttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtatttttttttttttttcctctgcaagggatggggtcataagacattggtgaggttaggccttcctttgtctcccaggagcacacttgatagcaatgtagggtgaattccaaatctgtgagttagtgccatatatagcagtgttgtcagtaagatttctcactggcatctctgcttcccctcttgactctcttgaaatcccttcttcaggcagaagttggagtcatttctctaaaatagaaatctgatcttgccaccaccctacttgccactccctgcttaatcccttcactggctcaccatatcccttaggataaaataacaaaatcctttccagggcctgcaagacccctgccaacctctgcagcttactttgtaccactttccccagaaacctgctacctaccctgctccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaactcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcaccatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattctgagattatgttcaacagatattttcagtgttaaaatattcttttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgattagaagtaggagaagcttgctctctttttattggcacttctgtcttacatgcactttttgatttaaattattctgtcttctatgaaatgacagtgattggaggtggtttatttttttttaagtctgcttactcggaaaaataaaacaaagttgacaacctgatttcagacctcccaattttttcttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgattccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggccaattttttttttttttttttttttttttggtggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgatcgcctctccacccctgctacgtgtaatagaaaggtagggccatgttggagagggatccaacatttattatccccattttacagatgaagaagttaaggtggccaggcatggtggctcatgcctgtaatcctagcactttgggacactgaggtgggtggatcacttgaggtcaggagtttgagagcaatctggccaacatggtgaaaccctgtctctactacaaataaaaaattagccgggtgtggtggcgtgtgcctgtaatcccagttactcgggaggctgaggcaggagaatcgcttgagcctgggaggcagaggttgcagtgagctgagatcgtgccactgcgctccatgctaggtgacagagcaagattccatctcaaaacaaaacaaaacaaaaaaacaagaagttaaggattgcagagcataagtatcttctatggggctacccaactaggtcgggacagggcagggatttgaacctaggagctcttggattgcaatttttcattcacccctccctctccacccttcctgtcttcaagcctgagcaggtgatactgcattttgtaccgtatgactttaaaacagaaccacgagttcagaactttggttaggtcctgcccgtgttctctagctaacgcatggcaacgctggtttccaacctttcactgtgcgggtttctgatgagtacgctggcaggcctctggcttcagagatgccactacaaaggtctcctccttttcataaacattgctgcaaggcccgcttctcaagaaagcaacttgtgctacctcctgcgtgcttttatgcttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgttttccttcccactcacatgtaggtcacctacgggagcaggggaggaaccatctgaggtgtttttttttttttttttagatttctcattgctgagaacagttccagctctgctgaccaaaggctgagtgtccttttattagtctgagcccctagagaaaccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgatacgcttcagctcttatttttaagtcatccttatctctttcacttattccctcattcaggcaccaaaaatgctgtttgactgggagagcaagtggagctgttcaaagttctagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagtgtgtgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggagggcagacaagttgctcatcctctctgcgcctcagtttcttcatctacaaaatgaagatgttggttatttctttattcaagggttgttgagaggatgaagtgctaaaaatgcttgaccagcattcacacaggcactaagacggtgagtactcactacttagcgctgtcaacatcatctccgtccacatcaatgtcgtcatcgtccttatgaaaagccctgggcatcattttgcccttgagctggatgtccatgttggaaaaacagctagtggaaggcgtgcccaaatctcagaagttggcgtttccttgcagatatcattggtggccattggaggggaaaaagatgctttggaaaccaggacacagagaaaagtgcctcgtattatacagagccaagagaggtcactgtggaagtacagaggaagccttggcctaattgcacggttaatacaattccgtaactcatcctgccaacacgaaggtagatggacggtccttatgctcgctgcggaacactgcctgtgttttcctaggagagacatctgcactctagtagtgattaaaatgcctttgacaggctcttgctattaagagtttctggctccagtttaataaaaggtagtatattataatggaaaccaggttattattgataaggactagacatattagagaccaggttaaagctttgatagtcccaaatgcaaggggagggagctaagggttattgcaaacctactgtgtgtcaattgctctaccagacacctcagagacatcacagccaaagacccccacctttgaataaaccaagtttggcctctctgatatattaatatatttaatcatcagactttcagtgttaaaggagattacagtagaggcatccagttgattggggaatagttgttgcaaatgataagctcttttgaataaactgatactgacttaatgaggttctgctgtgtactatcttttttttcctaatagaaaatagagtagctgccctccccatccgccattctcagtccttttgcttactagtaatgaccctcttttctctcactccatgggaacttttaaaactgataattaatggatttttagcctcaagtttctggaattctaagagggcctgaaaggtaagtgctcacttactgaggtgtgtgaacaaaaacaggcaacctagctcagcaagtaagaatggagtggcatctccccacctgctctggagtcatgtgtttgcttctggaagggaggcaagaggcattcaacctcctgttaatttggttgctccttcagatacgctcttcatggtacagccctgagctgcatcatttaaagaccaattgttaaggaccaatctgagggcctgtgcattagttaaaactccttatctggtcatagagggtggtgtggtttggacgcgttccccttgtctgtgcaattcccaacagaggcaagtgcgcatttgagacaggttgagggttcaagctgtccaatccctgctcatctgcagcacaccaaggaatgtggactaatgaaaaataaactgcatgcatgcaatgcccatcacactgcctgcattttctaatcttcacaataactctgtgttgagaaatattcctgtctgtaatcccggcactttgggaggctgaagcgggcagatcacctgaggtcaggagtttgagaccagcctggccaacatggtgaactccccccaaccaacgacccttcccatatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccagcccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccaggagtctgtgtttgttctttaaacctctctattcagttgcccagctcttttcattccctgtcctttccccctctggctgggtctgcctttccaaccgctaccaccttccaccaccattttttttttgtttcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccagttgacaccagactaatgcttctgacttttccatggtgccccagcagcaggctggagggaagggcgggggcggtcagaggagagatagagcacttcagattccactcgaatacattagagcattagagcttttctcttcctcagggtgctctctctctctgggttgggaggagatgtggcatttctaggaattcacagtaaaatcagaaataattaggagatttcacagttgtagctcctgtgaagattcaggaattttttttttcttctatttgcaagctttagtcctaggcatggaaaaagaactttgaagaaaacctgagagatatgagtgtaaaacaagagaatgattccctctggggtgctggtagtgggggcttaatttcctaaaggcttactgggtatcagggctgctttcctttataatcttttacccgtcttatgggggatgaacagaaacacactttagtgctagaaaagctgggcccaaaagaccagtctcctgtcccatacttggacatttattgttctttttgggcaaggtgaaaacttgaaaccaaaagtctgttgagtttggaagacttgactcccaggatgtacaaagtacttctgcatgtgcgcaaagtcctgtaggcccaggcatcaatgacacatgcagtgtgggcccaggcatcgatgacacacgcagggaagcaacccaagctgggtcagtccttacaaggagaccggcacctgggctcacaccttgccgtatatgacttcatgggaacctcataacagacctgtgggctcagaattattctctcactttgcagatgaggaaatggaagtgcacagaaggaaagtaagagtgtttgagatcctgtagtgggttcattgctgagaataaacccggagttgcctctgggaggacctggtggtgggtgggatggagagagaggcctcccctcagactccaggggcacagattggattttttttttttccagacagagtttcactcttgttgcacaggctggggtgcaatggtatgatcttggctcactgcaacctctgcctcccaggttcgagtgattttcctgcctcagcctctggagtagctgggattacaggtgcccgccaccacgcccagctaattttttgtcttttttagtagagacagggtttcaccatgttggccaggctggtcttgaactcctgacctcaggtgatccacctgccccagcctcccacagtgttgggatcacaggtgtgagccaccatgctaggcccagattggcttctgtgtgaggatgaagagtaataggaagatagagtggtgatctaatgtcaactgtggagggagtgggaggcaggtgttcgcagggcacagctggtttcctttttgaatcccacccagtgctgggggcaagtttcataagcctgtgaccacccagataggaaagtacacagcaacaccaggcagattcattttctttaaatgaggggttcaaaatagaaacacaaagcattgagtattgagaagaaatggatcttcaggtttggagggaggccgatagagagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcagaattggcaggaagggcacaggggcaaggtataggctcacgtctccacattctgcacctcccaggctcctgccattgatgtgagcgggttcctgtactgcatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaagaaagaaggggccgggcatggtggctcacgcctgtaatcctaacattttgggaggtcgaggcaggcagattgcctgagctcaggagttgaataccagcctgggcaacacggtgaaaccccgactctactaaaatacaaaaaattagccgggcgtggcagtgtgtgcctgtaatcccagctattcgggagggtgaggcaggggaattgcttgaacctgggaagcagaggttgcagtgagccgagatcatgccactgcactccagtctgggtgacagcgcgagattctgtcttcaaaaaaaaaaaaaaagaagaagaaaagaaaggaaggacagatggaaggaaggaaaagggaagggaaaggaaaggaaccagctgcaaaaattgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctcgtggttaacccaagcaagaggtagttaaacggccccgcagattgccagtgactccgggaatgcctaggtttatgtatggattaacacagtgatagaccctgagtagcaaaagacgaagactaattacctgacagagctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagtccttggaaaatgcaaagagggggaaaaagaagaaaaacagcaacgagtttattggagagttaacacttaaatactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagggcttctgtctccagattccttgttctgtccctttatgctgactttccttttttgctcaaagtctctctccttgcttctttctctttgggctccctgcttttatttcggccctgatggaatctgtcgactttactgagctccatgtatgtgcaccaggtcagattcaatgctgcctaggtccacagtcctcagttatttgttcctgtgattttcgcgccaccaggagccacttgttggatgagatttccgggcaagttgagtctccatgtttttgtcgtgggctactgccagctgagatatggatgaagactccctttcatgtttcccttctttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattctctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacatgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgagtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttgaacctgggaggtggaggttgtggtgagctgagatcacgccattgcactccagcctgggcaacgagcgaaactctgtctcaaaaatgaatgaatgaatgaatgaatgaatgaaatactacttctccctgtcctccccaccctaagcatctgatcagacaggtagtgctggtggacagatggacagacacctaccccatatgtcacctccctcctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatggggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacactagtaggtacagcaggagagcatgtagaagaggatagatgtagaaaatcgggacggcatgttaggaatatagataggaattactaaggaaaattgtatttttgtggaattctttgaactcgttactattagtaaacggtgagttttggttctactcttcaatgagtttaagatgaaggaaatcattaaatagtgctttcttttcttcaaaagttgggttgcattgcatagttaaagttctttaaattcttctctaaaccccaaggctaagcaatatacaatctagttacaatggtctgcttgctgttaccagaatctatcaagctctttcctatctaagggttttttccatgtactggtttctctcctgcgtggtcttgttctacccttgaggagggtaccacttcctcattgcttagttgtcagtataaatgctcctttctcagagaggcccatcctgaccatctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatatagggagaaagggagcaagagaggggaggggaggtgccagagcctttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctattgccaggctgatctcggactcctgggctccatcaatcctcttgcttcccaaagtgctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatctcccatcagccgaaactaactctgctgtgtcacgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccagtgccccaatctggagtccaccatcctgggtctagctggggacatccttgaatcagcctctgggaatcactgaaccaacatgagtcacttgctactgtgagatctcagaacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacacggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataacagctaccatttcctgagggcatactgagtgctgacaggcacatcaacatcagaccatcaccttcttatacctcaaaatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaacggtgggcttttctttctcatttgctttcgcttagtattttccattattcatttggcttcttgaaccctccctatctgtaccccacacttactcttattcacccagaacaggtgtgtgccaccttggagaagatgaagccagagagaaaatcagtcagacaggaattatgttgaaaggtgactgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaccaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggttccctttgtttatttttacactagctttgcactaggttaattttttcccacatggcttttcctgtttgtttctttgattgtttttaattaataattagtttgcttatttatttgtttattttttgagagggagtctcgctctgtcacccaggctggagtgcagcagtgtgatcttggctcactgcaaactccacctcccaggttcaagggattctcctgcctcagtctcccaagtagctgagattacaggcgcccaccaccaagcccagctaatttttttggttttttttgtattttagtagagacgggatttcaccatgttggccaggctggtctcaaactctggacctcaaatgatccaaccgcctcggacttccaaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaatagctgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctactgccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacgtactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccgtgtgccttgcttcctaggctgtccaccatgacatcagcctgcccatgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctgcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgtaatgtgattctccttaacagagggattcgtaagcttaggactgatagagatttggcttttctgctgttggattgatagctccttgactgctgaagccattgcccatctgttcaactgttgtattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgtgagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagctcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaaagaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggacccaggcataaaacgtgatttgactcccccttgcccatcacagttctggagttcacatatcatttgttactttgaaaaatgaacttttgttatttgattatggtgataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagctaggccatttataatttggacactattttaaaaaataactcaggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgccagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctacttaaagcaaaatgccttctcctaaatccaggtagagagaaactctcaaaggccagggtctggactcaagatgagcacaggatttagaatcagaaagtgtgagttcaaattgccttcggctcttcacctgggtgggcgatttgaatagagctcacagccctgaaaaccctggttttcagactctttattggtaaatgaagtcagcttagtgatatgagaattatgaaacataaatccctttgtaaaaatataaaataatcttacaatcatcatcgtcatcctcatcatcgtgttccttcacaccagcggtatttatggtatttatcaactaactgctgtgtactatgctctattgaaaatgttagcaatatagtaatgaacaaaacagatgttatctctacccttatggtttttatattttaataaaagtggcagaaaagaaataggtaaaacaataaactgagctctttggagaagaggcccacgttcttttcagattctgatttctccgtgatataaatagttttttaggtgatcacttgtttttaatgtacctacctatctatacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatactctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagaaaaacacaacattgagtgaggtctagggtgaatgccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagatcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcctaaggaaacttaaaatcatggcagaagatgaaagggaagcaggcatgttctgcatggctggagtaggaggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcacaattcacacaccaggctgccactttggcccctgcgtcaccttcaccaccacccaatgtgtcctgctcatcactgaggtttgtcatttttactctgagtctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtggacaagaggtcacattgccttttctagcttggaaggtggcgcaaataactgcttgaggctccctctcttgggccaagcttgactctggattttcattgttgtccttttttattaaaacaggttttgtttttttgtgtgtgtgttattttgttttttgtttttttgtttttcgggggctggagtagtgtgcagagcctggcggtgattgttctcattagaaagtatagtgtaatactcaataaattacttttgttctcaccttgggaagtggactcagaggccaagtgactttgatttttcactttatcctggagtttctcaaccttggcactattgacattttaggccaggagattctttgttgggggggatttcctgtgagttacaagacattaagcaacatcactggcctctacccactagatgccagtagcatcttctatttcctcaagtctcaaaataccaaaaacatttgtagatactgccagatacccctggggaacaaaatcacccctggatgagaacccctgctttatcctcttacagttttggttctttccatgagaaagtatttttaatagcaaagtaatgaacaagaaagtattaataagacccaaataataatataaactactcctttactaatggtcattatgtgccatgccctgctctaaacacttgccatgtagtcactaatttaatcctcacaagaattctgtaatgtagtgtagtttcccagggcttccttgaaaacgtgccatagactagatagcttgaaacaacagagatttattctctcacagttttggaggccagacacctgacatcgaggtgttggcagagttggttcctcccggggctctcagtgaaagcctgctccgtgcctctcctccagcctctggtggctgccattaatccttgacattcgtcggcttgtggcagcagaaccccagtctccgcctccgccttcacatggccatcttcactctctgtctttgctcccttttcctatagggactcaagtcattggatttagggctcactggaatccaggatgacctcattttaccttaacaagttgcatctgtgaagattccatttctaaataagatcacatgctagggctgggcacggtggctcatgcctgtaatcccagaattttgggaggccgaggcaggcggatcacttgaggtcaggagtttgagaccagcctggccaaaatggcaaaaccccttctctattaaaaatacaaaaattagccaggtatggtggtgcgtgcctgtagtcctagctacttgggaggctgaggcagaagaatcccttgaacctgggaggcagaggttgcagtgagccgagattgtgccactgcactccagcctgggcaatagagtgagaatccgtctcaaaaaaaaacaaacaaacaaacaaaaaaaaaacaaaacacatgctggtgcacacataaatttggaagaaatgctctttaacccagtatgagcacgtggtattcttatcctcattttacagatgaggaaattgaggcacagacagattcaataactacgtgactcacagagataaccgtgtagcagaatcaggaattcagcccagttttttcagttgcacagcctgagctcctaaccatcgcgcctggggttctcaaaggctcgtccccaagcgacaacatcagggtcatctgggaacttgttagatgtgctcaccctcaggctcgccccaccccgccagacttcctgaaccagaaactctgggagtagggctcagcaatctagttttagccctccaggggattctgtggtgcctaaagtttgagaacttctgatcaaaaatgccagataagaaaaaaaaacctttcgagacatcatttgaatcaattatcaaatgtttccaaagtgcacttgctttgcaaaccactgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcagaagagcaaagtccgggtccccaggctcaactatcagccgccttctcatcccaagggctgtcaccaccagaaatttaacatgctgttagtgcatgcaaaaaaaagcccagtaattgtagggctcatcagtacattgttaattgatcctcatttcctattattttacctcaaagcaaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtacactaaaggtccctcttccctggcagacagtggttcattttatttgaggaggtatgttgtgggcttggggaaacagaaggaaattggagacattgatatgcttcctgagaggtggaaggggccacttaacacagctttcatttttcagttgccaatgggagaggagctggggtgggcatataatgagtaacattcaaagctccttctgtctttttttcagagaattcacaaaacaactcagggcctcctggtcctgcaaaagtgtttactgtttatttgtgttgtttctgcttgttttgcttgccaccagctccctactcacttgggggaaaataacccatcaaaggaatagaagctcaggataaacgtttcagacctttcagtaagatagtaaaatttctttcattcccagacctctctccaaaagaggcagccatcattaaaagtttgttatggattcttccagaaacgttctatgcatttagcatcagttgcagatatggatagccttttcaaaaaatgcatgcaactgagactattggctatgttttgtttattacctactttttccatttaatagtatcttggagattatttggtaccagcacatgtagctcaacctcctaatactgcatgacggataatatgccatcacatggtgtcatttaatatattcattcctatttatagacattgaagttagatccatgtcttactattacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctaccattcacacgtgagaatgcctgtggccccccagaaattatctccagcagcagcaacagagaggactggaatgccattgacaggtcccacaagtcagcaatcagcacgccattttttaaaatttatgttgctattgtatcgtaaggttcttctgaagcgaccacttcataacactgtgtagtccaatccctaagctgggcaatttttttttcccctttcaatacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgagaggtggggagggggtgggggctctgtgcatggaatggggggaaaagcttcagggaagggcagtgcaaattgtttctggactgatgccatcttttaataatagtagttaatagactgggtacaatggctgacgcccgtaatcccagcgctttgagaggccgaggccggtgtatcgcctgagtccaggagttagagaccagcctgggcaaacagcctgaggcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtagtagtgaatgccctgactttggggtttgcagtaagctaggattaagtgcttcacagtgaggcacagtggggagctactctgaggatgaattgcctagtaaataagtgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgcaatgagacatctagtttttttctctttcgtttgttctgtttcccactgagagaattttctagctttatgtggagaaaacagtattggaaattattactcagttcaagaaaacctcactgagcacctaccatgtaggtgctcatcccgataccactatcaggccctttggaccagttgcaaggatgcaggatgaggaaggcaatgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtggtcattgactggggctggattcgggaaggatccacttccaagctgcacagttgttggcaagatgtagtgttttggtggttcctgggctctgggactcagctttttggctgttggttgttggctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcatgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctgatttctattatgagtaatgctgctatgaacattcatatacaagttttagggcagacttctattttcattccaatatctctttatggcatgtcttagcagtgatgtctatgacatccaggatgtgtcttgacatgtctgacatcatttaaataaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacagggataatagacaacgctatcaagaggggggccaaccacacatgtgcagccactgtatgacgtctggattttccttgacttatggtgatcactattgggaggtggtaagcaaacaggtgacataatttgaatcatggttttaaaagacgccatggttgccatgaggaggacaatgcgtaggaggcaggagtgaaagctaaaggatatgctgggaggtgaccctggagttaaagagagcaactaaggtgaccaggtgacaataatggagatagagaaaacaggatggattcaggaaacatgaccacactgagcatattcaaatgtaattgtcagttttcgtgtctccctcccactggaccacaagcccctaactcttcatgtacacaccctgactcccagtgtgggctggccacccaggaggcacccagtttatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtgcttctctgatgtggctttaagatacttgctctgtcgcccaggctgtagtgtagtgattccatctcagctcactgcaacctccacctcctgggttcgagtgattctcctacctcagactctcaagtagctgggattacaggcatgcaccaccatgcccggctaatttttgtatttttagtagagatggagtttcaccatgttggccaggctggtcttgaactcctgacttcaagtgatctgcccaccttggcctcccaaagctctgggattacagacgtgagccgctgcgcctggccaagatactgagatgtgggggccaggcacagtggctcatgcctgtaatcccaacactctgggaggctaaggctggaggattgcttgaagccaggagtttgagaatagcctggttaacatagtgagagccccatgtttctaaaaatttaaaaaaattagccgagtgtggtggtgtgccacagtagtcccagctactcaggaggctaaggcagggggattgttggagcccgggaggtcaaggctgtatagtaaactgtgatcctgccactgcactctagcctgggtgacagagcaagacactgtctctttaaaaataaataaataaattaaaaagacactgagatttgggggttacttgtaactgtgtcataacctggctccttactgccatcggcatgcctagagggatcccagttttacacatcagaacaacccaagccccagtgtgtcacgccattacatgcttacagcctatttttacaaagtttgaatattgtaatttgcctttaaaaaattgttttaaagatctgcctaggtcagcaaattttatttactctctagaaccatttgattggggtactgccttaagaaataaagcagattccttcagtcgcatgtgggcctggagtcactggaaaatgcagacaaaacaagatctgctgattggcaaggtcatcttgggaagggccatcgtgcagtaaagagcaggtccattaattcaggggggatttacatcagttccatctgcctctttcctaatgggactgtttggttgtgttctttcctggagagattagtgattgaaaggaggagatctagaaagaagagataaaagtttacatttaattttcatgccatgcagcgttctacgaaggcttcctaaggaggctccatactaaattcagacataagtcagaaggcagcttctcccaagacactgttgatgtccagggggtgacagttccatcacaaaagggggttaaaagggtttaggggaagtttagttgtcttccttttatctctaactctaaaacccaactgctggctgaattaaaagtctcttacataatggtcagaggagttttgagtatcggatctttgtgtacttgctttttaaattcagtcacgtcttaaatagtacttttcactctcctcctctccacaccactttatgtgtttgctagtagcttccatgaaactctatgggtgaacatgtctgcaactctttggcatttaaattttaggtttctgcccctcgtagcagactatctttctagaagcagagctgtaagtctcttttaacaccattttcaagcttggacaggctgacatttttattgaatgggttatctcaatatatatctacttttttgcatcctactttttttagaaaattaaaaatgatatgatgggtgtggtggctcacgcctgtattcccaacactttgggaggccgaggcgggtggatcacaaggtcaggagttcaagaccatcctggttaacacggtgaaaccctgtctctactaaaaagtacaaaaaattagccaggcgtggtggcaggcacctgtagtcccagctactcgggagactgaggcaggagaatggcatgaacctgggaggcagaggtagcagtgagccaagatcgtgccactgcatcccagcctgggcgacagagtgagactccgtctcaaaaaaaaaaaaaaaaaaaaaagataatgatgaaaataatagaatattgatgagaacacccattactctgctcattgttcaaatgaactcatttgagagctctctcctttgtttctgtctttctctcgcatcagcttgcatctgtttgcctatgctataaggcatcagtggttaccaggcagtgttgcattttttccatcccatacctctgtgtgtgttccttatctgtttctaggatgtgccctctgccccgtcacatcacactctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccaccatggtgaagccccgtctctactaaaaatacaaaaaattagccagctgtggtggcacatgcctgtaatcccagctactcgggaggctgggacaggagaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccatcctggaagttgagtgatggggaataaaaggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggtacttaaaaattgttagaagagctaaaagagtagttttgaggttgaccttcagaacggcttcctgaataatacagaagtgaccctccaggaaggcccttccactgaagctacaactggagctaagcagatggataagccaaaaccacctccgttgctgtggccccatctccaccacaaggaagctggagaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagaggcaggaagagggaatgaatggtggccaagaattttaaattcctgttcccggccgcccccggaagctccatctttgttgtgagggcttctctgcgtcagtagaggccagctgagctcttattcaccccttattctctggttccctttcaccagcaggtccagctctaaccacagctggagtttaggaaggccaggcagcgtgtgttgaatgccagccactcttctacccagggtcatatccttggatgtttttctgtgcatctgtctttcccgaccctcccgtgattctggaaggaaacacctttccaagctccccagtgaccctggttcatcccggaaatatgcaggaaaagcattatgagcattgcagtgccacatgctgcattggtgtgttacgttatgagaactattagggctgatctctgagaaacttaccagtggtgtgtgatcggaaatcatgtcaccctctgaatgtgggttatgggataaatggctaggtacacaggcttcagagtccagccagccccaggtttggattacagatggttgctgtactagatgaataatgtccccccaaattcgtgtctatctggaacctcagaatgtgacctcatttggaaataaggcctttttaattaaaaaaaaatttttatttaaaaaacagagatagagtcttgccatcttgcccaggctagtctcaaactgttgggctgaagcagttctcctgctttgacctcctaaagtgctgggattacagacatgagccactccacctacccagaaataaggtctttatagatgtaactgaaataaagatagagatgtgaatgtgatcgtactggtttagggtgggccctacatccaataagaatgtccttagcagagacagaacagagacaccgagagaggaaggtgatgccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaataaattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagccgggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagataacttgtgatggtttagcttatttagtacaacaaccctgccccttctagtttttatgataacctcattaattgccggtactctcagagccctgattttcttacctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaataaaaagggatcaagatatggattgtaaagtagaaaaatacatgtcaattaaatggatttacatcttaaaaagtggtgaggtagacacacaggcactactcacttcattccttctcatctcaacccgttaggatttggccttcaactgggtagtggaaaaaatatgatccttggcagtctactacgcaaaagcaggaacatcatctgcttttgggtagttaagagttaagtatcactttgagctacaggatcatgattaaaaagcattctgttatcttacttcacaactctccacttttgtaaaagtttaggataccggcagggcagcaaatacctttaaatgattttatttaaatgtcagatttaattaaatccatgaccagaagacaaacccaaaggaaattttcagggagctttagaattttccttttccatgttcaaggtgataaccgtagcataaaactgtcccaaccacatgcaaatgcaagcaggggcattcatcatgaaaatacagctctcaaggcggaagtgcttgttaactttgcactctatagccaagtgcgatgatcagaaaatacatacattgaagacaccagaaaatagtgtatggattggtgattttgactaagactggaatgtgggtgtgtgcactcctcatgttccggtttctgtgatcattcaggcatgcacaggtatcctgatgggtagccaggtcattaggcccagagtcggcagtgtagcatggcaagagaagtcattgcatctccaaactgtgcctaaattgcctgtaatgggttctttgcaacttgcagaaccagatcttaccatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatacatcctgataaatgctgtgccttcctccttcgtctctctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagcactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgttggcaggcacccattagtgttggttacgacttgctaaaagaaaatattaagataaaaattagatcataaatttggagccaccattacgaagcctaaagtgcaaattgccaaacaagtcaagagactcattagcattttatgtaaatcagttattactgttctccacttccttaattatccatgttatttcaatacaaccctttctttgatgtcccaattctatatttaaatagtgcaagatttctatcgtatcctcccgcagaggtttgtgccatgcaaaaaacatgccaagagcagctattttagagactacagggaaatgtttaattggttcatcccatttgagttatgagggtgtattactgagcacataaaatcagaaacatggaaagtactagcttggagaagtttactaaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcgcaacctcagatgtccctgggcactagcccatctgtatgtctttaaaaaaaataaattaaatttttaaaaacatgactttctggccaggcgcagtggctcatgcctataaccctgcacttagagagggcaagacagaaggattgcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgtttaagaatctcagagtaatccagacgttactactccataagcaaatctgggacagtaatcagacaaccagacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagttctcatcatttatactcgtttcagctaagtcttcttttattgaaataaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggtgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcagggtataggggtcaggcagctgtttgacaggattcttgcaaatgtttttggtttctctgtctactcattacgtacactctgccagaggttgaaaactcaatgttgagatcacatacatcctgaaaacactgtttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccaaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatgaaggcttaaggttttgtctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcaaggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtacagatctgtaaaatatgaaaacaggaaaacacatggagtcttggagggtagggaagtcttgatgagtaagattgggtctgagataaacctaaaagagggtcaagattttgacggagggctggaagggaggaacgataggaaactgaccttttttcagatctcttcttgtgcgtggcctggggttaagtgctttacatgcatcccctcattgacttctcagagcagctccataaagagtccctgtgcttcccagtttactctggagacgactgaggctcacagaggttaagccacctacccaggctggcaccgcacactttgttcagagtgggcctggcatacggcatcagttcagcctggccctagacccttttcctcccacaaccatattgcccccagtggagagacaggaaagcagggaagggggcaattgccaagcctgtttctagaatctcaaggatgccatttggtgaagctgaggctggtgcagttactctgtggagacaccagcgtcttggacctagggatggattcagggaggattgtgtcccccagtgacctgctttgtgaaaggtagagaatagattacaggtgcccgagatcctagaacccgtttcttaccatgatggcgttgaggtagaggtagaaagatgggtgaggtggctgggtgcagtgggttgcgcctgtaatcccagcactttgggaggccaaggcgggtggatcacctgaggtcaggagttcgagaccagcttggccatcacagtaaaaccctgtctctgctaaaaatacaaaaattagccaggcatggtggtgtgggcctgtaatcccagctacttgtgaggctgaggcaggagagtcacttgatcccggggggcagaggttgcagtgagccaaaattgcaccactgcactccagcctgggtgacagagtgagactccatctcaaaacataagtaaataaataaaaaataaatataatacagacacaggcttttctccccacctcttttaattcttgaaaggaacagtaacaagctcctattcctgtttccttgccaggagaagtattgttttcatataaatcatttgtgacagaagctccttatttttaagtggaaaatgcacatttaataacatgagaataatgtccaaacatcttctcattgatggctgccaagagaacagcagcactcttgctgcctgcagaaagagacactcagagtcaactgttttaggggccatgctgtcattgctgccgcatttgcttaggtgggctctgagcagcagcttcccagacactccgtaaccaatggcagctgagtgcttttgtgccttgcaaatcctctagtcagagcagacctggcttaggaccccagccctaccactaactgactccatgcgctcctatcggttctttattttacctctgcaagcctcagttttctcatctgtaaagtagggataacattagcttcagccctcacaggcttagagtgaagtttaaataagaaaaggtatctaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgacgtaaaaagacctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgctaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggccatacttagtggctcacgcctgtaatcccagcactttgggaggccgaggtgggcgcattgcctgaggtcgagagttcgagaccaccctggctaacatggtgaaaccccatctgtaataaaaatgcaaaagatagttgagcgtggtggcgcatgcctgtagtcccagctactttggaggctgaggcaggagaatcacttgaacccgagaggcggagattgcattgagccgagatcatgccacagcctgggcaacagagcaagactgtctcataaataaataaataaataagctggacgtggtggcatgtgcctatggtcccagctacttgggaggctgaggtgggaggatggcttgagcccagaggtagaggctgcagtgagctatgatcttgccactatacatcagtctgggtgacagagcgagactctgtctcaaaaaaccaaaacaaaggtcaattttttttccacattcatctataaaacaataaaggaaacatcctagacacttgaatcagagcccttttaattatgacttcaaaaaacagggctcgtgccacccaagatttcctccatatacaaaaaaaaaaaaaaggaaaaagggaagaagcaaaggggcaatacagggctctgcccattagaatctctagggacagaccgaggtttgagagttcctgctcctgatctcaggggaatcctgaattacaggtgttaacctgattatccccagcccagctcttcgttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccgcagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactgttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagtttttttgtaccagtgaggatgaatgtttctgcatgtgggtagttggcaccagtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaaggattgcttgagaagtttgagattggcctgggaaatatagcaagatcccaaccctattaaaaaattaaaaatgaaaataaaattttaaagaaaggtatttctccccttcacggtaatttggagccagtacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgattctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagcactttgggaggctgaggtgggtggattgcctgagctcaggagggcgggtggattgcctgagctcaggagttggagaccagcctgggcaacaaggcgaaaccccatctctactaaaaacattaaaaaaaaatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattacatgaaaaatagagacaaagtctcgctttgttgcctaggctggtcttgaactcctgggttcacgtgatcctcctgcctcggcttcccaaagtgctgggattacaggcacgagctgccacgcctcacctcttgttttcaataccattgataagttgtggtcttcagggacttgtgggcattttcaagttaaatatccaacagtcgtgatttagggcatgaagagctcactcatcaagatgtatgtaattcagattttctgagtgtttaattcggcgtctttggtcacaaggaacagagttttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacaattttggctcgcacatgcttcctttttagctcatgaccgtgcaattcaactcaacctcatggcatctttttatcagctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccaggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttccctcagatttattacgggacctggatgtgatgcaagcatgcccgctggctcaggctgtgcctcacagctgcaacatccctggggtggagaagccatgtgggacctcacagaacactccaccgtccctgctaatggctgagaaaggactctgccctcatggatggggttgggggacctgttatcttcttccaggttaatcttggtttcagctgctttaaactctactttttagtgggacgcatcatactgaactatggaagcaccatagttgtcacctagttgagcttctctttgttcccatatgtttcagtgaagcagttatagcttcagaaaagagggagccaggaaatacacttgtaattcatcactccttttatagtcagagcataggaacactcatagtatgtatcagaaactagtgaacacatgttgttttacagctctgtctgcaaaattgcatcgtgggcctctttggggagtgttctcaatgtgatttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggacagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtatcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggacccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctgtaatcccaggactttgggaggccgaggcgggcggatcacgaggtcaggagatccagaccatcctggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggaggaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcatgaagccacatagtaataaacagtttccatatccaagcagctaaggcttgtgccttgcaagttaagtggaacatcacgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctctgttcatgatataacagtaaatccaagttgctttaagtagatattggaaatatgaacccaatatgttcttaacatctccatgtcgtaattctaatttaaaatcaaaatctcatcaaattacattttagattaaagcattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacagattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaagtctcattcacttctttctatttttcctctctctattgcatattaacccaccatattgagagaatagaaacttttgccttcattatatcacctttacaccccaggacaggtgccctcctcagcggagacaactgtccccctccatcctgcaggagttttgcagccatccttccagccactgcttctctaccggggcaaattttcccccaagggataattgataatgtctgaggcatttttaattgtcacaacttggggaaggggcaagggattgagggagagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctctccttcctgctgccgtttgaagaaagacatgtttgctttcccttccaccatgattgtaagtttcctgagacctccacagccatgccaaattgtgagtcagttaaatctctttgctgtataaattacccaggcttgcatatgtctttattagtggcatgagaacagactaatacagtcagggatgctgcagaacatctccaaacacacaggactcccaccctctacttccaccccaccaacaaagaatgattcagcccaaaatggcagtagtgaccttgttgagaaatgctgttcaagccatacgtcaccattggaaggttgccaaactgtgctttgcacacacatgctgtctgcacgccttgtatttttctctttgcttagtcctgctcatgctctctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccgcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctggaaggctgagtcagaacgattgcttgagctgaattgttcaagactgccctgggcagcacagtgagaccccgtatctacaaaaaataaacaaacttagccaggtgcggaggcattcacctgtattcctagctactcaggaagctgagatgggaggattgcttgggccctggacgtcaaggctgcagtgggccatgatcgtgacactgtactgcagcctgggcgacagaatgagaccctgtctgaaaattaaaaaaagaagaagaaatgtttattgaatgaagacatgaaagcatttggtggaaatagggcacacacatgaatatattcacagttgcaaactcagaaggatactcccaacctggttctttgtcttgtccctccatctgggtgctttccagtcacagcctggatgcatgtatgaataaacttctaccattaagtccctgaattatttaagcactgccagtgattctatataaaccgttcagtaaaatgaatggcatatgcgtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcgttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacactttgggaggctgaagtaggctgaagtgggaggatggttagagcctaggagttcgagaccagtctgggcaacaacgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataataaagcactgtctctctctacccttgcagtatccctgtaggagagagttactattagctcccagtttataggtgagtgatatggtttggatgtgtccccacccaaatctcaacttgaattgtatctgccagaattcccacatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgaggcctccccagccatgtggaactgtaagtccagttaaacctctttttcttcccagtctcaggtatgtctttatcagcagcgtgaaaacggactaatacagtgaggaaatccatgtgttaggaagggagtgtggttgtacttcaacctggaactgtctaactcctaaggttttattaatatctagtccatttctctcaatctaatagtaaatggaagagaagcaacaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctcttaatttcatgcttcttaaactggggtatgagtggccccaggtttccctgttgggggtactgataccagagttcatttgaagtcattggaaaccaaggcatattttcttaaagagacaactgtttttggtgaataggccatgttgtttatagtaaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagcttgccagcaaccttttagatctctttccttggaaggttcagcaagatgcttgtaaatgtatgttgctttgttgcagacaatgtatatttaaaaagcaattatttgcccatctcttgttcaactcagatattgactgcctttctgtatttctggctgggcattgtttatctccacctcatggtttttactatggttctagaggtctagcctacaaagagaatgcttcccgtccccaccactacccacaggaccctctgcatatctcagaggaatttctcagtgttccagttaattttctctctgtttcctttattacttctaagttccattgcaaaaatatgctgcctgctctgtcagccaccctatatgcctatttagtcccagttttccagcttctatttttttccacataatccctaaccatgataatacaaatataatagaaataattatgtttgtttaaaatatacacagaaccaaatagtcatagagtagtatttcaggtggggggccctcctctagggcagtggagacaatgtcacctgtcgggaacatttggcaatgtctggagacattgttggttgtggtgcggtgacataactattggcatcgagtggatggagggcaggtgtgctactaatcgccctctattgcacagggtggcccttaccacagagaactatgcagctctaaacatgcgcagccccaaggctgagaattgttgatctaggggaagatgtgatttcattcttcatgcttgtaaattattatttaagctgtgaataccctctcttttcccactgaagttgtggttgtaagattctcagagttgagcagactcggcaacattacagaaaaaaaatcaagatgtaaaaaggatttagacgtctggacgtggtggctcatacctgtaatcccagcactttaggaggccgaggcaggtggatcggttgaggtcagagttcaagaccagcctggccaacatggtgaaaccctgtttctactaaaaatataaaaattacctaggcgtggtagtgtgtgcatataatcccagctactctgtaggctgaggcaggaggcagaggttgcggtgagctgagatcgcactacttcattccagcctgggcaacagagagaaactgtgtctcaaaaaataaaataaaataaaatggatttagaaatggtacagtcagaggttaggggtcgggtcaaagcgatccccccagagacctgtggaaagtgtggttctgtctacaagctgcgaccatggtctttactgcttctgcaaatacttgacaaaaagggccacactcttagctggacttttcctccctttcctgaaacaatgcccttcccattgtcaaggcagaagcagcctccactgagaagcgtcagacaccacgtcagtcttgctttccattgctttgctccagtatccatttgaaattcagtgcaaacccataaattccactttgcctctggtagcagcctgcatggtgtgtatattgaacactagaaacacagtaaatccagcccatttattcacattaaccagcaaaggcattctgcatgcccatgtaaatactggaaattactgacatggccttctagaccatgaaaagacagaagcatatggcagaattcatatgtgaacagattgctttttctcataagaacgctttattggaatatcaactattacagctttttgaagttactcttcctgctcttgatttaagtcctgaatcaccccactactctttttttttttccgctgcattctgctatgtatctttacatctgcttcctgcactttctaaatggcctacttaaaccttgaggtaggtccttcagtttcccataaattaataacacatctatgaatatttcccagccagtcttagaagccccagtctattccaataccaggattgtaaacacagggaatagatgaagcaagctgcttctttcaaatgctcttccaatatgaagcaaaatattattgatctagactgcctgctactttcatttaccatgttactgctcgtgggattacaggcacaaaggtttcataaatttcaaatgaaatatgaacatttgttgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagctgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagagaaccaagagccagacacagggaacctgtgacaaaaacgaaaaccaataaaaacatatattgagcattgaccaggtgcccaatattttaatgtcccatgggtgtgcatcaggtacgctgtggaaggacagatgtcattccttaaaggggctgcactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcctaagtgacttcagactctatagacagtccctgacttataatggtttgacttagattttttcacctttgggatgctgagaaaaccatacacatccagtagaaaccgaactttacattttgagtttcgatttttttttttcacctgggctagtaatacgtggtaggatactctctcacaatgctaggccacagcagcgagctgcagctcccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgcctttacatcctcatagcttagctcccacttataagtgaaaacacacagtgcttggttttccattcctgagttacttcacttagaataatggtctccagtcccatccaggttgctgaaaatgccatcagttcattccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactctccacactgttttccatagtggttgtactagtttacattcccaccagcagtgtagaagtgttccctgttcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagcaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaataccccatgaaggaggtgcaattacccctggcttagggttgagaaaactaagaggtttagtaatgtgcttgaggccatgctacctgtaagcaagaatcactccaggtttttcttgtttcaaaactcctgttaacaactgagttgctatactgttttagtaggtcaagatatactatgtgtttcaaagggcttataaattataaatgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttggggtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaatgtaattttgttatatccatatgataaaccttaagtattcttaagccaggtgcagtggaattcccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagacttttttttaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggctcatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaactggggcactcttggtcttggggaggggaggtggctggggacgcagagggtcctgcggtgggtggatacttacaacatagaaatgtcctggctcttgatgctggctacaccctcagtaagagatactgtcctagggtcatttttttcaacccacactagttacgtggactgtcttagtcagtccaggctgctataacagaataccgttgactgggtggcttgatttttttttttttctcccagttctggaggctggaagtcagatatcagggcaccagcatggttggtttctggtgagtgctcttttctgcatttgtggacagctgccttcttgctgtgtcctcacttagtagacagagagagagagagagagagagagagagagagagagaccatctctcttgtgtgtctttcattcatgagaactccacctttgtgaccttattacttctgagaggccctacctccaaacaccatcttattgggtgttctagtttaacatatgcatttggaagagagaggaacatattcagtccatagcatgaaccaaccacgtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctgcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacataaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctacttttctctttttcccagcctccccccgatatactcaacatatatctccctctccctccacccacctgcctcccccacactccttctttccctctcctctgcagggagagcttggaaaccaagagtctatgagctcgaagggagcatgcaaaggtgccaggcaggccctcaaagctgggaagctgcagtaggggttctttgggacccagttaagcagtgggcccttgctctgagatgcagtctgctgagctgccatctggggacacatcttgagtttctctccatgatggcgcagctctcagcgtaaagcagtctatggagtgagaagggaaaaggccccagtaataaaaggcaaaggaagccctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagtgagcagtgatgactccactatactccagcctgggtgacagagtgagactttgtctcaaaaataaaatataaaataaaataaaaaggaagaaatagccagtagtgctttcttgtagacagagaagctggtgaaatgatgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctgggaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactgcaggagagggggattatataggagcttctggaaacagatgccttgggagctctcctccttttccagaactcccacacttgctcttgtagatcatcataggataactctccgctccctttcctaagaaaattgatctaaaaagtaattatggaatcttgcagtgcttgttgggatcagagaaggctcctccgatgatgggatgttaggtagagggctgcagggaccttgcttttagtcaggaggcaaatcaagagccaagagagggaggggtggtcgtgagtttttatgatgttccttctcttctccgctccttcctgacaagagtctgtctcttttctctgtgtgtcataactacccacattcaccccggcagcccatctaccttgtttctctcataagtcagcttctctcccatctttcctgtgaaaatttctaacaaaatgggagttaaggccgggcatggtggctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcggaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgcttggttttatcttttatacatataatgcacaatacatgtagtgccaacaagaattatagtttctgtaagtagtgtatgattgcccacggatcttcagtaactcattaggcactgacgggctgacatgagcaacaacgagacttagtatctgttgcagctctccatacagtttacgaaactctaatccataaaagccgtttgaaatttccattaggagatttgcacaagtggttaaaattagtcatgcattcttggtctaaactgcaggaagggtatctttactgtgaaaatgattatgacatgttaaaactgtgtaatagtaagcagacagttttccgagctgctgggtgaattctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaagtaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggaaaggctctttcagctgctctttctcgatccttgcagtttcccttttgacctgtgggtacacatggtactgacgcaattggcacctcagatggttcttcctgacagctacccttgcaactgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgctggaataattgacatccaggttatcacagagccttcctatagtgttgattctgatcactcaaataatcttagtgttaaagggtttatttttatttttctaccttcttttaccaccccttactcccatcagagcaccatcagtcttttgggaataaaataattcctcagatatattaaaaagctatagaagcagaagttaacgtacatgcaaaaatctctacatttctcaacaattgtgtaaccactaaatatagggaaagaagtgtgcaaggtataagacattggccatgcgtccttgtctgtgccacctcaccaggagcattgctcctttttatgcacaagcatcagaggttctggacatcttcttgggctagttggtatagcttccttctcagctcattctgcaaggtttgctttggaaaagtctgtgcatctgagctctctcttgccatatcaggaaccgaagtcagaaataaaggctacagatgctcaaaatctgcagtattcaatctttttaaggcccagcatggtgtctcatgcctgtaatcccagggctttgggagactaaggcgggtggatcacttgaggtcaggcattcaggactagcctggccaacatggtgaaaccccatctctactaaaaatacaaaaattagcctggtgtggtggtgcacacctgtagtcccagctagttgggaggctgaggcaggagaactgcactctagcctgtgctagagagcgagactctgtctcaaaaatataaataaataaataaataaataaataaataaataaataaataaagtatctgtccccaagtcacaatgctattcggttggtgcaaaagcaatcgtggtttttgccattacttttaatggaatagtaaataacacttgatctttggtcttctgacctgaaatcccatggctaggattgtcagatagaatacaggacacctggcctgttacagtggctcacacttataatcccagcaccttgggaggcagaggcaggaatatcacctgagcccaggaatttgaggctgcagtgagctatgactgcaccattgcattccagccagagtggtagagcaagaccctgtgtcttaaaacaacaaaaacaaaaacaggacacctggttaaatgtgaatttcaggtaaataacatattttttaaaaatgtatcccatgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtacttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcccagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccacgctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggccaggagcagttgtttattttctgctatttcgtgtgtttctttttgctggcagtgacatactcctacagggatgtctgcctcatgttgacctgcttgtgtttaccacctagaggcctaagaacaggctttccccgttcaaatcacccagtggcgtgcacacttggggcacctggggactggtttcctgaatggcattgagagtcattactttccacacacagttaactgcagggagatttgtctctgaaagtagtcttcaagaaatgcggcagctgcttctagccgctccatccttccttttcccagtgcgcactaaccctccagagccttccgcatctgctatgcagcattggccacaccagtgggatgcaagaatttatcccttctgttgatgcaattaaagctaatggatctcatatatatatatatatatatatatatttatataaatatattttatatttaaaaatatttatattttatatatttttatatatttatgcaagtatatatctaaatatataaaatatatataaatatatacatatatgtgtatatatagattttgttttttgagacagggtcttgctctgtcactcaggctggagtgcagtggcgtgatcatggctcactgtagcctcaacctcctgggctcaactgattctctcatcttagcctcctgagtggctgggaccgcaggttcatgctaccgtgcccagctaattgtttaattttttgtagagataggatctctccctttgtggcccaggctgatctcaaactcctgagctcaagcgatcctactcactcggcctcccaaagtgctgggattacaggtgtgagccaccatgccaaagcctaagggaccttagaattttttctcctttcttttcacattttgttttgtgcttgcttatttattgaaatctggaccacaaataacttacatgtttgtcaaggccagatttcaggacctaaccaacacccgacaggcatcttagaaagtggagggtgtaagttataaagagagattacttccaacacgtttctttaaagcctgctggctaaattaggtgggaccttctttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatgctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggacgcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaagctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggcgggagaatcgcttgaacccaggaggcggaggttgcagtcagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataagaaaatattattcagaggtctcaagaggcaggctgccaagaatagcagttagaaatagctagtatcaggcctggtgtagtggctcatgcctgtaatcccagtgctttgacaggctgagggaggagaactgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcactttagcctgggtgacaaagtgagactctgtctcaaaaaaaaaaaaaaaaaaaaaaaaaaaagctagtagcacaccccaaaacttctagacagggcatggtgtgagctggagtagacaactagttcatggtaacaggaccagcagagctccgtcttgatgctgttattatttggtatctgttaggagctgaattatgtgtccccaaaattcatgtgatgaagccctaattcacagtacctcataatgttactctatttggagatacagccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcacattttcttatggcaacccctgtagataatacagtcccattctctggggaaacagatacctccgccagggtcctgatctgaatatgatttggggtgatggaacagaaacacccgaggactgtcgttggggaacaggaaacctgtctgtagtcctggctctgtctccaattggctacgagggcttgtgtgtactctagttctctttccgtgacactgcatttggggggaaggtaagggaactggggaaaagaaggcaaaatgatgacttaaagagactgatgaacccaaagctctcttgtgaagccccttctagaataagtccgtctcacgttacagtgcttaggaagtgttagatgtactgtcatttcttcaacatatatgtcctatattagtctattctcacactgctagtgaagacatacctgagatggggtaatttgtaaaagaaagaagtttaacggactcatagttgcacatggctggggaggccacacgatcatggcggaaggcaaaggaggagcaaaggggcgtcttacatggtggcaggcaagagagcctttgcaagggaactgccctttataaaaccatcagatctcgtgagacttattcactgtcacgagaacagcatgggaaagacctgcccccatgattcagttacctcccaccgagtccctcccatgatacgtggggatgatgggagatacaattcaagatgagattttggtggggacacagacacaccatatcatgtcttggcagccatctatattcaagacactattctaggtatgacataaaggatggcaaaaagtcagttacttaaaagtgtggaagcagagtgtcccaggcggaggaaacggtaaatgagacctctggtagtaagaagcagtgtagcatgtttgagacactgaagtccaatggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatatggtgtgatatatgaaatgacatgtttgaaatgatagatgacgtgattgtgatataatatcatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctttgtcttttcttgctgaataagaagctgagagggaggcaattgctgtcactggtccagccggctcagcaactgcacatttgtcaaagttcttcatccccagctttgtgattctctaggttattcattcttctgggatcgtagatggccaccacaggttcactgtggaaagaggggtaggaatttttaccagctgggtctgactccaccccacccccacccctacccaccgttttttgtttttgttttttaagatgaagcctcactctgttgtccaggctggagtgcagtggtgtgatcttgactcattgcaacctccgcctcttgggttcaagcgattctcctgcctcagccgagtagctgggattacaggcacatgccaccacacccagctttttgtatttttaatagagacaggatttcactatgttggccaggctggtctcgaactcctgacttcaggtggtctatccaccttggcctccccaaattctgggattacaggcatgagccaccgtgcccagccgtgtctgaccattttatcaggaaaagcaaaagcttttctagaatctatcaactcccttctgcatgtgtctatttggcatgggctgtgtcacatgacccctgagctgcaaggaatgctgggatacgatggaagcctgccagaggtagagccttgggaagggctgatagggcctctaacctaaatgtccaccaccagaggtattacagaggtttgagcaagaaattatggtggtcccagggatgatgcattctgataatcattatcatcaagaggaatgtctaaaggaaaggggaaaaaaaaaatcagacagtcacattgaaatgaggtccttaagataggccctaatccaatatgcacataaaggggaattttgggcacagagacagaggcagagatagagggaagatgatgtgaagaaaaacatagggccgtgtagaggcagaggcagagattgaaattgtgctatcatgaacgggggaatgtctgggactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccagtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccaggtttgctttacctgatctcactggcttcatgtttattatcttattttcagtttcaaaagggcatatcctgccccctttcccaagatcagaggataaggaatgtcttgatgttctcagtcgtaaaattaggctaataacacctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgcaataatgtaattgaaataatgtaatacaatcctgcttaatattacactgtatatattcattgacttatagactgagctccttatcttgttcattgctatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttccctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggccattgcatgtttatagtatctcttttttatggctgcccaagttattattttttattggtttgggtacttaatttgcacatttgtaaacaattatgtagttacacagctgttgtaccacagagaccatatgcatttccatgttaagagaaaagtccgtgagggattctcactggataccatcataaaagaattattgtggtgccaaaaaaatttaaaaaaacgactagctcagaagttatcattgtgtttttatagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggggctctcttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctgtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagtaattttcatatatacttatttcctctgaaatgtattagtaacatttgtaatttaccaaatggaaaatatcacttaactttaagcttcatcaagttaagaatgaatttgtaaccaggggtattatgttttctcttattataacaaacaccaatcaaaaacaaacaaatacatgacgggaaagaaagaaaacccagcatttattggcagtatttttctgcaaaatattatttgtttccctttgcagttttattcattttaagcacgttttcaccaaagtgttctattctaagctagtctcaattcaatttaaagtggaaggtttttttcagtttagataatttacatataaaagcgttactgtacattttatgaaatgactgttttcagaaaacaacgatttcaatttaatcgtattgttattctgcaagttgaaatgcctcactcttgcttcttggtcttactgacaatattccttcttgccctaattttaaatggtgagtgtttgaaaattgatgtgcttcttttagaccctaccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttctttttttttttatgacacttttcttctggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagtgcccaagtgccttcctccaaaagtacattagatactttcttggggagagaagaaattagacaggagctacaaagatggattaaaattaatttggtcctaactaaaagataagttcctcccccatcctcaggatgaaaccaagagcacttctccatcatcaggggagccaagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacaaagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcctccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgtcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgatcctgacattccagtcccaaaggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctgaaaagtgaccgtatgaaatgagcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcagcactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaacgtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttctcttttcttttcttttcttttcttttcttttccttttcttttcttttcttttcttttttcttttcttttcttttctacctctcgggattctgagagcatcctgtaatgttggaaagctttctgctaatccgggcattggagtgctctctgggttcactcctgacagttctttattgctttcccacctctgccaaggtcaaaaatggaacttgcttcttgttctcgtatcactcagactaagcagttgatgtaacagataacccccaaatttcagtgatttcacatttaatctgtaaaaaatgaggatttgtttatagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttaccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcagctcgtcacccttgagattgaagctcgcactctgtaagctctgaataaatattaaccatctcctgaaccctgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggagaatattgaatcatgggggtggttcccccatactgttcttggggtagtgaatgaatctcatgagatctgatggttttataagggggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatggagtttcactcttgttgcctaggctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatgtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctccttctccttcttcttctctttgttctccttctagttctcctcctttcttctttcttacttttactcctccctgcttcccttccctccctccctcttcctccctcnnnnnnnnnnnnnnnnnnnnccctcttcctccctccctccctccctccctccctctctccctccctctctccctctctctttttctctttctctctttctctttctgtgtctctcttttctctctctctctctttccttccttccttccttcttttcttccttccttccttttttcttcttttttttggaaacagtcttgctctgtcacccaggttacagtgcagtggcatgatcacggttcactgcagcctcaacctcctggggtcaagtgatcttccccacctcagcctcccgggtagctgggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttattccagcacgtggcatcgccagtcccagtgcccttggcagaccatgcagaatgcatccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggtttcagtgagctgagatccagcctgggtgacagagcaagactccatctcaaagcgaaacaaaacaaatgagggtcctcatcagcgtgcctttgacactgtcctctggtcctggtgatctgaatacatcaccacagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcccttatgtcaagcttctttcagtaacaactgaaaggctaatagtagtgctgtgtggggaggactttggacttggggattggactccatgggagaggtcagctccttgtctccctggtggtgagacagggaatggtagagtgtgtcctacctatgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctggagtgcagtggcccagtcacaggttactgcagccttaacctcctgggttcaagtgattctcctgcctcagcctcctgagtagctgtgactacggacacatgccactacacctagttgatttttgtattttttgtagagatggggtcccactgtgttgcccaagctggtctcaaactgaactcctgagctcaagcgattctcccgccttggcctcccaaagtgctaggatgatgataggcaggagccaccacacctggccatggataacatttctataaaatataaccatattttcaaacaaagagaaaagtggcgttgtgctacatttcttctccagtgcttggttccctagaagacagccagattctcacttcttttcctgcattcagtctcttgtgatatcacatggcatgtggcctctgaaaaactccgctgtctagttgtaaaagaatacaagtaagtagtcaagtgacaccttagcattctgatgaaaagagctttgacctcacagagcttctggaagggtctcagagacatccctgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaacggtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcaatcccagcactttgggaggctgaggcaggcggatcacttgagctcaggaattcgagaccagcctggccaacatggtgaaaccttatccgtaaaaaaaataaaaaattagccagacatcgtggtgcatgcctgttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggaagatctcttccagggcctctggaggaagcacagtcctgctaactcttaatttgggacttctggcttccggaactgcaaaagaacaagtttctgttgtgtgtaggcacccagtttgtggtaatttgttacagcagacatagcaaactaatgcaaatgggctttgcttgaagtccctcagctgctaagggtcagaaacaggatttgaacctacagttttgaggcctgaacctgctatgcagtgctttcttcctgatagtgaaaccactgtggtcccaaacccacagggctctatttagatttaaacaagactatgaatgtaaacagacacagtgcaatgccagatccagagcaatcgaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatatggtcaagttgcttcccaaaaagcgtctctgtcaggatgatcttatgaacgacgttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaatgatccacccaacctagcctcctaagtagctgggaccacaggtgcatgccaccacgcccggcaatttttttttttttttttttttaagtagagacagggtcttgctgtgttgcccgggatggtcttgaactcctgggctcaagcgatactccctccttatcctcccaaagtgctgggattacaggtataaaccaccaacccagcctcaggagaaataaatcttttaggaaaaaaaagtgacacagttttctcttgtggcttatcacttggaatgtggagagtcatttccattagggaaccaccaggaatcttggcaacttagcagccacaggagatgcagaaactgagtagtgatttaaaaattcagatcactttgtttgttcccctagaataatacattattatcattaacaaagtaactcaacttacagtatcaaatcaactgcagagccattgatattgatgttaccgtactatccaacacattatgtttagtgttgatttaagaaaatgttgattttatttgatgtcatgggtgggaaattgcttgcttttgttttttgagtgaatctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcattccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggataaggccagggtgcagactgggcagtagttccctgtcatgaatccactctgcagttgttttataacatgcaacaaaaactaaagtctaatagcactccccaatgccaattttttttctttctcttttttttttttttttttgagagacagggtcttgctttatagcccaagctggagtgcagtggtgccttcacagctctttgcagccttgaactctgggctcaattgatcctcctgcctcagccatctgagtagttgggacaacaggtatgcactaccatgcccagtgaatttaaaaaaacaaacaaacaaaacactttttgtagagaaagggtcttgctatgttggtgaggctagtctcaaactcatgccctcaaatgatcctcctgccgtggtctccaaaagtgctgggattacaggtgtgagcccccaaccccaaaacttgaatctgggccacctttactgacttacttattactatgtagaatatggtacaggtgacgctgcagactcttgaagttaggtcataaaagatgatcctgcttccgtctggttgtgtctctcactcatgggatgcttaccctcaaaatttggccaccatgccatgaggaaactcaatctagcgtaggtaggaagaccgtgagaggcccaaatagagaggaattgaggccgccagtcatagtcagcttcagtcatcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactcccttggttaatttaaataaaataaaagtaaataaggggaaattgcatactcctatctggactgttttcttatggttttggaatctctggcaggtagaagtaattatttctgtaactcttaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctaagcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgccactgcactccagcctgggcgacagagtgagaatccgtctcaaaaaataagtaaataaaataactaactaggctaggcacagtgggtcatgcctgccatcccagcactttgggagtccaaggcaagaggatcacttgagcccaggatttcgagaccaacctggacaacgtacagagacctcatctctacaaaaaataaaacagctaggcatagaggcacacctgtggtcccaggtagttgggaggctgaggcgggaggatcctctgcacccaggtagccgaggctccagtgagtcatgatcatgccactgcactgtagcctgggtgataaagtaagatcctgtctggaaaaaaaaaaacacaaaaaactaaataagtcgtccatccgtccatctattcatacacacacgtaaaatgaaaactaaagcaaaagagtagtattaaattctagttagagacttaggatttccagtgactgaaattggaatgttaggtgttaaagacacacatcaaaatgagactcttggttttttttataagtgcaaggattgcaagatacctgaaaagggagtatttttcccccacatgcatctcaggagggtagcctcagatataagcttaggagtcctgaatttatcatcaatatttatatcgctgtttggcccctaacaccttccctatgatagccctaattggaatatagtaaatgtttgttgcatgaatcaacctatttaacctgtgcgtccttaaatcttacggtctgcgggttgacatttctagtgaagggagacatttctttacctacctgggacctcagaccttggacctcactgaacttgagagcagagctggtttatgtgtaactgaacctgatggttagtttcctgtttcaacttgattaggtcccagtcacagggtgcccacatgtttggtcaaacatcactctggggtgtctgtgagtgtgtttctgggtgaggtgaacatttaaatcagtcacctgattacagcagattgttctcaagtgcctgagcttcgtctcatcagctgaaggtctgaatagagcaaatagactgaccctacttcaaagagaactccttctgcctgatgactcaggtggggacttcagtccttttttttttttttttttttttttttttttttttttttttttgagatagggtctggctctgttggctaggctggagtgcagtgacgcaatctcagctcactacaacctcagcctcccaggttcaagcgattctcctgcctcagccttcccgagtagctgggattacaggcacccaccatcatgcccagctaacttttgtgttgttagtagagacagggtttcaccatgttggccaggctggtctcgaactcctgacctcagatgatccacctgccttgacgtcgcaaagtgctgggattacaggggtgagccaccacgtctggcctgacatcagtcttttcctgccttcagacttgaactgaagcatcagcatttcttgtgttttgatcttgctggagttggactgaaactacacatcagttctcctggctctccaccttgcctatagcggatcttgagactttttcttattttatctatctatcaatccattggtcatcaggttctccagagaatcagaaccaataagagatgtcatacacaccacacacaaacacacacacacacacacacacacacacacactaatatggttctgattctctggagaaccctgactaatacagaggcaagatcctgttttgacgtgcttgaactcgaggacttatgccgatgttaactctgagtgttcctgttttatactcagccatacagatgctcagagcatacctgcacaagtcaactttttgtgtctgcaggcatgggcctgccctgtacatgaggagacagcagacagttcctctccctgctgctggcctcttcatcttctcctggcgtcaccacggccaccgtgatgcctggctcaagtactagttctatgtcaatgatggtaccaatggactctaactttagaatgttgttgactgaaggcccctgccccctgccttgctttaggtggaggatctggtcaaggctttgtgaatcaggggatgctccacacctttctgctctctgcaacagggccagggatctgagtcccttcttgtctatccagaaaccgtatacccagtgttctctttctctcacctccgaataggtgggccttcccaatttacctgtgagaaaactagtgtgccacctcaagcgattctggcctctgttgactgtctgaaccctgtgttttgttgagtggtgcagactagagatgaagacagggattcggcttcgcttgctttatcaagggaatgttcttgggacaaatgtgtgacaggtgaggaaaacaacataggaaaggagacagaagtgaagagaagatgtggtctcaaatgaagtctggcttcaggtttatccttggggggctctggaataaaaatcacacctcaaacttgacccgcttgaggccagaaggccgggctgtggtaccttcgtgtcggacagtcataggctatcctcatggggacctgtatgttgccaggtgtcttgggcaaggtggacaaggatgccagcaaagtgaaattttccagagaaggtcacaaaagctaggaaatggcacagcagctgctaaaaggggatctgaccaggccaccaacagcttctgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggcactacaggcgcatgcctccacatctgactaattactaaatttttaaaaatttttttagacactgagtctcaccgtcttgccctggctggtctcaaactcctgggctcatacaattcccctgcctcagaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcaagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatatgtagtcttttattcctcaccctactcccacccttctccctgagttcccaaagtccattgtatcattcttctgcctttgcatcctcatagtttagctcccagtctacagggttatattaaaagaggaaaaggggtataagaatctaggtatcatggatgatgtcctggtcctttgctgagtcccatttttttcttcctcacctgatttcccccatctggcagaaacttttacagagtgtttgcagaagagaagcctgtaaactctggagtgtgtcctgggtggtttgtccttgggccactttattccctcaccgatcccttccaaaggccatgagttcccagtcagtcatttccctatatcagtatttattgttttaatcaattttccccatcccaagagaaaggcaccaacatgagtccatgtgttttaacatagcaggggtttccctgtcagagcccggtggacttctgtggccataagcaagtcaaggtgggctcctaagtggcagctgcccacttccagaaagctagaggttctaattatgtcttcctgaaaaacagttcaattaggtaaagtgacattttttaagcccttgtgtgtgtccgactcataaaagttcagaaggttgttactgagaggagactgcagtcattttaagatttcagtagctgctggagttgagtagataatttttcccctttctaatattatatattaggtgtgctcttgtgtctgggtgaaacagagcaatcacaatgattgttttttcagtatggtaataattaggcataaaatcaatatttatgtgtaatgtgccatttgaagattctccctgtgtatgatgctgggttttacaaaggaaaatctggattcaggtggccaatgaagtgtcacgatataaaaagagaattttgaaataatgagaattccactcctttgggagtattggcatatgttaaaatacaaatatatctgtatttttctcacttttattagaagagtgcaagtttgttcaaaacaactgctggattatctagtccctgaacagccatttatatttttgttacgcttgtggtttttaaatcatcctcatttccttgatcgcatttgcttctcctggctagaatgtgtaggagacgggtcggggagactgtgcccatttgacaggtgtgaatgcgaacagaggctgcagctggttagaccagggctgtgcaaccctagagccattgccttgaccacaaagccacagtctcctagtcctaatattaagaggtaggaggtagatagagattgtcccttaagccacattccattcttcatatttttgtacccattagagtagtgctgatcatttgccttcattgctggggtcccctaaatgcaacttctcatgctgccaatttagtcctggccctaggaagacgtaggtgataggatagaattcaacaactagaagccatggtttcctggttggatagacttcctctgccaccagaataaaggaatagagggttcctcactgtgccccatagctgcaaagtcacaggaagcttgcagcaggccagtggtaacctctgagtgacttctgagttcccagagctaggaccatgacttttcccctggattcttaagtacccggctaaaattgtgtttgccgaatgaaagtgtgatcctggaggccatgttgtttgtggttcatggaagggtgcttgttcagcttggtcaaagcaagatggtcatactgggttttggtgcccagacgttcccaacactcgcagcagagggcattaggatcatgtttagccaacaattttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcctggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtcgagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggaccccggctggctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttacctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtcttttccttgcaatgttttgtaatattacatgtagattgtacatcgtttgtcgataaatcagtgtacaaatactaggggtgagtgtgctcaaaacttatttttactgataatagtccatgatcaaggcagtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctcccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcagaacaggatctggaggcagggaatctaaggctgattcacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaacctatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcctccagtaacataatgaatgtctggatgtggtatgaagagtattggggtacaccacagcagcgtgtgctctgagaacacagtaaacaggcatttgatacagatcagaaggtccgtaaaggtggtatttgaactaagttttgagagctgggtaagagtttgtgaaaagacagggcttaaggaaggatatagtaagctgaaggcacaggactttagaaacacataggctataactgcaaggtgtgtctcagaaggtacatgtgacgtttcatttttatttgtttgcttttttatagtgactgcatgatcattatatgcagaagacgcttgaaggggccagattaggaagggcccatggtccacactgctttttttttttttttttttttttttttgaaacggagtatctgtctctcacccaggctggagtgcagtggcacagtcttggctcattgcaacatctgcctcctgggttcaagcaattttcttgcctcagcctcccgagtagctgggattacaggcacctgccaccacacctggctaatttttgtatttttagtagagatgaggtttcaccatgttggccaggctagtcttgaattcttgaccttaagtgatccacctgcctcggcctcccaaagtgctgggattacaggcgtgagccactgtgtatttctattaccagcctgcactgcatttctattacccgaaaacagtgtggaaaatattaattacaagggagattaaaaagtaaaactggttggttggcctgaagacccacatggtgacttcactaaagtcattgggtaagcaaagaagagcaacactctagttttcctccaagcttcaacgttttctgtttcctcctatgtcaggtcttaatttccctacctgattcaggctgcgctaagctgacttcatcatgactcctggcttccccagtccctgcttcccagcacataccatttattcagtgttggccagtgacgcctgccactgcattttattgatgaagaaatggagatctcaagaggtaaaaaaaactgactataggagccaagactagtttagagtggagtttgaatatgaacatgcctctgtctgtgaaagccagtgtcccttcagccaggatctttcctggaagaactcagtattaaggcacttgattagttcttcctgttggtggactgattgattacatttgaatctttcagcaagcttttggctgagctgggcatcttccccgccttcctccacctctgccttcaaaagcctgaatttccaaggctttctgccatgagtacttagctttgaaaaacatgagcatatttttcattcttcttgccggcctctccctgtgtcatgcctgttattcttttctccctcaacattgacctaggtcagaaggaccctattttaatgtttagcgtttgggggtcactccatagagaggggtttgtggaaatcctttttttttttttttttttttttgcttctttctgtggatctgtttggaaatgtaacattttaaagcccttcttggctggaggattttttatggtaaacataaaacgttcattgaaacattaaacattttacagctgtttttcagcacataaattttcatagacatccaccccctcactgccacaccccctcatagatttcttcttttcctcctccttctcctcctccctcttcctcctctttttccccccccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctcaggaaagccagagctaagatggtgcaaaccagcatgtgatttgtccaaggacatcgttttgatatgatgaaccatgggtggtttgggcatttgtcaaagcagggtcagcagaaagctgacgtagttgggtctaaagtacaacaggactgagcatggtggctcacacctgtaattctagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcctgggaagagtggtggggggcactttcttgcccattttttttttttttttttgagatggagtctcgctcttgtcatgcaggctggagtgcagtagcacgatctcggctcattgcaacctctgcctcccgggttcaagcaattctctagcctcagcctcccaaattgctgagagtacaggcatctgcgaccacacctgtctaatttcttatctttctaacacagtttaaatatcactttctcagaggcctaccctgaccatcctacttaagtaacaataataaaataaaaatacccatcatttatgaagtgctcattatgtgccagcgttcttagcatctcccaacaaccctaggagacaggcattacaatgagccttcgtaatgttcagatgaggaaactgaggctaagagagccttggcaagctgagttacttagctagcaaatggtggagtcgaattcaaaccctgcctctcctcacccactctgtttcttttcttttgagcacttaccactttctgaatatgtatacaattgtttcctcgattactgtctgcctcttcttccctagagcgtcagcccatgagcttatccagcctacagaggagatgctgcagcttggcagagcatggattgctcaacataccagagtttagtcctacctctgtctccaagctgctccatgatcaaggataaactataatctttctctctgcctcagtttttccacctgtcagtggaggggcatgctcttggatgcctgagtttttcttagactcagcatcctgcagccgaaataaccatgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccaggcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccgaatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcatagtcctccatgaccaagggctgtctgcatgggtacgcagataaaacatgcactgccatggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgttacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctccctccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctcctgtggtctgtaagaatgggaccaggactcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctattgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttgtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagaaagccatttctgcagagttaaaaaatacgtaggttcagttccttaccaacacgtagacatgttgtgatgaaagaaggaaaggaaggaaggaaggaggaagggaagaaggagggagggagggaaagagagagagagaaaaggaagagaaaggattttctagaaaaagaaaggaaggagggagggaaggtaagaaagaaattaattcccattttagagtaagactggaggcagagtggtcacccagatgaaaatgaataacccaactgtgtctttcttctggtgcctccacgtggaagtgggctgccacaatacttctaaagagaattggcatttttctttaaataaggaggaggatgaggagagagacgacacaaaattcactcacagaagtgaacataaattctaacattggtaaaactttgtctttgttttaaataatcagtcagttgtctcaatccataaaagagtatctcttgtacaatgtctgcttttgagtgattcacttcgatgcgtactgaaaatatacctttaagtagttgagtgacttgaaatattggtaaatgttctttaatattttgtctgtcagtgttagagactatcaggttaaaacaaagatattctttctttcctttttgtttttgacggagtctcacactctgttgcccaggctagagtacagtgatgcgatctcagcttactgcaacctctgcctcctgggttcaagcgattcttctgcctcagccttctgagtagctgggattacaggcacacaccaccacacctggctaatttttgtatttttagtagacacgggatttcgccctgttggccaggctagtttctaactcctgacctcaggcttcccaaagtgctgagattacaggtgtgagccaccatgcctggccaagaatattctttctaatatgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtgtccaataaatttaatcacataattacttaaatggcctggcgagccgccttacctagctggccaggaattccaggagtcaggcttcctgatctaaatctgtcctggtcccatcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccagctactcaggaggctgaggtgggaggattgcttgagcctgggaagtcaaggctgcagtgagcaaagatcacaccactgcagtcaagcctgggtgacagggcaagaccctatatcaaaaaaaaaaaaaaaaaaaaaaaaatatatatatatatatatatatatatatatgtatatgtatatgtatatataaatttaaggaagcatagaattgaagaggctattccaaggtcacatgacttttaagtggcagaaacagggggaattctgtctaacacaatccaatttatccatctcaagaaaagagatatgccaaagagaatgattattaaattatcattaatgtgaactcttgtaattactctcataattttctttaggcttatcccattgggcattgctaagtattattagattgtgattataaatggattccgccaggcatttctcttttgctctgtggcagctctttctctagagaacttggtccctggggatgccatcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagtctttggatgttttaattatataaaaaaagcatggaaactgggcattttaattagcaagtacagccttgacacaaataaaggcatggctttggttatgcagtgcatttatttggttttcttgaaataagaaaaaaagatttcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactattaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccaggtaaagcaggccttgttgctattcccctggaccatgatattacatgttgggatgatggggtcttgtgatactgattaatttaaggctgcatgatgatgagggaggaacaaagatgttcttgagtcagtacctgccagagtggctgtatcctggtgttgtaatatcaaataattctacattatttagtaaatagccctgcccgaagcctctcagtgccacacacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcataggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgacacatacgctttttctccctttccagctggccctgttgcttaaagtggcagaagtagatgtcatgttggcagacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatggactttagccagaacacactgaaaaacacgagaaaagttggaagaaggaattatttttagtgttctgagaatgctttattgatattcctatgagagtttcattggttactgacgctgtgtactgattgggtaaattctagcatttttacactcctttgtttcaccctgtttgttcattcattcttccgttaaactacaattaagcaactaccatatctaattttaaggtggtggacaaagaatcaaacctaagttggggaatgtggcctctggtgattctcagttcttggtagccatgtctcagcatagtcttctcggacacctaatactactgacctgtataatcgatagggtattgcagacatcagagtatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctaccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactgaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaacacaattccaagtgctacctctgcatggcagaaactgtcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattgtaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcaggccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatcaaggtccttaacttaatcacacttgcatttgattttatcatgcaaggtagcatactcacaggtgggattaggacttagacaccttcagcaagaaacattactcaggccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccgggagcaaagctgctgtgggacatgagactctttgaggcagaatacctctcatgcctggagagcattacaggctgcattagtctgttttcactctgctgataaagacatacccaagactgtgcaatttacaaaagaaagaggtttaatgaactcacatttccccatgtctggggaggcctcacaatcataatggaaggggaaaggcgcatctcacgtggtggcagagaacagaagagagcttgtgcagggaaactccgctttataataccatcagatctcatgagacttattcactatcatgagcatagcacaggaaagaccctcccccatgattcagttatctcctaccaggcccctcctacaacacgtaagaattatgggagctacaattcaagatgcgatttgggtggggacagagccaaaccatattacaggctaatgactgagcgggggctgtttcttgttgtgttcttataagaactattgcattttctttttcttccaaatatagttaatggcctcatcttttctggactaggtttgtagtagaccataagcaaaagagttcagaaagcacggcctccaagaagtcggatctgcttgtctttatcaatctgtttggattttcctggcccatttactcacaaatttaaaagacatgatgagttttcagggagaactctttagcatttacattttaatttagttttgtttacctgtttagtgccctctcggttcccagaccatcaaactcaccattgtcaccggggagaaatttgtgttggctgaaatctgtagtggttggtctgctgcttttctttctctgctcatctaccctgatagtttccctgtggtttgtggtgggctcacagctcttgacctcaggactctcgctggtctagaggagattggtttgtgggggcgtctgacatgtttgggttctttgtgacatctgggccacccggttgagtctgacaagaaacacttaatacctccttggctttgaagctctcctttgtggcactacaaggtcctctttgaaatcccacattcttttttggatttaggtattaaccccttgctgtgaggagaaagataattgtcaacacacttaggagagaaatcatgcagtaaagctgacccgacatagactaacttaaaactaactagttcattagtgctaacttagttcattagtgctttatctccttgtgtgtgtgagtgtgtgaggggatcaattatatacataagacaaagaccacctaggaaatgtttgagaaactgtgcagtgaggatgaatcaacaagtaaatatcatgagaatttcttagattgaagaaatattactcctatttggtgtcaactctgtgctggccttttcactcaagttctctgatgtaactgcccacagtaatcctgtaaggtatggctaatcatttccattttatagattaggaaaccaaggtccaaagtggtgaattgatttgaccaaaatcacagacccaggaatttcctcagccaagagcctacagcagctgtgtcttaagactgtgccctttcatccaccctcttggtactcaaagcttggtccatgaaccagcagcttcagcatctgctgagagcttgctggagatacagaatctcaggcctgactgacccgaggcctgctgagtctgaattttaaccagagtctcttggtgactcgtgtgtactttagaaggggaactgctcaccgcccccacttcccactgagtcgaatagacattaagtgagccttccttatgtgctcagcctgtggtgaggctgcaaagacaatacgacccagcccctgtaatgcaaaattcagagcatagggcagcacactgctgccatgagtcgaggtgacacagtactaacagtgggcacagggggctcggggcacagaggaggggtgcttcccagggagactgcccgttggagcttactcctaagctaattgggaggcaggaatccactgtggctgagaacagcagctctgaatttgcactgtctggtttcaagtccaaattctactacatcccagctgtgtattgtggggcaagttacttaacctctctggcctcagtatctgtatctgtaatatggggaatcataaaagcacctacttgttaaggcatattaaatgcaacgctactttgaaggactcatagtagttaacacccagtttggtaagtgttattattgaaggctgagaacagaacgacaaacaacaatcacaacaaaaggctggggaagattttcctggtggggggaccagatgagcaatagatctccatatgcagaggggtaactgagtacgactctgggacttacactagaacattcatattgcaataaagcagatttttcctgagcacctactctgtgccaaagcactattgtaggctgtggagatagggagctgaagtactgaaagcgttacagtcaagggccagaaaaccattgttcaagcaattggcgtatggcttgatctgtgtttattacaaagcgatacttttccttctaagtactgctttacctgcatcctgcaaattttggtatgttgtattttcattctcattaattcaaaatatgttccaatttcccatgtgatttcttcttcgaccctcacatgtttattacagcatttacttgtttctgttcatccagaactcattgaatacctgctatctaccaggcagtggcctggtcacatcttctgacctcaagtagtttatagtccaaaaagacattggctctttgggatagaggcactttttgggggagagaaacatgaatgcaactttttacatagagtatgaaactctgttccaaatctctcaaactcaggttctttgattcttaaggtatttttcactgccgagttgctgtcattgaaacaaaatctgtcctggtcaccactgtatgcccagcacgtagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgccctgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgggtaggacatgtgaaatatttgctcagagagatccagaagtgttgatctgagtaggatcagctggtgctccaggataaaaatcgtgtcaccacttttgccgaaaagtcactgtgtttctcctgtactcagcaggttacagggtgccatattgttttcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcctaattccctgtgagcttgacacaggaggccgcctcctcctccaggcttacttggaagcattctgtcctcttgttggaagggaaattggtatggtagggaggtgcttcttctgggagtgggtttgtaaaatcaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagtggcagtctaagcctcagtttcctcatctgcaaaatgggtgcaattctagtacctccttcctaaggctgtgaggattcaatgaggtactgcttgcaaagtttctagcacagtgtcttgaacacggtaaacaacttacctaggtctgatctcatttgatattgttgctcatagcaaaggtttgttgagtttactacggatataacacttgttcttttttaaaataacttttaaaaacgcaagtgttgaattatctgcattgtgcctttagggcatacacatctgcttacaatattttttgagctttcagaaaacttaagatatggttgagggatgcaggaaggaacaggacaagaacccagatccctgcccaacaggacagtggaagggaagtctcagcatctcgaaatgagtgcctggagaggatgggtggcggctgtgcggggatgtggtagggtgatggtccttgaaggatgctgcagatcacagtggccccacagtgtggggattggggtgggatatgtgacaacaaaggcatccctggcagaggatccagcacgagcaaaggcagaaagtccaggaagtgtcaggaatgagaagagcccagtagaggatgggcttagggacagtgatgagaccttctggtagaggcgttgaacactagggtgagggctttgctctgacttcaggaagcaggtgagaggccctgaaatttccacgtaagattcggggccgggcacggtggctcatacttataatcccagcactttgggaggctgaggcgggtggaccacctgaggtcaggagttcgagaccagcctggccaacatggtgaaaccccatctctactaaaagtacaaaaattagccaggtgtgatagcgggcgcctgtaaccctggctactcgggaggctgaggtgggagaattgcttgaacccgggaggcagacgttgcagtgagccgagattgtgccactgcactgcagcttgggaaacagagtgagactctgtctaaaaaaaaagaagagttggatcacagcaaaggtgagctttaatgagttcactctggcagttgtgccgaggagggactggcatggagagaaaacagaggcaaaaatcacaacctctgtcagagaactcatcgcactatttctgtcctgccctgggatggtggagcctaagggaacagagaggacagagtgggtggcacaggcattgcggaggcagaaatttacgtggcttccatgcccattggtgtgaggagtgaggggtgatcagggatcccagtggcttgaaagtataacaaaagtatgactagatccaggaaatacagctggagagacccaagtctgcacagaaaaggtttacagagcccaggcacacagatgacatgagcagttccaaaggagtgggacggggtgaatgatttgtggtcagaggtgtggtcacacataccgtcccctgatagtcggtgggaactgggtcaggttccatttgccaggggcaggacatactgcgtgccttggccttttctgggctactcaaaaaaggattccaccaggtaaacttgaatcacctagcgctggtagaaagccttgctcttcgtcatctctcctgtgtatcgctagccttattaaaatgtgcagaggagaccgggcatggtagcacacttgtaatctcagcacttggagaggctgaggtgggagaattgcttgaggctatggcttcaaaaccagcctgggcaacacagcaagaccccacgtcttaaaaaaatttagccggctgtcgtgtctcctccgtgtagtcccagctattcaggcagctgaggcaggagggctgcttgagctcaggaggtggaggctgaagtgagctgtgattgtgctgttgcactccagcctgggcgacagagggacagcttgtctccttgtctctaaaaaagaaaaacatgctcagaggccttgtgagttagctctctccaaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacttccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcctcccaaggagctagaggtgcatgccaccatgcctggctttttaaatttatttttattattatttttttatttttagtagagacagattttgccgtgttgccctggctgatcttgaactcctgtgctccggtcatccacccgcctgggcttcccaaagcgctgagatgactgcgccaccacacctgccacaaaatttctttgttatggctgaataatgtttctgtgtgagtgtgtgtgtgtctgtgtgtgtgtgtgtgtgtgtgtgtgtgtttgaataatactcctatgaacattgtaccaatatctattcagatctctgctttcgattcttctgcatatatacctaggagtgaaattgctgcgtcgtttcgtatctgtgtgcttaaccttttgagaaactgccaaactgtcttcaacagcagccgcatcattttacattcccaccagcagtgcatcaggattctagttgctccacatctacccaatacttattttacttaaaaaaatagaatagccatctgagtgaagtgttacctccctgcagtgttgattcccatttccctaatgatgttaagcgtactttcacgtgcctactggccgtttgtgtatcttctttggagaaagtaacatccatttttgatactcacatggctttttggttctatttttgctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcggggggtcggttattttataagcaaagaagtacagccagtatgattttgaagcaactaggccccagtagaaaaaagttggagagtgaaatctcaagcaagccaaaaagtgatagatgagttaaaaaaaaaaaaaaaaaaaaaaaaaaaaaagttgcctggcttggtgcagtggctcatgcctgtactcccagcactttgggaggctgaggtgggcggatcatctgaggtgaggagtttgagaccacactggccaacatgttgaaacccgctctctactaaaaatacaacaattagccaggtgtggtggcgcacgcctgtaatcccagctactcaccaggctgagagtggaaaatcacttgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaattgcccagcgttttaattatcggcgtgttttatgcttttgtgaaatgctcatttcacagcttgctggtgggtctttttgtggaacgagaaagtgaatattcacaccagaaatgaggtactgaccctgaagggctttccagtcaaagagaaaggagagcatgacccgccaatgccgttgtttgtaagcaggaagctgacgctgcgccatggtgtaggggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatataccaggcgctgttacagcccgtgtaatgccacctgggagttggggggagtcaccatcgtccatccgtctgtccatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttttaccatgtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgttgtggagcatgtgggggtcccagctacttggcaggctgaagcaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaaccccgtctctactaaaaatacaaaagttagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggatctggactgggccatggcccattggatggcagaaaggttctcactgaagcccccataaaggtgggactcactgggaaaccgctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagccgagcaatgctaaatgtgcctggtactgagacgtcatctgtggacggttggcaccgatgctaatcagtgctatgggaaaataggcagagcgaggagcgtaagaattattatgtgtgctgtttgatagagactgtacaaggaagacctctctaaaaaggtgacatttggagcagagacatgaaggaagggattgctggaggcagaacattctaggcagaaggaaccgcacgtgcaaaggccctcaggtcagccggcatggcatgcaagtaagccacctgcaacacagcaggtgtggatgaagggaagagaattagcatttggccagagcacgcattttaagggatggagatccatttggatagtcttgaacacagaactgaccggaactgacttactctttgaaaagatcgctctggctgctgtgttgagtggattggtaagggacaggtggtgaagactgaaacagggtatccagttaggaagctaccacagtgatccaacccccagcttctgttgaggttgaagaacctgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggaggtggaggttgcagtgagccaagattgtgccactgcacttcagcttgggcaacagagtaagactctgtctcacaataaataaataaataaataaataaataaataaataaataagagttggatcacagcaaaggtgagctttaacgagttcagtctagctctctcacaaaaaaaaagttaaaatgacaaattttgtgttacatacattgtactacaataaaaaccatttttttgaaaagaatagtacaaaaatgatacttccctctcagtgtattttaccaagggattattagtgtatatgtgtgttcttactggaaatgttaattggacttgtaattctttttttaacttgtattttgggttcaggggtacatgtgcaggtttgttatataggtaacttcatgtcacaaaggtttgttgaacagattatttcatcacgcaggtaataagccttgtatccaatagttatttttctgatcctctccttcctctctccctctaccctcaggcaggccccagtgtctgttgttctttctttgtgtccttgagttttcatcatttagcttccacttgtaagtgaggccatgcagtatttgattttctcttcctgcattagtttgctgaggataatggcttctagccccgtccgtgttctcgcagaagacatgatcgcattcttttatatggctgcatagtattccatggtgtatattcactactttttttttaatccaatctgtcatttgtggacatttaggttgattccagtagacgtgtaattcttcttggaaatgttaatcttgatcatttggttaatgtgatgacttctgggttctgcagtgtgaagttattatcttcccttttgtaggtaacaaatactttggaagagattaaacaaacaaataaaaaagtggtgattgttattaccagcatggctactactagctaattccaggcttcaagccactggggcataggcatatgtttagctcattccacaggaggggaacagaggctcaaagaacctaggtaagttggccaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaacaaacaaacaaaagaaacaaacaaacaaacaaaaagaaattaggtaacttgctcagtggctagtgagtggctagattgtaagcttcatgagggcaggggactttgacgattttgtcggtatcctaagcccctagaacagtgcctaaacatttgttgggcagttaatatatatttgttctattaataagtagagcccgagtttgtgttctccgattccacaccccatgttccttctactacaacttctggctctggcttctggactgtcagtcattagcactccctatccctaagatttcaggaatgttcagctgttgcctagcttggaatggaccatcctctggtcccacccatgggtaagtcattggctgcagagcgcagacatttggctcccttcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttttcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccttctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccgagatcgcgccactgcactccagtctggtgacagagcgagacaatgtctcaaaaaaaaagaaagagttctgaatgatgataggtgttggaatccacgttggtgtgtctcatgtcattttttcgggcagtttcttgacagacccattttgtgtgtgtgtgtgtgtgtgtgtgtgtgtgtgtgtgcgcgtgcgcacacgcatgagcctgtacgtgtccccctccccccccacacatatgcacataagatagcataaggtagttccctggcacatggcgttgttcttaaccatgaggtgctcccaggctccgggcagttccttgaaagactcattgtctgtgtggggggaggggaggctgtacatgtccccacccaacacacacacatacacacacatgggcacatatgatagcataaggcaattcctggcacatggcattgttctgaactgtgaggtgctcccaggagatcttgtgcttcctatcacatgcccattctgcaagtccatccccttattgagcagatgtttaccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctggctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcaatggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctgtgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctggagtcctgcctctgtgacacttgcttactgtgtgacctgggtcaactcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcatggtcggggaagcctcagaaaacttacgatcatggtggaaaggaagctagtgcaccttacatggcggcaggcaagaggggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattaggaatgaagtttaggtcagaaaagtttcagtgattattttttcagaatcattgtttcttggtttctagggtccaacatgccattgttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctggacttttagtttaattttttgtaatttaaataatttaagtagctgatgtgtctagtggctgtcgtattggaaagcacagagtagacattgcaaatacagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgcctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccatctgaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatgacttaccatctactcacctcctgtttgagttcaagggaaggtttgcagattggcctgaaggaagacttctcttgaaaaactcaaaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcgcctaaaattctctcttctacatatctcactgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactacaggtgcatgccaccacacctggctaacttttatttatttttagtagagaggcagttttgctgtgttgcccagactggtcttgaactcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcagtgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccaaggaaggaaaggggaaggagaagggcctttgggactgggtggatgtaacactttctgccacctctactcttcctgctatagattaaaacagaagctctgaattgcagccacaaatcaataatgaaaagctaccagaccaagccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagccctcacctggttttctcttctccttccaagaaaaaacacccataccattcttaacatctctggaagctgggggtcaggagagggagatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatgcgggggaagaagacaataggcaagtaagcaagtaaatatacaagataaatagaaactgtgatgagggagttaaagaaattaaactggtccttgtggaagcaacttcgggggaggaggaaagacagggaagaccattttaaggaggtgatgtttgaacttaagaatcaaaaacagtgcaagcgctgcatgggggagaacagtctaggcaaggtgaacggaagtgcagggtccctgaggcagaaaggagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatttggaagattgttttgcagctgcaacctcaaaacagaagcctcctaattaccaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctgtccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgaatattgggccgggcttggtggctcatgcctctaatcctacctgaagcaagagaatcgcctgaacttgggaggtagaggatgcagtgagctgagatggcacccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgcaatgttcacaggtctttacatgtaaaaacaaccctgtaaaataaataacattattctcttcattctccaagtaagctgaggcagaggattccagcacaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctggggcaacgctaccaacattggtattccacagcattccaacgattctaaatactctcccagagtagggaggaaaaatcatccaaactacttggtaattgaattcaagagtgatggaccaaaaattattaatgcattcccttccgtccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgcaatcaatcattgataagatgtactgttattttatgtttcactaagagtgcgaagaacattgttaattatacaatgatccaaaaatgtcttctctctcagaatgtattgttttatatctattagaaaggctcttttgacttaggcatagatttctcatacatcaggccatttctatgcctgcctgtgaacacagggattttgaattacaatactgaatcctagtgtgatctttctgaagtcattttaattatcacttaaactcaatatggaaagcatcagcaatgcacctatatgcacaaaaatgagcagctatgatcaagttatcaggaaaaaccaaaacaaaacaaaagcacatctccatcatttataatggcccatcatttataatggctgcctgataattggagatacatgcaccagacttgacttaactgttctcttagtcatcagacatttagatttcaacatgctcctgttaagctctccttacagtgtgtgtggcactgtgcagttgaatgaaacatgccatggccagtggaaacaggcttgggctgatggagagggcctacagggccaggccttgaaggggagggaaattgttagctacacgaccaagagacagaagagaggaaggagtttgtacccacaactcagctttattttatgtaagctctttctgtaaagggaaagtagctctttgtaccaaagcaagggcctctgaatgagagctgggagaggccagaatgggcctgtaagaggttgatgtgtatgagacctgaagccctatgcctttgggaaggagaggaaggactaatatttgtgtggtacaaaggatgtgcctggcataccccatatcttttacaaagacataaatgtcttctgaataaaagtatgatgatgatgatcatggtgatgaagatgagggtgatgatgttgatgatgatgatggtgatggtgatgatggtagtatgataatgctgatggtggtgatggtgataggagggtgatggtgatgatgatggtgataagatgctgatggtggtgatgatgatggtgatatgacgctgatgatggtgatgacgatgataatggtgatgatgatggtgatgacaatggtgataatgatgtcgataatgatggtgatgctggtgctgttggtgatggtgatgctggtgatgatgataatgatagtggtgataatgttggtgatggtgggatgatgttgatgttgatgataatgatgatgatagtgatgatgatatcaacagataccatgtactgagcacttactttgtaccatgcaatgcttatggttttttaaatgcatttacaccaaattcttataacaaccctataagtcagtgccattgcttttcccatgtaacgtgcacatcattcaatcactcaacccttgtcataggtagatactattatcctccttttatagatgaggaaaccttggcttagaagggataagctcaagttcacaggcagaaaagagacagccagtcaagccctgactccttttgtgaccctgatgagattacaggtcctcagtctcctcattgtatctgaagactaaagaatcagaaatttgtgactccacttagtttttctccacccaggagccctcaggccgctggtgagtgaagttcttacccattagggattattaatatactagataagagtacagtctctggagctaggcttgtgactttgaacaaattattttatctctctgagctcagtctcctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaccttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttacagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctcttaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatatttcctttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggccaggctggttttgaactcctgacctccggtgatctgcctgtctccgcctcccaaagtgctgggattacaggcgtgagccaccgcgcctggcctgaattaatattttctaccccactttcttaagtcgagacaatcaataaagcaataaatgacacctggatttgtagcgaatgtctatttccatggtgtaaatagtggtaccctgagcaattttaagttataaatatgagatcactgaaagtggagttggggaacacgttattatatagtattttcaccacacacaggatacagtcaatgacttcaagagcataggtaacagtaaaatgtagtaaaacaatttagaagtcatgagttttgagtacttagtactttttagtatgatttatttaatagtaaccttatataatgtttttcttttaattgttttattgagatgtatttcatacactttccaataagcccatttgaagtgtaacattcaactttttttagtatattcgcatggttatgtaattttcatcaaaatctaattttagagtatctttttgtccccctaaaagtaactctgtgcccatagttggcagtttgtcatatcactcaatcactgtttcctttaaagagcttatcattaaagacagcaggcagttacacaacatcttctacatgccaagaatgtttctaatacatgctttatggatttttaaattgtggtaagatttacataatgtaaaatttaccactttggggctgggcgtggtgactcacgcctgtaatcccaacactttgggaggctgaggtgggtggatcacttggggtgaagagttagagatgagcctgggcaacatgatgaaaccctgtctctactaaaaatacacaaattagccaggtgtggtgctgggtgcctgtaatcccaggtattcaggaggctgaggcaggagaatcgcttgaacctgggaggcggaggttgcagtgagccaagattgcaccactggactccagcctgggcgacagagtgagactgtgtctcaaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatagatttgactattctggatatctcatataaatggaatcacacaatatgtggccttttgtgtctggcttcttgcttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcatattttggggagtggcattgctgggtaatatggcaattttatatttaactttcagaggagccaccaaattgttttccacggaggctgcaccattttatatttccacttgcagtatatgaaggttccaatttctccacatccttgacaacactttattttctgttttctttgaaggtatgaaattgtatcgtggttttgatttgcatttccctcatgattaatgatgttgagtatttttatgtggttattggttatttgtatcttttttaaaatagaaatgttgattcaagtcctttgcccagtttttaactgggtcatctggcttttgttgttgagttgtaaaagttgtttatatattttggatactagacccttatcgtataaatcctttgcaaacattttctctcaatctatgggtaggcttttttactctttttatagtgtcttttgatgaacaaagattttaaatcttgatgaagtccactttatctattttggatgttgttgcttctgtttttggtgttgtatctaagaatccattgccaaatccaaggacataaacatttactcctgtggtgttatgatatatatagggttcctggctcataactctcatagcccttgttgcagtctattgttacaatattgcgtgtgttaggcatcaggaaacagaatctctttgtctcctgtccttctttcacctgccccaaggcaggactctaatctttcccacctttttgattgtgagtcttcagaccctccccagagagtcagtcctgccttatgccctggggaaaggaatgctgacctcatgaagctcccataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaagtggtagcaagtgttttcctgagttctgtcatctgctccagcaaattaatcaaacccaaagagggggttatgggaacttccacctgaagcccctcagccagacattctgaagtctctgacttgctattggtgtctgggggtatggggggcagtcttggggactgagcctccaacctccaactaactccacgtagacagtgtcaggattgaattggaggactcccagctgctgtcccctgcttagtatgtggggaaagttgagttgtaaaagttgtttatatattttggaaactagacccttatcatataaatgatttgcaaacattttctctcattctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacccctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctgtccttatgccattgccacactgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttcgttaattcctgtgaccatatggcagcatggttaggatcttgggcttctaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaaatttattttatttttttgggacagggtcttgctctgttgcccgggctggagtgcagtggtgcgatctcagctcactgcaacctgcttcctgggttcaggtgattgtcctgcctcagcctccctagtagctgggattacaggcgcacgccagcacgcctgactgatttctgtattttcagtagagatggggtttcatcatgttggccaggctgctctcaaactcctgacatcaagtgatttgcccgccccagcctcccaaagtgctgggattacaggtgtgagccaccgtgcccagctcagcattattatttttagtctacacacagtgaacttaaatctcctctagaaaagtcagaaggtctacgtacaactttaagagttcagccaaaagagaccagtatctactaccgtggacaaccctatttaacatggaggagataagcagaaactgaaaagaggagcctgttttctctctggcagattaattttctttctttcttcacccatgccttggacatgaaacacaagtacaaaggttcagagaaaatcaaaacaagactgtggtttacaaataagtagtactagtaacatctcactgttggctgggcacagtgactcatgcctgtaaccctagcactttgggaggcagaagtgggaggatcacttaagcctagggttgaagaccagcctgggcaacatggtgaaacctcatttctacaaaaaatacaaaaattagccgggcgttttggtgcttgcttgtggtcccagctactcaggaggctgaggtgggaggatcacctgagcccaggagatggaggttgcagtgagccaagattacaccattgcactccaccctgggtgacagatccagaccctgtctcaaaaaaaaaaaaaaaaaaaaaaagtgaaaaaaaggaaaatcttcgttgttcttcatcagaagcctccacacagggcccctgaaggaagggcagggaagaagggggttggaggtcagtgggaggaataactctgtgactcagtgctttcctgactaccatctggatgtgggctgtatctgcgtaaggtgccgggacagggcggcctcatgaactcatgggaagcaaacacacaccctccctccgatccaccaggcactcgggtttcctgtgtgtctggtgatgtgctgggtgttgtggatctggactgaacggcagtctcaggtttatgtattaggaagcattcagcaggcaggagcagccgatctgagactggcatgggcagtggagacatcattcatctcctgaaacataatttggaggagactgttccagggctggctgagtgactccttgatgtcagcactttgccctgtcgtggtcttggcctttctcttgtgttccccagatgggtttcactgctctaaggatcataccttcgcaggccatctgaagttagtgaatctgaggcatacagaagggctgggtgcggtggctcatacctgtaatcccagcactttgggataatgagatgggtggatcacctgaggtcagaagttcgagaccagcctggccaacatgatgaaaccccgtctctactaaaaatgcaaaaaattagctgggatttggtggcgcctgcctataattgcagctacttggaaggctgaggcgggagaatcacttgaaccagagaggcagaggttgcagtgagccgagatcgcgccactgcactgcagcctgggcgacagtgaaacttttgtctcaaaaacaacaacaacaacaacaacaaacaaacaagaaacaaaaaatacataaaagaggccttctcttcacaagtttttcttattgttttttgtttttttaagggaggaaatttctttcagaagtcagtactggacattcccttatttcaccttgagctacacatcccatagtcagcttagccctgtccctggtgcgggggagcaggactgttgcctgtatcccttagtcattgccgcaggcttgctgcatcacaaaccaccattagacctcagtggcccgcagcaataaacattcgattctcgccatctctgggtttgaggtgaccttggctaagctcccctgcattgctctgctcatctttctcacgagtctggcaatggggctgggaatgggctgatctaggctggacttggctggagtaacccagccccaccttggatctctctcctctacttcccacatgtatccttttcatggttaaaggtagaaacagaaaaaaacaggcagaaacataaaaagctcggagatggcttcctattgcttcttcattctgggccagagcaaatcatatggtcgtgctccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcacacccaaaccttgataaccatggcaatgcaataggaaatctctttatttcgttggtgctcaagtgataccattaagtcccttaagatgcggaatttccttgcccccgctgccccctttctttctttcatcttatctatatatctgtatctatatctaatctattttttgagaaaggctctcactctgttgctcaggctggagtgaagtgatgcaatctcaggtcactgcaactgctgtctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgctctccactcaagaatacaaattgaacattgactttcctcattttttatccagttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacacagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatatagaagaggatgtagggcaggtagggctcagaaggacccatgccatatagcaaagttcttagtaacacaggctttgggttacagcaggctagattcaaatcctgctgtggtcagaatgtctgtgtcaccccagcattcatttgttaggagatggggtcttttgggagatgatttggacatgaagacagagcctgcataattgcatgagtgcccttataaaagtgaccccagaagctgccttgcttcttccaccatgtgagaaaacagcaagaagaatatccatgaatctatgaggaggcgggactctggccagacattgaatttgctgcttccttgatcttggacttcccagcttccagaaccatgagcaataaatttctttttttcaaagctccccaggagtctctctcggtctgttctggctcaggaagctgccttatttgtaacaaacaaataaacaaaaaacaaaataaataaaagctacccagcttagattattttgtcataaaagccccaaaagactatgacaaatccttctatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaccttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgtagacacagggcacagaactgccaactgtggctgctgacacctgtctgactttgactgggttagtgacaaagaaatgactttccttttgtatgttagccctgtgcctggcatactgcaaatatctatggttgataaattaatgttatcatcatcacgtaagcatcttgggaagtctgtaagtaatgggagttggaggcttaacactgatctttgagctggcgatttttccagccaactcattttggacgttggtgcttaagcatatcctgttttcgagggtggtgttggtggtggaggaggtgatggtgatgatattgataatgacagcaagaatgtcttacatttatagagtgttcaaaaggtgccagatattgtgctaagtgctttgcgggcattatgttattcacacttcacagatattctctttctacatgtaaggaaaaaaaggcataaatactttatataatttactcaggattttaagtagagggtagattttaagtccaggcagtccaaccccctgaaagctgactctttaacaccatatgcttctgtcttcctggctgttttgtgaatgagtaggatggaaaggagatccttgaattgggaaggctacccatggactacaactagtacttgtcttcaacctccatctagatggagtgctcacaagatcctctacatcaaacctggcttcttagtccactgctgagtcttcccaattctgaaaaaaaggattcagggtataatttctcacacagatttctgggacagtgctttcttggagcaccacgcctcactaatggaacactcatgtataattctggcttttgaatttttatttttttattaacatacacagtcagcattgggtgtggctctggggattcattctagtgggcaagtctcatatttctcaacctcaggtttttcatctgtaaatggggacaatactgacatctacctaatgtccttgaggatggaatgagatattgagtataaagtatctagtagagtggctagcgtatagtgagtacccaataaatgcaatagatgttggcttttattactgtcaagtggaaacaaaagtataaggtttaagtaagcgaacgaaatggaagataattgaggaagaaaatcagatgatgtctaagataaggcaaagaacattttgtgaatgtttaaatatcctaagacccactaaggaagtttgtggcaatatttgctcaaagacagtatatataataaatactttagactggttaagagaatggctctgaatgtctacctagctatcacatttagaaacgccccttgccttccttccaggactttcttccttaatcaggattgacttaactgttaactcctagaactgtcgttgattgcttggtgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggaggcaagagaaatgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctctggctggtcagtaagaacctttgatcccatgtttctttatcttcttctttttttttttttttttagccatagtctcactctgtcacctaggctggagtgcagtggtgcgatctcggctcactgcaaattctgcctgctaagatcaactgattctcctgcctcagccttccaagtagctgggattataggcatgagccaccatgcctggctaatttttgtatttttagtagtgccggggtttcaccatgttggccagtctggtctggaacacctgatctcaagtgatccacccacctcagcctcctaaagtgttggggttgcaggcgtgagccactgtgctgggccccaactttctttatcaatagaagtggggaaatcgtacctgccctgtctgcctcattggatgtggaagaaatgacataatccatgagagtggcttctgaatgaagagaacctgctaaagggaagacatgatctcaagtcagccacctctgacccaaataagaacacataattacaagactgtattgtataatcatgcaggacacaaggtatgcaattttaagggtcaaagtggtaaaaaaaaaaaaaaaaaaaggaaaatcaaatataaaaaggcagccccgacaggtacgagcttgtagtcatttccccaaatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattcgtccagtctcaaggaactatgataagtagcaaacaatatcccagaaaaatctccagtcaaaaatccactggaggccaggtgcgttagctcatgcctgtaatcccaacactttgggaggtcgaggcaggaggatctcttgaggctaggagctcgagaacagtctgggcaacatagcaagtctctgtctctacaaaaaatacaaaaattagctgcgcgtggtggcgcgtgcctgtagtcctagctactcaagaggctgacatgggaggattgattgagcccaagaggtcaagacggtagtgattcgtggtcacaccactgccctcaaccctgggtgacagggtgagaccctgtctctaaaaacaaaagcaaagtctactaaaaattcactggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgcgggaacaaaagctattttatcattaatatgccgcttttttgttatgtactcatgccccagaaattattgtacagcctgtacttgagtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagctatgggatgtacagcagagtataacaatgataaatgatgttgtgtgtaatttttctactattaacataaagtaatataaactgaaggacactggtctattgagagacttagaagctaatgttccatatcagatgcggccaatgtcaggactgaatacagattaggcagtgtccttttctccccaggggaattaaagtttgagacaccacttgctgccagtggttttatggcattttgttggggccggtggtgcctttcttggtctattaattcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgctgtctctttaacggagagttcatgggcagggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaagattttcttatgaaactgattttactcaccagggatagagtctcaaagttggaggtattttatgttgttttaaataatatcgtcatcacatgtcattttagaccccaaaagtccactccgaatctctgcttatggaattgaggaggggtgaggctgtcagaagccgagggacttggccaaggtcacatggctttggacggcccccctgaaccttggagctcatgttctgtggcactttgcatactgacctttctgctcttttatgctgcctgctctctaatattgtccaaaaaccttctctaaagaaagtacacaaatggagagagggggaattggacatgccattgggagaacaaatttatttagatatctttggctgtgttgacagaagctgcccaattatacccaatatacaaattttaaatgcatattagtcaaagttccagttatgtagctttagaaaaatttctatgtgaatgactacttttccctgaaatacgtcctccatctcaggcactagttaggaacttcccccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcactaaaaacagggttagaatatcttcaatgcaattataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcataattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattgtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacaccactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaaggctagaccctatctcaaaaataaacaaacccttgctattttagcttccgatgaggatatttatccttctagcatttgaatgcagccaaagtccttactgggcaaatttttgagctctcaccccacattaacaatttctctccttaactttgtttctgaatgaagttatccacagagttttaaagtgagtggtgagttgtggatacctcttccgagcaggtgcacccccatcctgccattgtccctctccttagtgtatatggattgatgacatttcagtttcagacaaagggacatttcattttttttaggagattaaagctgtgtaagatatacaatttaaactgaatgttgatattttatagattgttgagtccgattgtcctgatctaaaattaactggttttgtgatttggtgtaaatcgcttaacctctttcaatgttttttcagcaaaatggggtaagaacagaatctgccttgcagagaattaaccgagatgatgtgtggaaagggcctatcccagaggctggtgtaccatggtggcttctcctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatggaattgaacaggtaggttgaacaagataaatgccgaggaagcaagtgtatttaaataaacagtagtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcactttgagaggccaaggcaggcagattacttgaggtcaggagttcaagatcagcctgggcaatatggtgaagccccgtctctactaaaaatagagaagttagccaggtgtggtggtgggcgcctgtaatcccagctacatgggaggccgaagcaggagaattgcttgaacccaggagggagaggttgcagtgagacaagatgatgccattgcactccagcctgggtcacagagcaagacttcatctgaaaaaaaaaaaaaaaaaaaaaaaaaaaaaaaaaacagaaaaatgaacgagtgagtggcaagaaagatgaaatgattttcatcaccaggcctgccatggaattcatggtgccttgtactgtggccagtaggtgcaagagtatctagtaggtgctttatttttaaaaaatgtcttggaatcagtcatagtttaatatcaattatatataaattagtcttgcaggatccaacagttctgatttattccactcacacaacaagtcagttcttaacacaaaccacataggttcttccttaaataaaaagctgtggctatgaagaagtgagagtttttttttttttcctctccaaaccaccacgtgctcttgtgtgttattgtagtggcttcgcagagtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcattgaccttgtgggctcaagcaatcctcctgcctcagcctcccaagtagcttagaaccacaggcatataccaccatacctggacatgtttttaactttaatttttatttttgtagagatgaggtctccctatgttgcccaggttgctctcaaactcctaggctcaagcagtcttcccaccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatagtcagagctcaaaaattgagtactgcttcgtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacccttctttccttcagctgacttccctctccttcattcccaaccaagtttgaccccgccgcagtggagattgtggcagatgggtcagatagcatgtgtcctgtcgctgtcacaagtttttaataagggctgggggtcctcttgaagagcccaggaactgcagtccctcctctatgccttcccctgaacacagtgcgccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatagaaaagaaaaaaaaatcctgtttataccttaggcattctgtgatccttaggatgtagccatgacagtattacgggttttaaaagccacccaagtaatctaaatttcctccaaactaacaattcctgaaagattgaaatattgctaccaatgtgtacggatggtttccattgatatttgggaagtttccatttgtatttgggaagctttgcatgagcaaaatgcccctttctcctgatatttgcaacccatcttaaaaataaaagtacttttctgcatgtggtcttgtacatgaaattaagaatatcactaccaaaatatcaaaatttaaggactagattgtgaaatgtttaaggtaggcaaagaatatttaaccaagaaaggaaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatgtttttcgtagagtcagggtttcacagtgttatgcaggatggtctcgatctcctgacatcgtgatccgcccgcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccagcaacatttttctcatcttttgaacattagggaataacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttctacaaccaagaccttgaactttttcctctcaggatttctttcatgagaacccattttctggccatttggatatcattgatgagggaattgaagcatttccctattctttagagtttcattaaagtttgactatattccagtaacaattgttgcataacaaaccacccccaaatttagtggcttaaaacaacaacatttattttgttcaggaatctgtagtttcagcagggctctcaggaacagcttgtctctgctccagcatcagctgaagcagcttgaaagccagggtctgagatcatctgaaggttgttcactcatgagtctgaggaatgatgctgactggtgggtgggacccttgctggagggtctattggctggaacacctacacattgtctccatgtaccctgagcttcctcacaatatggcggctgggttccaagggtgagcgtcccaagagaaagaaccaagcagatgctgcattgccttttatggccttccatagaagttacatagccctaggttttcctgcattctattttttaggctgtcagacccaccccaaccaggtttgcagtgagaggaaatagaccccacctcttctggaagagaatgtgggactggacatactgccatggccacttttgaaagatacagtctgccacataagcaaacagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttattgtgtcctaatctatgtcactgagtacatccttgctgtttttcatgaattttccactgagtcgcaacatgccactggccagtgaaggtcaggcaggaaacagattaacaacatctcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaaatgacagctataacatcaagggcccgggtttattttaaatgtttttgcttctacatggattctaattaacgacagtggctaaaacctgattcaaatgtggcaaatgtggagtgccatgggatgaagccagtcaatttcatctaggagcattttatggcttatggaaagaaatattctcttagattgaagggcgccagcctgtaatgggcatcagctgattctcagaaagaagaaacaacgtactgttacataattggggcttctccaaagtggcctgaccaaactgtagagctgcttgtttgtctgatacggtagccattagccacatgtggctatttaaactgaaatgaattaaagttgtataacatttgtaaaaatcacttcttcggtttcattaactagcctcatttcaagtgctcagtagctacatgtacctaacacattggacagcacggttacagaacgttttcatttcatcggacagtttaactgctttggagactggttctcctttttctttttccatgttcactccagaattaaagtcaaccagttcaaatgtcccatctttccccacagacatttgtgctcaaaggcatccccttccccatttggagactctcctagggcctaggcccaagcaaccaggactccctgtagtcaaccccactcctcaatttttggcacccatgttattccacctcaagatcatgtcctcttttaacctctctgaatatgctcctcctgtgatacccatagggaccctgaacctctagtcctcaagagcagtcattcacccctttggactatggatccctttgcaacccaggaacaactactgtatggccacttcaaacctgtatatgctgcaagtattttatactaggtagggtaaataataggtcttagatataggtgcaaataattttcaaatatgggtaaatgctattgggatgtgtaaagtagaaatccattttaaagcgttattgaatccatactaacctgatcattacatatttactaattgatgattactaaaaatgtggacctttgtgaatttccgatgtcatagaagggtgttcttaactggaaaagtcagtagccaacattctgggaagtagaggcctcttcctcactgcttcattggtttaaaataaactccaacagaaaaacatgccatcatctttaatttcctgcatcagctaagcatttatttcatgtagtcctcacactagattgagtggttccatattaatatcctacgtcaaagatgagtaaattgagatgcgtaggttctaatttgcccagtgtcgtggtgtgtgatcttgaccactagcctaaactgctattttatgtccacccatcaacctctacggctgcccctcatttgaacacacaaaatatagttgtgcggcttggtggagccatctaaattccgttaggccatttgccaatgctgctattaggggcgaaatgtcatgcgcttgatctaaatgtacttaggagaattctcaggacctgatgaattattattcggaattttatggcctcacaggttgcaggcttcataccaactgcagctaatgagctatgggccccgagaaacactgaggacacacggcgttctgcacacagagtgggctgtttctgtctgttctccccctgcacccttctcagatgcaatctcaagtcataggagaacttgtgcaaatgtttctcctggatggtttcctttagagcatgtgtcctataacttgaaatggttgtctgagcagaatgtttttagaagttagatttttttaggggggaaacaggaaccaaagcaaagccaatagagatcttgaaaaaaaaaaaaaaaagaaaaaaccaccgtggtattctaggaagaaaaaagcatttttcgaatgaaaactttttattatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactccagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccagacctaaaccagtgaattaagagtatggggaagaggagccctcatacagttctgttaaatggtcctttaatattcttcttcagagtgacgggtaccccttgcctatacattttcaaaactacactgaaaatttcaaaacatttctatcagaacacagtcttattctcagctgatctgcaatttccacctggatctgttaaatggcagcttagctatgaaatatcatgttctgcccaatcacctaccctgcctcatatgatcagccggtatatttatgtggacacatgcagccacacttgtttttaacatttgagaatgacagcgtattggcagttcatataagctatcaaatattacatgtcaactcagaaaacatccctaggaagtattatgggaaccccctgtatcacttgagattcttggatccatatttgctgttaacaaaataaattaatagtcaacaactgattaaagcatttccctgctaccatgattgccttgacaaattctgcagtgctggagtattttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaatattgcaggcagagctggggattccgtggccagagcatatttggtgaaccgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtatattattctgcaattgctgagtaattgatgatccttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggccaggctggtctcaagctcctgacctcaggtgatccacctgcctcagtctcccaaagtgctgggattacaggcatgagccatcatgcccagcccccttgtcctcttcttataaggctactaatcccctcatgaggggacccatcctcaagacttcatctaaacctaacaacctctccagggtcccacacccagataccatcccactgatggtcagggctttgacatatgaatgaggggtagagggacacaaacattcagtccctaacacttggtcaagttacttaagcttggtaagcctctctcttcttactgagtcatgaggataataagatatacctgttagggttcttttgaggaataaatggaatttttaaagaattgtgccagacatgtaataattacttgataaactatagctattataacaccatcaaagctgtggttcttaccctcatcattgtttaccctctcacacagtaagatctttctgaaaaggatcaagtctcattctcttttgaaccccaaagtccccagccaccacagagaccaaatacagtaggtaccaatgcatggcaatgcataggaactaggtgtcctaacttggcactgtatctgccaattttttaaaagacaagatgacatcccaaagattggggcatatttaggataatgccccattctgtgagggtggacattatagaggacatcagcagccagccacaggccatctcttggtgccattgggttttgagaccctcagggtgacaccgatttaacatgacaggtcttatgttcttgggtaatgtcaaacaacttcttgaaaatatttgttaaaaaaaacccaaaaacagaaacatatctgactgggcatggtggctcctgcctgtaatcctgacactttgggaggccgaggtggacggatcacctgaggtcaggagttcgagaccagcctggccaacatggcgaaactccttctctactaaaaataaaaaaaaaaaattgccaggcctaggcgcaggcacctgtaatcccagctgctcgggaggctgacgcgcgagaatcacttgaacccaggaggcgaaggttgcagtgagccaagatagtgccactgcactgcagcctgggtgacagaatgagactccatcctcccaccccctaaaaaaaaaatctatccaaaggccttgactaatgcagaatcagcactaatttacaagccccataaactaaagaccccatgtttgtgttataagttttcaaactttttaaatattttcccctgtcttattttctatcatttcacatcttcttaaacacatatatttttaaaagaggttttgactcactggtgaatttgtcttaaaatggaaaaataaaatcaaatataagaattttgttatgaatctttggggaaacacaattagggaatctaccttaataggtaaacccatgtaatttcttatttccgtctagttataggaaaatactgagatacttgtgagatgttttctttttttttttttccaacttgtatacacgttgttctataagtggttgattgtttttcaggaaaaaaaaattcagcatctcaaatgtacctttaatattgcttctgatttttgttgttttgctatcatagcgttacctacctcacagagatgttttaggtcataagtatttttcatttaattttttttccccttaatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcaggaatgtgtgtgcgtgtgtgtgtgcatgtgtgagctcctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttagcaagcatgtagctgcttgcctgagcaagccattaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttagcaatactgcccaggcacatgggctgtggctcaagttttcagtgcaggacagtgtgtcattgcaggagaagacagaacccggccagatcctcccgctgccggcaagcggagtcagttactgggaagccataataattctttcttctagagaattttggcaaaaatgtgcctccatcttacatcaacaatttttcatctttctggaatttttatttccccttcccctcttgttcctttttatcctcctggtgaagtatctccttttccctaaaaaactggaaaaaatgcacttttctatattaattcaaatcatattcaaaaaatactatatgttaaaaaatacgatgtttctgtaatccttacatcccctaataaaaccactgtgtgatgaaactaccaagaagcctctcttgaaaaaaaaaaaattaagtgaacctctactttagaatgttggcttttcatatatgtacaaaacaaaagaggttgcagtgatggcgtggataaaggcacctgtgtacttttccaacctatccaatttcaagatgtatcctttgtggattacattggttcttttctatggaatcatgcaccttagacctgggagaaaccagcgtgacatccagggtcaaggttttccaatcaggtattttgggggaaaaagttctgccttcatgtaacaactaatgtgacatggcagtgtataagacattacagccaaggccttctggttgaagttggggaactgtgggcgttgtccccactagtcctgtcatctgcccttgcaaaaccacccttgggctctctcgcgtgcggtctgtgcaccagctacctttgtgctccccacattcttccacctggcctggaagctgaccatagttggctctcttgccctttcttcttctggttggatttagcaatttaattttcaggcttgctccctgcagggtgtcacttcaccaccttcctctgtagaaggtttcgtccaggccgggcacagtggctcacgcctgtaatcccaacacttcgggaggccgaggtgggcagattgtctgaggtcaggagtttgaaaccagcctggccaacatagtgaaaacccatctctactaaaaatacaaaaattaaccaggcatggtggcacacacctgtaatcccagctacttgggaggttgagacaggagatttccttaagcctcggagatggaggttgcagtgagccaagattgtgccactgcactccagcctggctgagagaatgaaactctgtctcgagaaaaaaaaaaaaaaagaaggtttcatacattttagctgacaagggcaggagctgttcctgctgttactaactggagtacattgcatgaaaccttgctgtttccttaaaccctgcaccgacctttacaaacagtgcctttactaaacactttttacgttacccgttttgagtgtaccatctgcctcttgccaggaccctgaccaagaatttgaaatctcagaccatgatgacctccttgcccaatgcgtaagctgtcctccaaaacacacatttatgggggcagagggagtctctctggaaggaaacttcgtctgagccatggctccttttgcttcccctgggttttaatccttccttcccttcctgttcttttaaggaaatctgaaaaggagcaaaagagctttagaactgcaatgcatctgtctgaggccaaggacagttgtacgcagacctctctgccagtgtttcagtgaccctcctcttgctgcttggctgcctatgagtccatgctgacatctggctctgtctgcccaaatataaacttgagagtgacttccaagatatatacagggctcagaggttctctccccaacccattcactggccctgctctctctcgatgttcccaagtctcctgggtgaccttgtgtgtccttcctgggatattgctcaatcaccctagaactgtaaggccaagtggtcatagccagaacatggcagaaacattcctgcttctattctgcttttctagcatggaatcccctctgccttaatgtgaataaatactccccaaaatgaaggcagaatccagtatctgttgtttaaactaaatccctaactggaccccctctgataaaccctctgataaagaattgatgtaaaatttgggacgctggataggaccaggaagccagagaaagagggcacccttttcttttctagcatttgagttcccaaagaagtaaaactctgtgaatgttcacttcattttttcctgatatatcgaggactccagatgtaacctcattgatagtcttggtgtgttcttcagtatttgtgcttttaatagatattgcaagtgtgtttaatgtgaaaatagaaatggagggcttttaaaagagcttactcaaaatcctgccaattactgaaatctaccagacaagaaggagccactctttttttttttttttttttttttttttttgatacaatgaggggaaatgtttcttccacaaaagcctggccgtttgtctttaaaaattttcatcttttgggtactgagttgtaatagtaaatacagatgtagctgtgtcacattaaaagcacaaccaaattgtagtacaatgttcaggacacttttatgtcactttaaaatgtagagtatcatctaaaaatgagcaattgctgtgaagaaactggggttggctctgattttgtggctcagttttttttggtttcttgagaagatcatctttaagtcaaaagttatgcaatgccaagtactcatctgtgtaatctatttcagtttccaaaatttttcatcacctggttacaaacatctgaaggcaagaaatagccaagattccattgcaagtcccagagtaagttattattagacagaaacaaacaagtaaataccttgggcctgagctattgcccaaaccagtcctgacttggcttgggttctgaccaactgtttttgatcccacagtctgaagtacgtttgtggaaatacaaaggtcaaaccttcccctaaccctctgtaatccctggtggagctaaggaatgaaaagttgcttaaacattttcctgttgccagtttttcttaaacattagtgctattcttttttttttttttttttttttttttttttccttcttcaaccctgactctgattcacaaagaatagggaagcttagccaactgcagtttcaaagtattgcttcttaagcctgggccaagtgtgtagacttgatagaattctgattaatgcatcttattacattaattttagaagaaaccagaaggcatttctcctattcctagtgcaggccagcctgccagaagcatttgcctccttaaagagctaatatcttcagctaccaacaatcataaaactgaaagatctatcggaagagttggcttctctggatgtgcataaggcacactgcaaaatagatgtacagcttggctgaactttgcttcaaatttgccaatcaaaattcacgaacccatgccaagttggctacaaaacctctcgcttggagccagcactaattatgtcaacaagtagttcaagtttagcccctgttaagtcctgtactcctgggtattggggatgagtctttgtgtggtggcaaacgggccctgtcttcgcttggcttcctcctaaaattcccaggacctcttcgggtcccagccctttctgttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatgcagtccagcaagggtctcagtcaaccttatgaagctaaaagggcccatcagagctaatccctattgggctaatgtggccaggcttttataaacctgccttgactcgtgattgggtgggctgccccaggaaggatgtgcccttgcagaaggtagtctctgtgttcaggtactccctggaaaggctaatggctgaaggctacaggttaccctggaagggagacctgggctgcacatcagagcccatctactttccagtgtggacaagttccagctcctgccccagccctgccacaccatcaccctctccagcacacacagcccttctctgttgattagggttggttgagctgttctaccaccttcattgactcaggccttgaagtgcagtagaaagccctaggacaaggcaggcccagttttgaggctgggtgcagaggctcatgcctgtaatcccagcacttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctggtaggtcgaggctgcagtgaactaagatgccacaggactatagcctgggcagttttgagtgctgcctctaccatgtaactagcttgccagtcaagtcattaactattcggggccttagtttcgtcttttctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcaggcccatagtactcaggtgttcattccacagaaaagcgttcactcttctgcactctttctcagtcagttggccactgctgttcagttcacttcttttggatcttctcagccccatcaggttcccaggtgaaatgagccccggctcagcaggccagttgtcttcagtgacccccagtgaggcagcaggtgggacttgattctggaggcaagactcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcagttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacataagagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttggtgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcattggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccggtggctaataaagtagatgagtttcaggattgcaaaatattgtgatcctggcctttgtccattgtgtaatcttcacagtgaccagagtgtttgcagttcctaggaagttcacccattcccaacagtgtcccagggtcaagctcagatgacctgtggtatttttatacccatatatgtgtcaatgtttataacttttaaagttgttttcaggaagcactgaggcatgtggtcgttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactctttagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaacaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccagcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggtaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactacaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttctgcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacatgattgagttacctcgccctgggtccctcccacaacatgtgggaattctgggagatataattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagccataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatataagagaggcacaatctgctttccttttgatggtgtgcagcagcatgatggccgcgcgaatttccaagaagaggatgttggtcgctgatggcatcttcaaagccgaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctaggagactctgaggacagagggtcaaatccatgagtttgtggatggcctgatgatccccagcggagaccacgttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggtgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttctctgtaagtggaagtggtattcattgatcacacactacatgccggacaccaagctattacattttttgaatatgtttcttctttgcctcttgaggactaaccagccgggtttagattatttcctccccgtgtcgctttcctgcccccacatgttaaagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaaaccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctattggacacatgtcctaataataaacgtgatataatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcctccccaacctaaggaaactgagacccagaggttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggacaggatgaaggaaagaagcagtgttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagacaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggccccctgggagtcagagcgttccctccctccttgccactgtaaatgactatttctgtcgtttgcagagtgtccttttctttctcctacagccccatccttaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttgctgagcatctatctgtagcactgcatgtcaagccaagctagagtacagtctcttaggagacacaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaacagttatccattgctgcctaacaaattaccccaaaatgtaagcacttagaatctcattgtctttgtgggtcaggaattagggagtggcttagctgggtgattctagctcagggtcttttctgaagttgccagcaagctgttggctggggctgcagtctcagaatccttgactgaaggggaggtttcgtgtccaaggggctcactgatgtggcttttagcaggaggcctcagttcttcaccatgggggcctctctgtacagcttcaggagcagcctcacaatatgtcatctggtctcccacagagtgatgatctcagagagagtgtgaggaagatgtggcatggccttttaagccccattcttagacatcatgcactgtcaagcaccgtaactttagctacattctattgattagaagaatactagtaaagaccatagttaggagaggggaacctggctccaccattgcaagggaggtctatcaaagaacttgtgggcatattctaagaccaccacactctgccactccacacaccctgactctcctaacacctgctcgcttcactggttcggctattggcagtggcatggagtgtgggaaaatgcgtccctctctccttcctggattagaaaagtcatcatcctgctagtgtgaatccatgtcctgtggtggccctctcaggagggattgtgattaaagaatggacaacccaagggaatcatgtgtcatggtggagcatacaggccagcaggtgagttggggaggcgcctttacagaggaaaccttgagcttcttctgtgatattcattacagaacttcccccaaagacagatgacatccatttataattatttcaccagtgacttttgagctcatgcagttctatttatttttctctctgaaagtaagaaactttctttaaaggatttctgccatttggacaatgtgctatgtccccattggtgttaatcagttggtgggatatagaaaagcaaagtggccaggctcagccttttctctcgatctttttttttttttttttcctttcttaagaaagggtcttgctcttttgcccaggctgcagtgcagtggtacaatcagagatcactgcagcctccaactcctaggctcaagcgatcctccagcctctgcctgccaagtatctgggactacaagcatgcactcctgtgcttggttaattttgactatttttttgtagagatggggcttgcttgcttttttctccagtctggtcttgaactcctggcttcaagcagtcctctcacctcattctctcaaagcactgggatgacaagctctttctttataccagtcctcaacttgcactctttcctgcatacagcttgtttctctaatgtggctgttctcatgtttacttaatggcccagccatctcctcctcctcctcctcctcctcctcctgctttctattctccttcctcatcattgtcctcttctgcgagttcagaaaattgggttacaatacctacaacgtgcagtgaggacactcttttatcataaccccagtaggcttatggtgcttgtatctgatttttcatagtctttcgcttgttaatttactgcacatatgttcctttctcttgtgcattactgatgtgtttaagaatcttgaatatctatatggtgcttagagatttcacagcagttgattgaatgctgttacctcagcatcctctgtgaaactgggtatgactacacccattttgctgatgaggaaactgaggcataagaggatccgataaattacccagagtcacacagctcacaagcaagtgcaggcttccagccaaggtttgctggctcatgcgtttcatgccttctctatggtaccatacaggcactttgtctcccagtggaatataagttctttgaggccaaggactgtgtcttattctgtgttgcatccctttggcttcagcctcattgtcttgagtttattaagcatttggaacatttcagctgaatgagtgaatgagtgaatgagtgaagccatcagtcaaatcagaacactgctcacacatgcatcccaagtccagctgtcgaacgtctggaactgagcagtatggagcctgttaagaccagtgatgctgtggcctgaataacaacaggataggaacattcccttcttctcataaatcttgtaaatttgcattgtttgtgccgaacagggcccgtgtgttctgatagcaaacatggagaggcccaaaaggctgatctgggaccatgtccccattgaacactgctctgtgctgagtctgcagaatatttaaataaggggttaatttataaagtgagctacgggaaagtttccaggattgtcgtgcgtgtgtctcataaatcggcacaaattgaatctaggtttctaggtttctgtgcccctcagctcctaagtaaaccaaaatttattgagaggtgtataggttgccatccaaagaaacatagtaagtgagaaaagtgtatcctcaggaggtctgtaaacaaggtctgaaggctggcagaaaggaccagggtctgcaatgtagaatccccattgccgatgatcagaaagtacagcgtagtttgttgcagatgaagacagggttccaggaattcttgatctttcttgaacattccactgacttcttaacagaataaagattttgtatattgcagagataatttatagatacaggtacaaaggggatacagacaaagagaaaggctaacttcaggatgttgcgtatgtcaaatcattacattagtttacccagaaccaaaaaaattatgcaatatataaatatgaagctttagtttttcatgattgttcgtaatgacattattatgataatgactgtttgtaataatcatgcgtaccaccttagtctgagcaatcatattagcagttcgtaattattgaagggctgtcaggaaccagacactgtgctgagtgttctacaaactgtatttccagtcttcttttttgttcaatttccactcaaatttttaaaggggtttggagggcgttagtgtgcccattttacagaggtggaggaggaagctccaaaaatgaagcccaaggatcttaaggtaatatatgggcttgaatccagtgtatcttgctccgaaagccttgcttttgtcattatccaacattagctgtctttattatagtggccttcttaccacctacaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggggaaatattccttcaatgttacaagcgcccatgagcatgttagtagagcagttgtgtgttgaagaaagagaaggtggagtgatactgaataccccgtaaaatcacacaatcagcacttaagaatgttcacacagttgttcacaaacatattgatatcagaccttatagcagtcctattggctagatcagttattatgaatgtgttttatagagtaggaaacagagatgcgacgtgacttgcctaagaacacacagcagttctgaaactcaccctgtgctaatctgacctcgtgaagaaattgagcaaactaggctccagggagaaacgaaaacaacaacaacaaaaaatgtattgccaaaaaattgctagcagacatctagaaaaatgtcttcaacttcttttggtaggaaaagaggaaaaattcaaatctgaattcaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctagggagggacaactggcagggccacacaaggaggtaaaaccttatgctccatttgcaaagccagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcagacacttctgccccttgccatgtttagtaagtcatctatgttgtttgggaggaaagagaatgagcattcctcagttcctgcactgcaccaggccttgccaatacagtacctcatttaattcttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcccctgtggtttggattcctaatcacgggactgagatgaaacagaatctcttagcatagggggccaagcagtagatgggcttttgcgaagaagttttttcttttttcagagtcagaggttggcagcaaaatatgagagatggaaggtcaagtgcagcagaagagagaaacagggagagtggaggttgttctctagaacatagaagccgcttcttcatcccacacaatggaaaccagagcccagattatattaacgagaagttccagaattgcagatggccctttgctgcttagggaggggggagaagaagaaggagaaaaagaagaaaaagaaaaagagcaggtggaaacttaaaaaaatgtttagctgcatgtagatggcttttattataactgctaggctgaaccagaagacttgagctatgtaaaaatgtcacttgctcttatcacggttcatagagattacctttcaacgcgagtttcattttcatttcttccaacacttagagaagtgaacgaggcagtgactcctttattccctaaccctcacccagcaacttgctttttcctctgtgttttgtgtcattctgtgtgatattgcatcaaggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatccaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcagagaaagcttgaatgagtaaatttactttgtgttgttccaaaggtttctccaaaggtctttgcacctcccaaggctattctcattttgagaaagactggcacagttagaggccaggaacccatcttggctgtgtgccttctgctttgtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggtcattcccaggaagcaaagcgagcgtcaaaaaaagacagggtagttgggccatggcgttgcagagtgacagtgaaccaggaaccagaagagctgacttcagaggaggctttaggcgctcctgcatgttgattcttagagaactaaagacacagttgcatcttaaaatgttgagacttacacgtatacacaataagaatattttctttggctgcaaatgtactataaaagagtgaaaaagccaatcccaaaagattacattggtaggattccatttacataatgttcttgaaattagaaaattataaaaatagaaaacagatggctgggcacggtggctcactcctgtaatcccagcactttgggaggccaaggcagatgggtcacctgaggtctggagttccagaccagcctgaccaatatagtgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatataaaacagcaactggaggatcctggtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctctattttgatatattttctcttcctcccttccagtctctctcttctgttcctagatataaaatggagaggttttaaaatgtaattacatctaactatcccctggcttggtaatatccaaccttttcatgtcctcagagaggtccaaaggctttgctgaaacttgttggtttggcattgattttgacaaaagacagcaacaagatcccctttctaggaacccatgtggattactatggattcagaatggatgcattttatgtacagggctgtgactttttctttccccttcctcatgctaataggtgttaatactttgcaataaatattacttatgtctatgaaatgaactgcatcccagcctgtcagcacatatttattttctcattttagtttctccaggttctcactgttatggagggtggggagggggtagaataaggttaggctggagggcatatctgatttggaaaatacatccctggtgatgttcctaccaagtcacaggcttggttggtgatgctaaattgggactgaggaatgggttaggagaaggcttgaagaacccacctcctaaaaccgtctcatcatcgtctagagatatttctccaagtgcttttgtttccagtgacctcccaaccccaggaactagcgaagccttcaggcaggtaagcgcacaaatcctgcattttctagttaaccatatattattagctagtgacttgagcaagttgcttcattttcctgatcctccattcccttttctgagccacagtttcttcgtctttgagtagagttaacaaattactgggtgtttgaaagatcaaatgagttagcacatgagaacatgctttgcacaaacaaagttgtatgcaaaataagttatcattatggcatgggagaaactgtttgtggacattgcctcccagttgaccctcagtgtgtacttgtggaataattttttaatataaaataattaccatcactaatcctaactgtgcacattcttgactctgtgacactgagcaaaatcctgaacctctctgtgccttgatttctttcacgtcttgttctagttttgaagagcgattcttgtgtgaattcagggagaggaggcatgaggcatggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtcttaaaactcagtatctactctagtagttgctccaaatgtgatgtcctcataaatcaccgagggatcttgttaaatttggattctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatatttgtggtctgtgtttcttataaattggtgatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataagaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctaaatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgcctgtttcttccaaaatctggattcagtgacatcgtgttggtagcttgaaactgaccgtggtgagaatatttacaccatggaaagtggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggcgaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacatattacttttgctaattatgtgtgtgggtagattatgttattcatgaattttatttcaggaccttggtaaggggttatacaatatttcttttgaaacgagggtctcgattattgggcttgagtatcctgatctaattaatgcactggacagagctggcagacgtgtgggacacccagctattctctggaagggaagggggatataagagacacactataaaggtgaatggtaatcggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcccttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggcggatggattgctggagctcaggagtttgagaacatccagggaaacatagtgtgaccccatttctacaagaagtaaaaaaaatcatctcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattcttactttttgggctggtaaagccacctaggtcagtgccatgtccaacccaatctggaaaacgattattgtggtgcctgttttgttgacttaacaaagccagtcgcccattcctatgctgctaagatgcgaatgcccagctcaggggatgagattactgtcagctttgcctaagctttgggcattagcaccctccatatgcaacaaacccacaaatgaaatgttttgactctttgacacagaatggttggaaatcacttccttggccagagcaggggtccggtgtaaaggaggaaataaaaataaaaaagcataaatgaatgaggaagtgagcaaatcacactcatcgaggagcaaaataattcattccctctccgtggctcagcatggatgcaaataatgtatcattaagtaagtccccaaaacaaagacagccagcataactgttgcatcaaatatttagccagagccaaaagcaatttattatgttttttaaaataagtttgatttactaaccttcagcacaatccctatttttagaggttggctcatatttttaatttgttttctctgaagcgctgcatccttggtagcgtttcagctgtccactcggttcctaatggcagagcaacaccgaaaagcgtaattacatttcctaattatgtgtaattaggcaaaacccagatgatgtattcaacatgctctgagaatagccaggggttaaagactgctggaatttggtaacatttttataaataagctggtgcgttatttaacgtggaggtctaaggtgacgctgggtgccttgtagaccgatactgtggttgaaatctatcgtatttgtttatttagccaagtaaaactgtaagtgattccccacctccataccttcccctcttttggaaaccagagtttagttgtgctattcttagcccaagagaggccctctaaacccagaaccataaagttctgcttactgacagcctaagtgatatttattttttcaaagcttaatccttttgaaacatggagaaataaatacatcctcttatctaccatatgcctgggatgggaaataaattcttattttcctgccgtgtggtaccagtgggttacgatgaataatttgggcagtctcactgaagataatagggaagccttctctattaccagtgataattatgaatctcataatggaaaacatcccgagcccgaacatcaatcagggaagataaacaatgggaaatgataggtgtacaaaagggaaaatggcaacagcacatgtggagggaaagaccgcagaattctggcggggttataaatcatacagtcaaataatttccgtgcaattaatatcctcaaattaaaacatacgtttttaaagaaagattttgcagacttttaagctgggcaactgtctgccttacaagatgcgtctggaaaccccagtgccatcctccttttttagtcttgtatatttatgtatccccggccagagttggctggggcacagtctaacagtgtcaccgtgtaagctgacccagtgaccttgctctagctcaccagggactgagcatacaccaaagtggccagagctagtggttgctgactctcaggatctttggccctgacagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcctatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatgagaagttttccattccaaaccctttttaggagcggcctggaaactggagtcaactgtcaaatatgtccttatggccacaaagtatgctcatggattctcttttacaggcttagcataatattttataaaacatatttttaaagaaagtgtaattttcccccaaaagcaagggttttccaatgccatataatttactaagtgtggctttgctgcgtaatagtccataatttatagtcagcctccacaaggcaaaaaataactccaagctatgattaagtaagtaatggacaaggtaactaatatttccggaagaatggccttccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgcctaattgtgccaccagtttttcccataaaataattcatttggaaggggtggcctaatccagtctgaaccaattctaagatggtagcgtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagcttcccctaatactaacatgatacatttttcagcactgagaagttaaccttgttatgatgctattaactacactcagactataactgaccaacagactttatttggatttgacggtgtgtcctcttccttcttttacaaccagataccacctggcatttattatcatatctctccagtcccctctggtctgggacagtttctcatgcattattttttttaatggccttgaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattgggggaggtactttgggactacttctctaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggctttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgtttctttgtttttttctttttgtggagagcagggtcttgctatgttgcccagctcagtctcaaagtcctgggctcaagcgattctcccgcctcagcttccctaagtgttgggattacagacttgagccactgcatctagccacaactgagttcattattctgagctttctttgggatgttatttaactctcagtttcttcttctataagatggaaataataacaactaaaggctaggatttggggaaggtatggtaaattgtaaaaatggtagcttgtttaaaaaaaaaaagaagaagaaaaaggaaaacagtatttccctcaccgcatcaacacctgtcctgtatgactggcattgcccagtggaatcttagcagcagaggcatgacaagcggtcagatactgggactttctgtttcgttgcttacaaccctgtgaccactgcacgaacaaccctgagctgacctgctggagcatggtggccacataaagggagagtggttgccccagctgatagcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatgtggtgttgcctaagggtacggggaacctggcctggtgttgggaggaaacagggtgcagagtgggaagggcaggagtatctaagtggccaaatttagcctaattaacagatttgcctagggctgaccctgaagcagaaagcaaagcctagatcagtctgctctcctcctaccaacagggtaatgatgaggttgaaccaccagttctcaatgccatacatgagattcccaaaatagacgggagttacacagagacctttttttttttaacctcctctgagattttttttaacctcctctgagattctgtatttccttaatgagccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgttctgcccaaacatacaagagtcaatgtaagtctctgggagcactcacctttgggcgtgttgctacagagtcactcattcctagaaattgcgaagtcacgaagttgtcaaaaaacacaacgacaggccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaagaaagaaaacaaccacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctgtctctacttaaaatacaaaattagccgggtgtgatggcacaggcctgtaatcccagctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaagagaaaacaataaaaaaatagagaaaataataataactagccaatgtgtcatcactccagacaacagccatggtcagtatttggttaacccattcagattttcccctatgaatgagttttttcgcctccataatattagttataatacattgatactacatcccgagtgtttcacttaacattatagcacaagtgtcttcccctgttgtaacatagtgattattaatgtcaaatatcagctagataaaagctgtcaagtgatagaaagtccttatagctcataaactcttcaataactgggaatttataccgtttatagtttttttactgctaagaataatgttgcaatgaaacgtttgtatataatgctgtttagtcccctctcccccattgtttacgattccttggagttccactgctacttcatatttaccatcaccatccttgttcaccattgttgaagctttatgtaatgacgagcctcatccaggacctacttgtgtctctgtgccagtcactgcctgtgaaccaggggtgtgtggactcagggctcaattcaaaaaagaacccaatcttattgggacaaacagatattgatacccctggtctttgagccccactgtcttttcacactaatgagttcttagtgtctatttttggtgattgagtagaacttggtgccatattggctcaacatggaagatttctgtgatcacttattgatcagtcatgaataaggaatcgggatggcagtcgggagtgtgccaacacctctctcagtattctgggtctctctgcatgtagtgtttcttttgcagctcctagagataaattttttaatgtattacatgtgagttatttgaaagagggtaggtgtggacagtgaggccaggtgacttaatttccagaagcttgcctgtggtatttaccttgatgagttcattaacaatatggctttcaccctcaaacttgctcattcagaaattagactttgtgagcccactaagagtaggtctttctgttaggtacagactctacaataaccaaattcacagaaactgatgtgtaaacccagggtcataaacaataattttcaacaggagctataattatcacatagtttgaaatgctcttgttaatctgagtaggaagagaggatgagaattttcttataggtggaactacagaaaaagagtttacttataggcagaagtacgggtactgagccaagtgacattgtaagttatttaattggcaaatgattaaagcaaaggtcattgcctatatgactcaaatgcttggttgcctcagaagataatgagcctgatactttcacagtgaagctgtattgcacgtttgtgtttgtttattttccatctttcccactagacggtgagggactttatctgtctcattcaccactttgtccaacctaggacagtgtccgacacatagagatgctcaataaatcttggctgagtcaatacgtttcaaaatacaaggtgactccaaatataaaacaattttttattttcaaatgaagtggacctcccctaaattttgtgcccagtttataaactttaggggctgtagatgaactgttcaaaagttttattgtaggatttcacttgctaatgcattttcacaagtaatgtatttattttaaaagactggagtttttatatatccttacatttatgaaataatttcatttaaacccttcatgcccatcttcagcatcattgctaaagcctcttggtttctgtacctgtaatcttcattcattcctcagctgtttgaaacacagcacttttgggatccttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtctagagaaagggagatgagcttctgtggtagccagaggtcaagatggcctctagtgaccctcacttcctgggttttacattgcagtatatttctcttctactctgaacaggattgtcctgtgtaacctacagggggaagtgatagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgctcctgaattcttgacccagaaaatctatgtgagggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaactgcaatttatatcttgcccccacccagtgttgatttgcccggggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccaggctggagtgcagtggcgtgatctcggctcactgcaacctctgtctcctgggttcaagcaattcttctgcctcagcctgctgggattacaggcgcatgccacgaagcccgactgatttttgtatttttagtagagacagggttttgccacgttaaccaggctggtattgttttcattattgtggttatcattatttatttagttattgatcatcaaaatccagaaatccagtttcagcaaacattccataacccggtgtgctaaaaccccctcactgctctccattactcatgaatcttcttgaccatgaggcagaatctttgtattttcttctcatcaaggattttatctgaaaaacctgtagtacttcgcctttccctgggtggagaagaggggcggataaatacttctaaagtaatgtagtatgcactctcctgcgtggtgggggtgtagtgggcttcctgttatgaaacccagcttgtaagcatgtatctacatcccagggaggttttcactgaaccaagagatgccataagcagtccttgttgtaataatttaatagcgaagccctcagcaatagatcttcaggtaaaatggatgctgactgtctatctgtcatatgaagattcagacattgatgtaatttaaaatacttgtagtatcatggatacaaacatatgcctttttatttctgaaggaatttccagaatgttcgattaaaaaatgaacagaggaaatgaaaaataaaattgtctgttgtaccaccacctgaagataaccactactatcattttgctatatttctttctatatttttctcagcatttacacgattgtttttacatagtagtgactttgccgaacagttatttcatttcgcatcttgatattttttctcaattaaaataataattgtgaacattgttctttctactctaactactcaggttgcttataatgagcttgtattataataaaacttcattttattttagataaaatgaaaagatgttactatgcaggtaactttatttattatttgcatgcagtttatcaaatagaattccttggttcagcaaaatgaaacctttaagtcttttagcaccaaatgtttgaaattatcatgaaacacattctaatttggcagtgagttcaggagatgaagactgtcctttagttaacatcaatagctttctaaaatatgtagccagttaatattttacttttgcctatgcatccctcaaattgtaacacccctggaacataaaaattcctctattgagattaacacctaacgatacctgtatttgctaatttgtttcttttttttctttgaagcagcatgttgctttgtcacccagactggagtgcagtggcgcgatctcagctgactgcaacctccgcctcccgggttcaagtgattctcctgcctcagcctcccaagtagttgggattacaggcacatgccaccactcccggctactttttgtatttttagtaaagatggggtttcaccacttttggccaggctggtgttgaacccccgacctcaggtgatctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattattacctttgttcttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccaaagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggatgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggctcacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacccctgtaatagcagctactcaggagtctgaggcaggagaatcccttgaacccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgccaccatcatagagtatacctatacaatcctagatggtataacctgccatactcctaggctaggtagagcatattgctccctggcagcaaacatgtacagcatgtttctgtcctgaatactgtaggcaattttaatacaatgctaagtatttgcatatacaaacatagaaaaggtacagttaaaatatggtattacaatcttctgggatcaccattgcatatgtggttcattgttgatcaaaatgtcattatgcagtgtgtgacagtgcttaaataatttatctcacatatgcaaagagttttggctaagggaaaagaaaaatgtgaacctcctaatagaaaaatgggcaaagataatgaacaagaaattcactgaaaagaattggcaaacatgaaaaaattctcaactttatttttaatcataaaaatggaaattgaacaatgagatactgtttttcaccatgacattggcaaaagttaagaaggcagataacttccatgttggtgagcatgtaagtataaaaaggtataaaaaagaagagttgtcctgaatctggtctggaatagaacctttttttccatgatgcatgatgtaattcacagcctcattcctgataaattgcttaagcaattttctgataaactttaatgcgattaagacttgttctgagaaatcagtcacccatctacccaagctgactgtcggtcaagagtctagtgaccttaaaccaaatgttattttccttttgtatctagcctaacattgactatcttgtcatttcattttcctataaaatgcctccaccaaggctgaatctttgaattgatcactagaggccttttccctagtagtaacattataataaaactttgactcatgctcataactcgattttccaaaaagttttcctttacaggagaaaagaacagctgctgtttataggagcatacattgtttttggttattttgaagaacaagttggcatttttgaccgaaattaaacacatgccttttgatcaagcaattccattctgtaccagaaaatacagaaatatttgaatgaatgtgccaggacacccaattagaagaatgaatgcttttttagcattattttgtgtgcatacatatttatttagttatttgacctattacattctaaattgatattaataaagaggtatttgagttacagtttttccaaagttttaaatactctatagcaaaaaaaggaaaaatgaaagaaattaaaaagatacctctatatacatacattgtgtgtttgtgtgtgtgtgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtgtatgtatatatatgtgtgtgtatgtatatatatgtatgtatctgtatatgtataatggctgtacatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtcttacttcatcacccattctgtagtgcagggcacaatcacagctcactgcagcctcaaacttctaggcttaagtgattctcccatctcagcctcctcagttgctgggaccactggcatgtgtcaccacatctggctaattttttgaacttttttgtagttggggtctcaccatgttgcccaggctggtcttgaactcctgggctcaagttaccctcccacctcagcctcccaaagtgctgggattacaggtgtgagccaccacggctggccaatatctactagttttgaaattaaaaaaaaaaaaaaaaaaaaatatatatatatatatatatatatatatatgaaaaaaaggacaaacgatttcagttgcacaactataatcgatgaagtggctccttgatgttctcggggcaatctgagacactggggagaaccctccacctttgcagagaagcaggatgaaggggcctaaaatgagttcaactgatttcaactttgtttcccagcataaagcttgggctgagctgcctgaaagggaagtggagaaggcaggaatggaattgatttttcccccctgctgaattccccttctccctactcccttcctgcaatttctaataaattagaagagctctgccttccagaaaagagcagaggtaccttgcagtacttttgggaatcttaccaggaagaactgggtctactattgcaaaggaaaagctttttttacagtgttaaaaattaattaaaaatggaatgtgttatagctcgatttttatcattagcacccattccagagggcatgttgctgttagtaaaacttcagatttttcctgtcattatggatttggttttagggaaaataccttcatgttcagcattttatgtgtcagtccctaaaactcatgatcttctgtgattctcttggtttaagagcagggcgagtaatgtactcaaaaatttctccatagccttctgggttagaggatataacagctggcaaacagaacactaatagctattgatggttattttcaaaggatggacatcgatagttaagttttaaggaagaaaatgaagaggaaatttaatgtgatttaacagtgatttttttttaaagacattatttgcatctcctattttcacttacttataaacaggtggtttccaagtagacatattttttgcttgcttgaatgagaaagcataatgaactttgtgatttggtgacatatccagatagctatagcaaatagctataatgccttagataaatagcattttcacgagtaaactttttagttctcaaaagaaaaattgtaacaattttctagccgcatattagcattatgcacaaacacataaacttttggctggaattgtggaatatgaagtagctcccatccttattccatcgcccatatgctaaaatgtagattgtattagttgagaaattttaccaaatatttacttatactgtgctattatttatactatttgtcaattccactatagtagatgcttaataaatatttgtgaatcagtaaatggatggatgaatgaatagtggcctacttctgtgaaggtaattgaagaattcccacacttggccccctttggatataacgtctgttctgagcacctcccattcactatcttgatgcctcacataagacctagtatatagtaggcagtcaatgaagatcacaatgaattggctagactttgatttattcatttatgcaaattgcctgacattcaaagaaaaaagaaggaaaaaatggacctcttatcatgtgccagacattgttctaagagggaaagatactgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagaaagggtctcactctgtcacccaggctagagtgcagtggcctcaacctcccaggcccaggtgatcctcccacttcagccccctgagtagctgggactacaggcgcatgccgtaactcgcaactaattttttgtatttttttttgtagagatggggttttgccatgtttcctaggcttgtctcgaactcctgggctcaagcaatgtgcttgccttggcctcccaaagtgttgggattataggtgtgagccactgtgcacagcctcagaggtcctgtctgcctgcctgcctttcctccctctctctctttcttcctctctttgcttctttccttttttccttctctgttgaaggcctgaataaaataaaagactgagtaagaaagaattgactccctctgcctgacttcaagctgggacgtaagtcttctcccagtccatgcatccatccatccacctatccacctattaacttattcacactggctttaaaattatttttggctccagcttattattttaaaatgtaaaatgatttacagaagttgacagagagtataattaaatcccatgagtctaccatccagattcagtaattattacatgtggccattgttgttttatctctctccacccacttcccccatgcctgaaaatttaccaaagtaaacgcaagacattatatattgttattcatagacattttgagtaactaaaagtaaggtctctttaaaaaatgataattacagtatcatcatcacacccaaaaacatcacaaattatttaatatcatgaagtgaaggcccatttttccaatcattctctaaatattataaatgtcatctttcattagtttgtttgaattccaggtaaaaacctttaactcatttccttcttttgatttttcaaaagttggttgaatagtttctgtcttaaaaagtccagaaattgttgaaataggtaaagcacaaaagaaattaaatacaccatgtttccaggcctctaatgttttctattcaaggttgtaatatccagtgcaaggctaaaattgctttctggtgataaacatttgagaaagatttggttgttggtgatactgatggttgtagtaggagtctctggagaaattgaactaatactatatgtgtgtgtgtatctatgtatagatatagatacacacatgtatctattatatatatagagagagatatatgcatatctatacacacctacgggtgtgtctgtatctatacacacacctatgggtgtgtctatctatatctatacacacctatgggtgtgtctgtctgtatctatacacaccgatgggtgtgtctgtctgtatctttacacacctatgggtgtgtctgtctgtatctatacacacctatgggtgtgtctgtctgtacctatacacacctatgggtgtgtgtttctgtatctatacacacctatgggtgtgtctttctatatctatacattatatgtactaaataatatatataaacactatagtatatagagtatacatatacacactatagtgtatgtactatacactgtgtactaatacagtgtataatgtatatatatagtattcaatatagatctataaacacacaagtgcatacacacacacatttttctgtatatatgtataaagatatatataaagatttttaaataaggaattgactcatgaaattacagagactgagacatcgaaacccaggacaaccaatggtacagttcatgtctgagtctgagcagctgagaagcaggagataaaaaggcatcagttccattccatatccaagtctgagtccaagggcaggagaagctgatgtctcagcttgaagtcaggcatagagaggcaattctttctcactcagccttttattttattcaggccttcaacagattgtatgaagccacccacactgggaagggcagtctgctttactcatagtactaatcgaaacgttaatgtcctccagaaacgccttcatggacacactagagataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcagcctcccaagtaggtgggattacaggcgccaccaccaagcctggctaatttttgtatttttaatagagatggggtttcaccatgttggccagactggtctcaaactcctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaccaatggaccactggtccctgctgatttagtgtcacagctcaaaaccatcagtagtcctcgtgatctttcggcattgtggctccctttgtgagaagggcctaagagtgaatctcccaaccataagctgtattcaggcaggcacgaagtctcttatttactcagtgtttctggagcccagcatagtgcctcgcacacagcaagtgctcagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctattgtacaatatatggtcttttgtgattggcctcctccacttagcgtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagacagaatcttgctctgttgcccaggctggagtgcagtggtgcagtcatggttcactgcagcctcgatctcctggggctcaagccatcctcccacctcagcctcctgagtagatgggaccacaggcgcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttggtaattaaaaacagagctgtgtggctatttttctccaactcctttttttttttttttttttttttttttgagacagtctcactctattgcccaggctggagtgcagtggtgtgaactcggctcactgcaacatccacctcccgggttcaagcgattctcctgcttcagccccccgagtagctgggaccacaggcgtgcaccaccacacctggctaatttttgtatttttagtagagttggggttttaccatgttggccaggctggtcttgaactcctgacctcaagtgatccacccatcttggcctcccaaagtgctgggattacaggcgtgagccaccgcgcctggctttcaaattccattttttaaagttaatgctttaatatgttaaacacccttattaacatattacatatgttaatatgtaaaataaactccgtacattttaaagtgctaaaggttgtatgtttgtgcgatggatatgtttaagagaatgatttaggatgcgatcagttttttttccttgacttactctcttcctttatttttttcccttcttcactttctctgttattccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctctttctcttccttgctgaggcttttgacaatttcaaatgctccctgaacctcagtttcctttgccacaaaatagcaatacaaatttataattccttagattgctgtgagaatgaattgaggcaaggtaggtaaagtgcaaggaattgtgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaagaataaacaagaattgtgtctggcctttgtgatagttactcaacaaatcatatctgtgattgttttggttttaacaataatggtttttaaaaaccgtaggtgatcacatactacgcagaaagggaagcagttacagcattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggactgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctgtttggctcctggcggtgtttttgttgccctggcttgcaacgtagcctgattgttctaagtaaatggcagagcacgcaaatcaaggacattggcaataaaccaggaatgcactgtttccagccacgggctatccagggaattggggacagtctgtaatgtatcttgagctaggaccatatccaaattactggcctttccagtttttctttaaatagtagggtcagtaggtgaccacactcagaagccaagcctgcagcatcagggctgaggagcaaactctttctttggtctgaagcttcaaatatgaacccttgccaccagctgcataaatatgatagccaaagggtttcaaatttgtgatttgtcataaacgctcctattgcaggctgggtctagtccttcttgactttgtggaaggagaaggcttgaggaagtattcacaattggagaagggcgccttctgttatgttcttagctcactaaaagtggttaatgatgagaaggggtgggtcaatgacaagaaaagtggagaagatgagacagacaaaactgcaactcatcttcatggcacactggtgagtgggggagtgcaagaagtttaggtgcaaaggaaaatggagtgaacatcttggcttggttaacagaagaaaagaataccaacgccgtctattttcatatccctttctattttatgtacatatttatcaatatactttttgttccagaaataaatgggaacttaggcacaatcttttacacatcttacctcaactggtgactcttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtgagtttcttaaagtcctacaactggtgagctgtgagctgtaaattgtggaactaatttttatactgccaatctgaggccttttctgacctcatcgctgccactgtaaaatgaattctagccccagaccatgacatgcctactagcttagctctaaccaaaaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgcttatacaaagtcttgttcatgaatgttcatagcagcatcatccatgatagccaaacgccggaaatacccaaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaaaatgttctaggacaagactgtggtgatggctgcacaactggataaatatactaactatcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaacgttggaaccaatgctgatgagccattcataggctctggctcactatatatgtctaaaattcacatgcccctaaccctcaaataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctatggtgggtggggtccaagcctccctgaagcagatctctatcctgtcaccctgctggaaatgaaacacttaggggttagaaggggatcaaggaaagtccgagagttggttgtgattatcttcagtcagaaagtgcctacttttccaagcatccagactgcaacctgtctttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcccccagatagcctcttagcagagccaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagggggaaattgctttccatctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctaggaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaaccctcactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattataggcatgagccaccatgcccggcctaatctaatcaattcctttaaatctgaaactgtccgcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacagaaagaggggggatttttccccccatggcttcgtccttattcttataacctgtatgcactgctgaacctgctgaataaccatgtcacagtggcaggagagggactgggtgaacttgagtctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggagccagttcacgcttggatgactctggagctgtggtgacaatctaaatcctaaattgaggcttactaggaaatgcactaggtgacaggctctagagaaatggctattaccaggttgctcaggctggagtgcagtagtgcaatctcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgggcccctcctttctggcccctcaacctattttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggaattataaaggaattctggttataattgcatgtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagttaaaggaaagaaatgccaggctgagagatgagacagtgaattacagtgggggataaaggggctgtggtgtcacacaggcctggcatctgtggccttgaacaagtgcattaatcactctaagcctcaatttctttgttttaaaaataattaactaaaataccttagggcacatggtaggaattcagtaaatgctcactgtctttctcatccttttgcttacctcacatttgcttgcagccagtgctcaaaaccatagacaggcagtgtccccaaccactccctgcgtttctctttctttgccttccgaagctgccatcttggtggtttttgaagcatcaacacttacttcacatgcagaggccccttttatttatttatttttaatttttttgagacagggtctcgctctcttgctcaggctggagtgtagtggtgtgatctcagctcagtgcaggcttggcctccagggctcaagcagtcctcccatgttgacctcctttgtatctgggaccacaggtatatttcaccatgcctggctaatctttgtgtttctgtaaagatgaggtcttgctatgctgcccaggctggtctggagctcctggcctcaagcagtcctcctgctttggcctcctgaagtactgagattacgggtgtaagtcaccacacccagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaactcagctgggcatgatgttgcatgcctgtcatcccagctacttgggagactgaggaggacgattgcttgaggccggaagttcaaggctgcagagagctgttattgtaccactgtactccagcctgggcaacagagagaccctgcctcaaaaagtaaataaaatagtaaaataaaacgagatatttggaaggctatgtttttttgccaggccatgtgcttagtccctgggagtatagcgaggggcaatcacaggtcaggtcctagtgtctctgaagacttcattctagtggccattgaaaatgtgtaactacccacagtaatcaagttaaagaaaggttctggctgagcacggtggctcatgcctgtaatcccagcactttgggaggccggggtgggcggatcacaaggtcaggagtttgaaaccagcctgaccaaccctgtctctactaaaattatttaaaaaaaaaatagctgggcatggtggcacacgtctgtaatcccagctactcgagtggctgaggcaggagaatcgcttgaacccaggaggtgaaggttgcagtgagctgagatggcgccgctgcactctagcatgggcgacagagcgagactctgtctcaaaaaaaaaaaaaaaagcttccatttgagccgccaggaaaggaggccctgagttggggagttgaatagagagctgcatcctgaacagacatgatcttgggtgagtgagaggctaggagcggagggaaagcagacgcagttgctaaagctgtcaagtcccgctcccttggaatgcagtcctggttctgctacctccaactgggtcgatttcaaaaaattatggacttgtctgagcctgatgtggtgcctggccagggctcactgcagcgcctggtatacaggaagaacttgatgttattcatggcaaaagatgtctggatggtctccactacagattctgatggcaagtgacttaaagacatgttggcaatgggtagtggacaaaaattgaaacaccttcaactgtgtctgtgaccagaagatttttttctttttttttttttttttttttttggctgactgtcatgacttagtaaggccatcacaggttgccagaacatctactcaactgttccaagcataacctcctacacaggccttctacataggagtatatttggccaagactcaccactagaagtgatttccactggactttcctacagcaagtggtaaatgatccctcagataggcccaagagctccccttcaagcatagagacacaaccctgtgaaaacatgcattggaaccaggaaggcctgcccccatgacttcacgttgcatacatgcctttgaggacttggcctcttaaaggaatctttcaatatcctatgcttctgagaaagttactatttcatttgcagcaggacaactcaacaagctagctcttcctgcccagcagactcggtggattctgaagagggtctcgggctgactctctacttcatgggtttgaattcaggaatgttgcaagattgcatgagattaagccgctgaaacctttctgaggaagagccagctcaaatttcagtgttggatgttcaccgcttctttagggttctaccactcccagtaaatcaagtaataggtttctgttaaaaaccccagtgtgctgatctcagtggcagccatcttgctttgtaagccttctctagctttatgatgctcccagtatataagacatttccagtgtctagtccaaattagtatttctctaattctcgagtgtctgatctgcctggctagaatgattaaaacaaaaaaatagcaaatcagtttgacagtccacttcattaagtggaggacagtgttttgattgctatttaatctgtttttccttctgtctgttcttggctatatggaattcactttgcctctcttcccgactcttcatatcccttatctcaaggtgagtatcgtcagaatcccggtacatttcaccagccaccttttatagaagcttagaaagatggaggcaaacccataaacaagacttggtttttctaagccacagtggcaatttcctagtcgattacaactgtgtctaccctttcaactggcctgtcagtgtaggctctgcatgtcctggataatcctacaattggtgacacggttattgacttacaggtttctagggcatctcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctggatatttcaactagtttacatgactttcttacctatgctaccttataatccttttataaattttgctttacgttttaacaacggaaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccgagactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccagtgtctttaatttgttaatgctttcgacttattttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgccttaaacacctcatctattatgctgtgctcaaacagatattttcatcttaacagcttggcaaacccagtggaacgctctttctagtttggggcataaaataagataacactctgaattcctacaggaaatcttgtaactctacttaaaattaaggcataaagtaggaaaatgtgtttcctctgtatagtcttattactttgcctgttaagttaactggttcctatttctgctggttcgaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcttcacagtaggacaccaaaccctctgtatgccctgcctgcctccccccctctgacccgcctgcctcccccctgtgagctttttccacctactggcctcttgttcttcttcagctgttcctcagacatgccaggtgtgttcctgtctcagacgctttgcctttgctgctccttctgcctggagtattcttccacgtagcaccatgagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtataatgtccaactcactctaccacacagcaacataggtagttttatatacattttatagctaagcccagcagcccaaaaagctaaatgacttcagcgcccacagatactcctggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgcatgctattcaggaggacagaccatggatgggaatcctgagccacaactccttagcctcatgacgttgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaagcaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagaggaagtgaagattgcatctcagtatgagacaccgtaagagcttgataaatggtggaccctctgatgttgacaacatgatgtcaaagatggtgtttgctgttgtttcaaatgtcttatttcaaattcccaattagtttcttcatgccataaggacaaaatccacatctcatactttttcaggatctgctctcacttccccaaacatgtaataccaccctggtcttcaagtccactctcaaaaaaaaaaaaaaatttggcctttggcctcgtgaccaccaaatctgatttccatccaagaggcaacattgtttgtgcttagaaggaattcctggctgggcatgatggttcacgcctgtaatcccagcgctttgggaggccgaggcaggcggatcacctaaggtcgggagttcgagaccagtctgatcaacatggagaaaccctgtctttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttacatttgtgaataagaaaactggggtctatttggtggtttatttcagagatgttggatcaaatcagacatcagaaaagacaccagtaccaaacgaagatatctttgctgtatttgcagttttctctcttattaacatgaaaacaccttacatagatggaaacatctaaaggctattttttattttattttccattacttcactctaatgctttcacccgtacctgtggaaattagactgtcacctgcttttagcatcctgttttctttcgtgtttgtaatgaagccctccgggaattatgcgattacaaaaatgagttacaaatcctcattcggtatacgaaagtatatagctgctttccttctctgtttaaatagtctacaaaacaagaaataattagtcaagcactatcggtaattaagcacataagatgaacattaaacaaactgcaatcttgcatcattttgaaggtagataggcaggtttttgcatttggaatccagccaaaatgcccatcttcattccctttgctccttatttattattggtgagggaattcacttgccgaacttgctgatgtactcttgctggcggtccatctgagagttcacataagtgtgagtgactattttttgacaacactacctttgggagaagatggtttcaaagaacttactgtatcaaatggaaagacaatgtgttttcccaacatgggagtatgtttctaagttgggatcagttcacgattcagagaaatgctctgccttcttgtctatgatatcagatcaggtcagacgtaggtataagaccctgactcctgttttccaagcacttttttttttcattatgagtctatctttcggtcccctaaagcttctggtaattttttttctttttttttttttttttgagacaaagtctcgccctgttgccaggctggagtgtggtggcaggatcacggctcactgcaacctttgcctcctgggcgcaagtgatcctcctacctcagcctcccaagggagctgggaccacaggggcacaccaccatgcctgcctaatttttgttgttgttgtattttttggtacagatgggattttgccatgttgcccaggctggtctcaaaactcctgggctcaagcgattcacgtgcctcagcctcccaaagtgctagggttacaggcatgagccactgtgcctggccctggtaaaattttgtctacatagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaatattcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacgccaaaatggttcttctgctcagttggtttctatagtgattttatggatataggcattttcttctcgaattagaagaactgacagtccaggcacggtggctcatgcctgtaatcccagcactttggtaggccgaggtaggtggatcacttgaggtcaggagtttgagataatcctggccaacatggtgaaacctcatctttactactaaaaatacaaaaattaggtgggtgtggtggcgcatgcctgtaatcccagctactctgaaggctgaggcaggataattgcttgagcccgggagacggaggttgcagcgagccgagatcacaccactacattccagcctgggtgacagagcaagagtccatttacaaaacaaaaacaaagaactgacaataaatagttttctccgttttgtgacttatttttaattattaagaataagtgtcataaagccaatactttctaacatgtgtatagtatgttatagttttcaaagtctttgacaattatacctagggagccaggacagtatttgtatcatcatttcattgttcctggaaaacaggttcagagaagttaagcgacttgcccaaaatagcacagcaatctgacagagccaggattatcttccatcctctattttattacctgtgcctcccattaaatcatcctaagctccactacagctggagaaggttctgttaacacaccatacatcttttttttttttttaattgagatggggtctcactctgtcacccaggctggcgtgcattggtgggatctcagctcactgcaccctccttctcccaggttcaagtgatcctctctcctcgcctcccgagtagcgtagctgggattacaggtatgtgctaccgtgcccagctaacttttgtatttttagtagagacaggggtttcaccttgctggccaggctggccttgtatttctgacctcaagtgatccacccgcttcagcctcttaaaattctgggattacaggcatgagccaccgcacccggttatacatcttaaatataaagtttttacaatgccaccatttaaaaaaaaaaaaaaagggcattaatgcatttagcaaagacttcctgagtgtctgcttggtcgagtgacacaaactggaacagagcatagcctgtcttccaggaaccggcaccagcgatgtcgtaggctgagggagaagccacagaactgtgagtgacatgtttctttggctgctcccgacacaaggaactgcaactaaattgaaggcttgaggacaggaagcaccttagcggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaaggactgtagtgggaaactcgtgaaatcctaaatacagtctgtcatttacttaatagtaacataccattttcataagcataccatgggctgggcatggtggcttatgcccgaaatcccagcattgcgggaggctgaggcaagctgatcacttgaggtcaggagttcgagaccagcctggcgaacatggcaaaaccccatctctactaaaaatacaaaaattacctgagtgtggtggtgcccacctgtaatcccagctactcaggaggctgaagcaggagaattgcttgaatccaggagatggaggttgcagtgagttgagatcatgctactgtactccagcctgggcaacagagcaagactctgtctcaaaaaaaaaaaagaaaaaaaaagtaatgcaataagcgtaccatggtcatgtgagatgttgacattaggggaaagacaataaacagcgtggaggaactctgtgtactctgtttgtaagtttcctgtaatactaatattctaaactaaaaagataatttaaagggaaagaaaacctctttatgatagtaacatcagttggtataaccattttggaagacttgatttacataggatcaaatataagtatatctgatcccctagaaatttcacttctggccaggcgtggtggctcatgcctgtaattccagcactttgggaggccgaggcaggcagattgcttgagcccgggagttcaagaccagctgggccaacatggtgaaaccctgtctctacaaaaatattagtcaggcatagtggcgtatgcctgtagtcctagttactcgggaggctgaagcaggaggatcacctgagcccagggaggtcaaggctacagtgagctgtgattaggtccctgcactccagcttgggtgacagagtgagaccctgtctccaaaaaaaaaaaaaaaaaaaacaaaagaccatttttaagactatgactggtcaaaatgtgctcatacatttgccaaaagacaagtacaagagtgtgtttagcagcattattcattataacacactgaatcattattcatgattactcaagacatctggtaaaccacccagatatctatcagtggtggaatggataaataagttgtaataaatccacacaagaggagactactcaccaacaagaatgaatgacttagaactaaattcaacaatgtggatttatcttacagagatgatgttgagagaaaggaggaagatacagaggaatgtatcctatgtgattatagttacaatgagttcactaaaaagcaaactattcctattagaagtcagggtagaggatggatgggagcatgaagtgtcctccgtcatgttgctaatgttctgttgcttgttcaagctactgggtgtgttcagtttatgaaaattcatttagtgacacatgtatgttttgtgaatttttttgcatgtatattttactctaacaaaaagttcatggacaaatacaaaatcatatctgacagttgttgagagaattaaaggaaataataataatataaagcacaatcaatgcattccatttattcttctgcttttcccatcaattcatgttacccagtcattaatgcataccctctgagaccccaccaagccatctagccctcagctgtgtcactgggcagttgtttcttccactgtgcagtgtttcgttcttaaccaacatggcaccccaggttcagtggtgagagtgtcactggcaacttctgaaataacatctctgttagtttgtggagtgggctaaatggccagcccttctacgagctccctcatggttgcgggggactaccaatcactctctactttttttttttttttttaataggtcttgtcatttgtaaatgcagaaggaacactgaaaaaaaaaatactcttgccttcttccatctgtattttctttactaaattatccagtcttataaatatttgaataacatttggtcagtataaaatctttcctgtcagctcagtacaagaacactttttggctcctgagaccacaacagtcagataaattaatattgatttgttagaaaatagttttcactctgtctaaacatcttattctgggctcttgaaccaaaattatgaatttaaaagcagcaaaatagttcttcacagttttcccagtgaaactaattatgggcagattgtgagaaatgtgttggatgtgatttccaacatagagttctgctaaccaaaattcagagaaactagagcctcagtctctgatttatttgagcaagttgcaatttggtagactggagaatttatgtaaatagtttttgcagtttccatagggataactcaatacattaatatctcacgaatggcagaagatgaagggggaaagttttttttttaactgatagtttgatttacctaatagaaggatcggattcttcccccttcttacttaagtctatatattaaagaacagctggcttacctgctgtataaatatgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcggattacaggcatgaaccactgcgcctgactgtacttttttttttttaaagtatacccatacccattgtacacatttggtattttttctttaaaaaaaaaaagcatttactttttgcctcatgaatctctgagtacattttgtgcattctgtattctactttatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattacaaagaaaaacatatatatatatatatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcgtattgtcagtctcaaaccttttctgaaattggaagtgatgaagtgacagtctggctatatgtgtgtgtgtgtggtgtgtgtgtgtgtgtgtgtgtgtgtgtgtgtgtgtgtgtgtgtgtgtgtgtgtgtgtatacctagtctagggctaggtttgggaactattttctcccgtaagttaaactgaactagactgtatgtcaaaaaagagtctcaatgtcaacttaatccattgtcatgactgtaaaatgctatttcattataccagcaattcccctgtggatttctcctgactctctatgcagcccaactctattttaatctgttgtagcttttctttcccctctctcccaactccccacgttttggaattattcagtgcattcgcttccaaggcacctgtttgatatttacacaaattatgaaagtaaggtgggaaggcaatgaaggcaacaaagtatataaaacacacacacacacacacacacacacacacacacacacacacacacacacaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaaagatagtggttttccagatgtgacaaaacaaaagaagatttccaaatcaaaattcccatttgcctttcgggatgttgaattttctccacatttgtgcaattaagagttttgctgagtgagcttaggactctgtctctttaagtgtttaacagtaattggttcatgtcctggtgttcattgaaaatcctagacatttcatgtaaaatcttcttaatgaggggatgaatttttcattcacattagaaagctcactctgacaaacaatttctaaataaaactttggcgacatgacatcccacattggacttgtcagagaggacaggtgcattagaatataactgtatggcgatccttcaagctgtcagccatgaatattttatttcttaatgaatcatctttgtgaaatcaactttcttgttgtagtgtcagtgccatttacaacaaaaagctggctccttttaaaaggtgagctccttaaagatgctgattcctgcataaaatgtttaaccctacccaaggtgttgggcaactgggggctttgtgctttgcttctcccttctgaaagtgacttgagaacccactttgggctagtgtgattacagtgaggagaaagctttccttgatttgttgtttccttctcagaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctgtcattctaatgaggacttaaatgtgtccctgctgaccgagccagaacttatttttatgttgccactaggagtcttctgagatgctcttgtggctggatgtagaatcgctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaataataagatgataaggattcgtaccagggattggcaaatgacagtcattttctgtttccttaagtaaaattttattaaaatacagctccactcattcatttatatattgttcatatctaattattttcacactgcaatggtgcatagtcaaatgctttctatctggctttttaagaagatctttgtccctcccccaccccccgccccgatttatactatggatcagcagcctaaaccctgcaaactgggtcccccatctaagagtctgcagtgaaacgcgagccgacttgatgtgtctcagagtgatcattcttgcccttggcggttgatgctagactgttgcagcttcaaatataatgtattttagtgctatacgacagccataagtattggcctgtgtccactggtctccactaggagaaaaccgagccaagcttgaaagtactaagcgtgcccaggggaaatggaataagctagaaatttgttgtttccttttcactaggtttaagtgagaatatttgtgagcaaactctcagtgtgggcaggtgacaatttctgcaggtattttccccccattttaacttgtgcgatatagttccctattttgttttgttccgcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacatatacacactgacacatagattttgtaaatgaggcacatctattcttgaaatgcaattgcttaaaaatggaagttctgaaaataaataaaaagaaacatcaataaataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctgggccttctgagactgttcccccagccccagtcaggagggcttgtccacaagttgctgtctgaactgggcaagcctcctggcttccctgaaatggtgctgatgtcttcacttcctgccaccttggcaacctttgtagttgctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttacatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttccggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctcgctaaacattgtcacttgccaaaccatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgagatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatactataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgacagcaggaagcccagcttctctggtagcagagcaggggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcacagagtcaggcctcgaaaaataccagtcctttcgcctgtcccctctcacatggtttgaatccaagaggctgtcataccaggctcccccattcagtatattttctttatgtttaaatagtttggattgacttctcttttcttttatttttctgttgctacttaggaaaccatctccaggctagaacaagtgcctgaaatagagaagggtgaggtcactgcctaagacacttcctcctccacccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcacactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattattattattattagagacagggtcttgctttcttgcccaggaaggagtgcaatagtgtagtcatggctcactgcagccttgacctcctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttgtgtgtgtctcaaggtggagagaggctgtggaaacaatagagagaatagcatggaaggccacgttgcaattaaacaagattgggaaagaagacgggactaaaatcatgccttgaagatgtttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaactaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcttaattatgcattaagaaaataacttaagtttctgtgcatacaacatcttcctttctcattcccagtaccctagaaacacagccgttcactgaagaggatttgagtgttgtctcctctgtggggtcaaaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatctattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtaaatttgcttagtcattttcagagacaaaaatttgggaaaaggattgtagaatgactggcttcccaaaaccacttggtgtttacaaagttatcaaaaacgggctgggaccactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtaaacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtctgggcaacagggtgaaaccccgcctccactaaaaatacaaaaaaaagaaaaaaaaaaagaaaaaaatagctggccattgtgacatatgcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaacccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatagaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgagaaacgctatctcttgctagttttattttgcattttcctagtgactaatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtatcttttgaaaagcagaagttataaatactgatagtgtccaatttatctttttcatttgtttagtgctttcttgttctaagaacctttaccaatcaccaggtcacaaaaatattttcctatgttttcttctagacactccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttgtactccattgatctaattttttttcttatacttactgctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctgttgatcaatttgaggaggatcaaaatcctgaaagtgttgagcgttaccatccatgagcatgcatctctccatttatttaaggcttctttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaatatagttttacttcttctccaatttttatggcttttgtttctttttcttgttttaatgcactggctatagcctgtaggacagtgttgaacagaggttttgagacagacatcattgctttattcaggacttctctattatatgtgatcctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaacgggaacattggccacatccgccattgtcaattttaaataaaagatatgatgactagttggtgagttgatcttgtaagacttttacagatacccagaacggctctacttcttcatattccactttttagttttaaaagtttaagtagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgaactgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaacccacagaggtccctattcacataagaattttctaagcagaggttccaatttggatatttcgtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagaataggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctctttttttcctgttcttttccctctccccacaaccacttctgtttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgccatggtctcccaaagtgctgggattacaggcgtgagccactgcgcctagcgaggtagtcagtgttctaaacactggtgtacaatccaagtctgtcgctgcccaggatagaggagggatgacgtgaattcacacgggcctctcctacaaatctgagtgtacatcaagtgaggggcgtccctccgcacctcactgttgggctgatcaatcccattcccactccattatgtgtgtatttctaagtggcagatttgccttaggaaatggaagaaggggatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaacgcttttaccatggctaaaccattaggccggctctgcagggagggcaagaccacagcagctcagtatttcctgctcagggaaaaaggccaggtcttttgttggtggaaatccacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagaggtttcccattggccacttggggtacaccccttataaatgaagtggtggcctgcaatcagtcttattggttgcagaaagcaaccaatcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtgaagttacaaagttacactcctatgcaaacgtctgattggttgcaaaaagcaaaaccactcagaggtactttcaatttcccatctgccctgcagaaaaggtaaggggttgcaaaagagtagcccctcctccttttgttacttaggcgtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagattccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcaattacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggatggggagcaggtaattatgctgggacaataggcgtatgtcaagatatctggtcaccctatctatgatctgtcacacttagtactttctaaaattctcgggcctttgcaccttctttttatcaacgcttagttctatgttactgaatatttcttaattaagtgcaggaaagaaaataaccattttttctccttttaaagaagcacacacacctttcttttattggtattacattccttttccctgttggtgcccctgttggttttccaaattgtcttcccatccttgtcctacctcccaatagagtacctcatcctatagtgttattataactacagaaaatatattttcattccttccacttcatgctttcagctagaaatgtgagtctctgagacttgtattcttggggtcacttaaaacatactgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtgcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaagtgctgggattagatgcatgagccacctggcccagccagaatccttccattaataaaaggatggaccatgaactcccttttatgatatgagccgatcaaatgtgagcagaatagtatcctatttatacaatgtagtttaaaaccaacttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgacgcatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaataatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagccccgcaaagacgagggagcagcaagttccaaagcccgtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccctatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgaggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagagtgaaactctgtctcggaaaaaaaaaaaaagagtttaattcatgcagagctggctgtgtgggagaccagagttttattattactcaaataagtctcccccaaaactcagggatagagatttttaaggagaatttagtgagaagggggtcagggaatggggagtattgattggtcaggtttgagatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcagcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaataacagccagtcgttcatgtttccttgtgccacgtgattattttgtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctctttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcgtcaacttagtccaaatgtagagggtcaggaaaacaatgatatgagaaaagggccggttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgctttctcctgacatcatgatcatggactcacatgacaaaatggatcctccatcttccagcatctctgattgagactaacaagggccctgacagccttttctggacttgtagtatgtgcaagaattaagctttttctgtatcaagtcaccgtgttatgggggttgttcctcactgcagcagaaccttgttcatccgtattagaacagtgtggtgtttcatgttagcagagtgtatcaggatcttttgtttttttttttttttaaattaaggatgctgtatgagtcttttctcatactactgagaaagacatacccaagactgagtaatttataaaggaaagaggtttaatggactcacaattccacatggcggtggaggtgtcaccattatggcagaaggcaaacaaggagcaaagtcacatcttacatggtggcaggcaagagaacttgtgcaggggaactcccctttataaaaccatcagatctcgtgggacttactcactatcacagaaacaacatggcaaagacccatccccatgattcagttacctctcaccgggtccctcccatgacgtgggaattatgggagctataattcaagatgagatttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaattaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggccctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttattgggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccaacactttgggaagctgagacaggcagatcacttgaagtcaggagtttgagaccagcctggccaacatggttaaaccccatctctactaaaagtacaaaaattagccagacgtgatggtgcgtacctgtaatctcagctactcaggaggctgaggcaggagaatcacttgaacccgggaagcggaggttgcagggagctgagatcacgctgatgcattccagcctgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgagcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttacgtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccgctcttccctgagtgccttgttggagacaaaaccagcaggattatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccattctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccatacgcaagctggatagagccagggtccctgagttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaacttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctattttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgccggtgagtgaatgagggagtgaatgaatgagggatttgcagcttgaacgctgtactttgaaacagttccagattcatgaaatttctttttaatgcagaagatttcttatgtgattaactgaatgggaattgatgctttgtggaatgaaatggattgagtacagagtgtgggatcaagaacttttaggcactgtgagtataagagggaaaccaggccgggagcagcggctcacacctgtaatcccagcactttgggaggcggaggcgggcagatcacgaggtcaggagatccagactatcctggctaacacggtgaaaccccgtctctactaaaaatacaaaaaattaactgggcatgctggcaggcgcctgtagtcccagctactctggaggctgaggcaggagaatggcgtgaacccaggaggcggagcttgcagtgagccaggatcgcgccactgcactcccgcccgggtgacagagcgagactccgcctcagaaaaaaaaaaaaaaaaaaaaaaaggaaccagatggccctgcccttgagcaggctgtggtctggcctggtggagagacagagaatcagttaattccagggtcatgtattaggtagtaagatagtggttcacaccaaaaacatagaaaatgatcacttagcctgatccagaagttcaggaaagggctctgagcaggagatggaagacctcttggctggttaaatggagatcaagtggcagcttggactcctgctgcaattaaaaaattactctccagttttcttcatgtgcctccccattcactccaccaccactcaccccaaatcagatcatgattcatttgggttgtaccgattaagagggttccctttacatgaccattccagtcatgaaacagagaatctggtcacctgtcctttatcttggctggtccaattccataagaagtaaatgctgtgtgtctgcaattcaaaagacccctttcacgggaggctgggagatttttccatctaaatagcttaattgttactctacagggcaatcataaatgtaaatcgacttaatatgacttgattgttagtaatgactgtgcctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccattttaaaaaaaaaattgcaccagttctcatcccatcatctgccttgatcaaacatttgcttattggaatcacttcgaaaaggaacttggtatcgttcacatgtgtttataactctcaaatcttcttcttccaatttttaatcttgatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgttatcattgtgtttacagaggtggtcagattcccagcacagtgtactcccgcacagataaccgtcccatcttgataaaacaatgctctcagccgaatcctaaacacgctgcacaaggaagaccttatgctgacagtagggaggaagcgacatgttaacaaacaagtttgccggccaggaagttttaatcagccctttctactgcagggggtatgatggatggagaccctgtttcagaggggtttcctttagataaaacaataataccatgctttcaagaagctcgttcgacagctgtaaagctatgattaatcccccaaaagtcaaacatgggaagactggcaagatgagattattcactgggtataattagccacaattatcgctaaagagaatttggggagattctgctctaaagggaaaagctttgtaaaggagaattaccagtagagtgaccttataatttaccatccaatggattttgaatacttttgagagagaaatgagatactgataataattataccaagacaacagacataaattgggattggcctagacgagcaaagatgaatggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttcgatagcaagtagaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgcccactctcaactaatttttgtagccatggagatttggaagtctggcaagtcttgggtcacatgatctaccttacagctgttactgcagacctcccaaagctcacgaactgagagtcaggaggcgtggttcccctaactcaaatcagaatttcgttatcaaaagaagagagggatggttctgtggtgtcccacactcaaataaacatcctttaaatacctctagatgcttataattcctgttgcagccttagtcagtgggagccactgacctgcattcgtgtaggaactgagcaaggttcatctagtctcggtagctagctaccccgagagctggctgattttttttttcttaaatttaattcaagacttcatgaagtcaacaaaatggtctgttggaaattattcctaacccccaaccactgtcactgccacaatcaaacatattttcattcttttgcagctgcagcccttctacttgaactttcccactcattgcccttataacttgccatttaatatctcttgctttcctacatggctgtgactactcgtgggcagggactgtatctcctgtttttggtagtgcctccagaaccaaacaccatatgtcataaggtctattaataaatatctgctagtttttaaagtttgagaaaaacccgtattgtggaatgaaaatgatactgacaagggaatacatctagatcagaaatactgatatcgtaagtgagatcttgttttttaaaacaaaaaaaagtttaagaaattgtcatataggctgggcgtggtggctcacacacataatcttagcactttgggaagttgagtcaggagggccacttgaggccaggagtttgaaaccagactgggcaacacagtgagaccccacctctacaaaatattttaaaattagccaggcgtggtggtgcatgcttgtagtcccagctactcaggaggctgaggtgggaggataggaggctgaggtgggaggatcacttgagcccaggaggttgaggctgcagtgagctgtgattgcaccagcctgggtgacaaagtgagaccttgtctcaaagataaaagaaagaaagaaagccctatcaaaattttaaaaaataaaacataagaaaaaaataaatggatacatgatatttgtacttctaagaggcatcttctatacatttcctgtttctctcttccttttcctaaggagtccttgttgatttgtggccatgaaacctctctcctttccaggctggcttcttacctaggtcgtgtcctatccctttattttctggcagggctggactgtcacttggttgttctcggtttcaggacccacgtcttttgtctctgtaatgaatgtgttcagaggtctctgcacagagaagctggctgttaggaaaactatttcttctttccgagacaggctgcaaaatgcttgttactattttgtgtattcctggcaggatttgtattcttagttttattactaatgataataacagttaatgttgaaatcagcttcatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagagtacctttctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagagacacccccccactcttagcccacttttatagatggctaagcagaggctcagagaagtcagacaactcacccaggatcaagcagagggcaagtggtagattctagaatttgcatccaggcagttgagtctagaattgtctttgtgtattttgctccatggtctagcacaggatcaccattggtagatcatcacttagaatgccatcactaccttctaacagcaatcagtccccttaagtggctttcttctcttttttttcttttatctttttgttttttttttttttttgagggagtcttgctctgtctgccagatggagcacaatggcgcgatctcagctcactacaacctccgcctcccgggatcaagcgattctcctgcctcatgctcccgaatagctgggattacaggcacacaccaccacacctggctaatttttgtatttttaggagagaggggttttaccatattggcccagctggtctcgaactcgtgacctcatgatccactcgccttggcctcccagagtgctgggattacaggcatgagccactgcacctgactaagtggctttattttcttatgtggggatcctggagacacagtgtgtgccaaagcgtctgcagaccagtctgtacagttgattatagatatattaatgaccacttctgagctaaaaaatgatctagaataatagactaccaaacacataagcttatttacggtttgcctccttctcatgcttttggaagggaagcactgagggtcattgtatcagtcagcgtagactaggtttgccgcagtaacaaacgaccccaccatgccatagcttgcaaaaacaaagactgagttcttgtctacactgtagggccgtcaagagctggctctgcttgctcttggtcttctccatgccaggatccagagtaaaagcacagcttctctctaggactccaggggaaagagaaaagacaagttcttaaagtttcttccaggacgtgacacctgacatttcactggccaaacacagtgacctggtcactctggggcagggatgtgtaatctccccatagctggagaagtaaataataatgcacaataacattgtctcccatgggtgcagatgtgatgctttcctccttgtgactgttttctgtcttgctgtcccaagtcctaaggtcccagccacctatggttctttggacctgtgattttcgctgaccccgaatgactggaggaactgctgcctgcatccccaacccagccctccttatcagtcacgtagaaagcagttattgtttccaagttccctgcccttgttaaatgtcagctttgagtgaaaatgttcctaattttactcagagtgcaaagaacacccaggtcaggtacctgacctgcttgattcatgtcttggaaacactcctttgtctttcagagaaagtaaagagtgatggagacagagagagaaagtgtgacctactttttattatcagcaccatttcatctgcaaaacacgacttttctcttcttgttacgctgagcatgaaaataaaatgttttccaaaagacctggctttggctgttgtgaggaaggccagggacttgttcaaaactctgatgagctcgatgagcaaatgattccaatttttaaaaactgtaattgactttcaaactgctctcactgtccacacataatatgtggtacttttctgcaaataccagcagcaaggtaggacaaaaccagctcccacactggctgtttgcttgatattaagctttgccagtccaatataggtcacatttccaaccagattttgtgcttatctctacattacaccttgtagcaagggggaaaaaaagagcttcttgacatctttttgaagaatggcgctctttaaaaaaacataagggaactttttttttcaaacactgtaatgagggtattcaagtctgcaggcaaaacagagctgtttgaaaagacattagcctcgaaaccgcactgtgccagaatagatacagctacgtcaaaatgccgcatttattttgccattacttttcactgactaaaaccatttgctaatgaaagttctagctgccataatttcagcacctgctgatggaaaggtggactcactggtcatggggagtacagtaaaattaggagagtagatagaatcctgaagcatttgagctgcaaaatcatagtaacaacagctcttaatatcctataattgaaaaagagattgccattttcaaagacctttcacagtcattctcttaatcaagtctcataataaagatgtcattgggacttagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctattgtatttacagttacagtttattacagggaaaggatacaggttaaaattagatcggggaagagacaaatggggcaaagtccaagacaagtaccagatgtgaagcttctattgtcctctacccatgacatcaggacagaatacttttctactatctatgtgtggcagtatgcatggaatattgtcagacagagaaactcacctgagcctctgtgttcagagtatttattgggtcttcgttgcgtaggtgtgattgggtgattgcccacatatttgatctcagcctccaagtcaactgataactgtggtacagtgtccctaccctaagcaatattgttggtcctttaagaatggttcatctgcaacctaaggttacatgggtgtagttaggccccaccctaaatcacattaagagtctccagagtatgatcagaggtgcccaagcaaacaaagactctttttttcaggaatatattctgcatatatttcagtgatttttttttttttttgagacagtctctcattctgtcgctcaggctggagtgcagtggcatgaccttggctcactgcaatttctacctcccgggttcaagcaattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttataagaaaggattccaactttcccatttacagagaaggaagctgaggctcacaggtttcactcaaaccataaagctcaggagtaactaaaggaactggagcttgggggtcccagtcctgggcaccattgctaagtaatgtggcctattttcaataagggcttattaatcatactaaaaataagaacttaaaactaaatttttatttgcctagaaatctaacatctttagataaaaatattccatattcaggaggcataattctttctcttttctttttttcttttttttttttttgagacagagttttgctcttattgcccaggctggagtgcaatggcgcaatgttggtccacctcaacctctgcctcttgggttcaagtgattctcctgcctcagccttgcgagtagctgggattgcagggatgtgccaccatgccaggctaattttgtatttttagtagagacggggtttctccatgttggtcaggctggtctcaaactgccaacctcaggtgatctgcgtaactcggcctcccaaagcactgggattacaggcttgagccactgtgcccggccatctttctttttcttcctctccttctaccttgcccaccatggcttaatttcaccagaatatcatcattatcaacatcattatttctagttcagatcattctaaaaatagagcagtcattttcttctatataagtcccaggtccagcctgctattttttgagcctacctttcctaatatctagtttatattttgttttgttctttcttgggattgggagtcagaatatcaactttttcagaaaagagctttggaaattctacatacataatatatataaattttccattcatagtgtgttagcagctttttctacaaatctcttggcgggtggggggatatttcactcttctatgaatcaaataatatatggctttttcctattggaaaaaattagtcgtgtgaactttattcttcaagaaaaagtagtttttatctgccttggaaatgtcaaaaggattcacaagtttcacaagtgatgatctgggttgattgctaggaactgtttttagttagtttttttttttttttttttttttcagacggagtcttgctctgttgcccaggctggagtgcagtggcgcgatctcggttcactgcaacctccgcctcctgggttcatgccattctcctgcctcagcctcccgagcagctgggagtacaggtgcccgccaccacgcctggctaattttttgttttattttgttttgttttttttagtagagacggggtttcaccgtgttagccaaggatggttttgatatcctgatttcgtgattccacccaccttggcctcccaaagtgctgggattacagacatgagccgctgtgcccggctgctaggaactattaatccatagacaaggctctggttagagaagcagaaagaaggctgggtagaccggggaaggtagctgggaggtctctgaagcttggtcttgaagctgtgaattcatagacgtcttggaaaagaactttataatgtggttagacaagttttataagattttaggattaggaaggcttttttagggggtggggttgcttttaaactttgtttgaaaaatggagcttgctgccatcatatcatcatcaaaaatggaacttgtctatccacaaatatttatttaaaagtcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggataagaaagccagtattggtaaaaacatatatcagagtccttttgactgtttagaaagtgttaatttactccacgattatccattcaacatttattagttggcttctgtgtgggagagtaaccattaataccttgaataagtttataatctggtcattctgtagagcttcctatatgatgtcttctgtttaagtatttctgtaataccttatagacatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgttcaagaccagcctgggcaacatggcaaaaccctgtctctacaaaaaataaaaaagttagccaggcatggtggtgtgtgcctgtagtcccagttactggggaggctgagatgggatgattggttgagcctgggaggtcgaggctgcagtgagcaatgatattgccactgcactccagactgcatgagaacgtaaaaccctgacttaaaacaaaaacaaaaagaaaacgtgctcattggctaagcctggtagaagccacatgaccaaggctgatcattgctgccactgggtggcagcatactgggattgaggaaaataacccctcaactgcccggatgataaacacagagttctaaaatggcaacaaagggagatccacccttctcagttattgtttgaaaggacagctctcaggcaaaatatgtccacgaagttccatggaataattaccttccttggtgttaaaaaatgccctcacatttcaaacatgtcctgctttaagttcccagcgtcttaaccaggaactcgcttatgtgtgttgttttctgcttctttccactagggagctattgctgtaaaacagaaggggtagtattacagggaggagatgcacattttaaaatatatttctgcttcgtcaaactgtacagaactcttttcctcaatgagaaccaggtttttgcatgtatcttttgccaagatttgagaagggaagtctccaccttccagagctttggtcatattttgtttctctctaagggtgaagatgctgtttgttcttgcagggtgaggctttggccaataagaaagcagtgctcagaggtaaagagcctcgctgaagccctagttctagcctaccaggatttggtcatttcttggtttttcatttgatcccacccttgcctaccttcagaatgaaggtagaatgtgggactgtttcagaccatgaatgcgattgggcagaaagactgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggcaaaaccttacctctcaaaaatttacaagcttagccaggcatggtggtgcccacttgtggtttcagctacctgggaggctaaagtgggaggatatcctgagcccaggaggtggagattgcagtgagccatgctcgtgccattgcatttcagcgtgggtgacagtgagaccctatctcaaaaaaaaaaaaaaaagttcctaagaaaataaagcctggcccatgcaatttgaatgtaactgtctataatttctcttggttactgaaattctgagtttgtgtctatggtttctccatccttgtctttgaggaggagcaggatggcgaagtcgcagccatttaaaaacttgttttcagtcattttgcagaaagcagacgtacacttctttgctgttggtctgtgatgcgggagtggtttgtcagttctttcattcaacaagtgctgatctttgggcagcatacactggtatgacctttatcatttgttcaggtgttgtggagaaagttgtttgcttttgaaagacttgatggagaaaagtctttctacatttctagaaagaccatgggtgtgagtattgagagctgagtgccagtttgtttttttgtttttgttttcgttttttgagaaggggtctcactctgtcacccaggctggagtacattggtgcgatgaaggcttactgcagcctctacttcctgggctcaagtgatcctcccacctcagcttcctaagtagctgggagcacaggcaccagcaatgacacctgcctaattttgtattttctgtagagatggggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtataaaatggaccttgttttgaggagagaatgaggtatgtggtactcgtgagcaggattttcaatgcctggctggttgttacttatccatttagtccgagcttcagggaaagaacatgacaccggcctccagcagagcctgctcttggtccactgtttatcctggtgaccttaggcaagtcatttaatttccttgagttttggtgtaagtattgatggagcagaccatcaataactgttcttatgtctattattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcactacaaccctatgtagttcacataactatttgcagttgtattttcctttaaatctaaattggagagaaggaaggtaattaaggcataattatcagacttaatcaagcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttttgtgtgtgtgtgtatgtgtgtgtgcgtgttatatgaagtcttgctagaatgcataaacaaacaaaaaaaatatcatactctcagatcctggatactgtggtcgcctggacttcaaaagccttttgtccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatctgcccgcctcggcctcccaaagtgctgggattacaggcgtgagccaccgcgcccggccccacttttcttgttgtgaatattttttccccttctgaagtgaatactgatttttcgttacagatatttgatgctttgggggcctgttaaaatagttgtaaatacactttctaaatagatgaaatgtaagaaattctgagaaggggtttctttgacttactggaaaaaaaaataataggaaagaaaatgtgatcagttggtatatttggctctctttcatcaacacttttatggacctgcattgcagtgtttctgtgatgtgtataaaacacagtttcagtgatcgtgcaagcctcagttttagaagataaaaagatatgaacttgaacccaagcttctctgtcaagagaattataatgtgttttgactgtaggcttccttcgagttaaatttacagtattttcccctaacaataacaacaaccagaagtgcccctttaagttgagatgcttgttaaactttacatgtatgcatgcatataaatgtacatttctgtatatataatatacgttcacatatagttacattagatttttaaagaatttcctttttgccttcaaatcattgcacagaacatccaagtagacatcatgtcaaaataatcaaaatgtatttaacgctctctcaagaaatccatttaagaataagaacacggtttgggggtgattttcagaccgtaaattgaagtgtaaatattcgaattattttcataaactcttcagttctgttgggcttttatgttatcatacagtgatttttttttttgtatttaagttttctagcagttctcttttttaagagcctcaagtgtccaataaaaagcaaatacttgaattttcagtttctatatagtgcatattttttctcctgcttgccttatttttataacagtgatttataaagacattactaaagaataggaaagaaggattttgaagaggaactgctatataacactgcttaaaaatctatttccaatgctaaggagaggaaaaaaaaatactggcaccgtatccgagtgggatctgggatccgagtgagatggccataccttcagtcattctcctccccaaatatttattgagcctggtggacaaggagggcgggataagattgccaggccctgcttctatttctggggttgggatggcgactaaagacccgcgtggactgcatgctgcagccagctcaggaaagatttcaggaagagcgtttaggaaggcagctttgaaaagaaaatggaaagatgaggttgcagagggtcagtccaaggtgaccagaatctgacctggggcaatgccataaatccaagaaagactgggtttcaggtgcaggaaatgcgattgtgcacggacccttgcctttttacccagtatctagcccatccttctttcttagaagcagaattttctaagaggtacacggtagttcaggataaaaattccctgtgctaactgcccttgcagctagctctctgtgaccgtgtgaccatgtgacccagttctagcgaatggggtggcagggaagtcccacatggacttcttgggcgtgtccttaggggaagcatagcttcttgccttcttcacactcctccttcccttcctgccgtctgggatgtggggtctggcagagaaacaatattgtgaatggaaatgggaggaacttgggtcctgaaaattacaccataccccagagcctggggtggattatttcaggacctttcttccttccttccttccttccttccttccttccttccttccttccttccttccttcctttctctctttctttttttattttttttttcagacagggtctcctccacacccagactggagtgcagtggcacattcatggctcactgcagcctcaacctcctgggctcaggcgatcctcacaccttagcctcctgagtagctgggactacaggtgtgcaccaccacacccagctagctaatttttttttttttttttttttctgtagagacggggtttcaccatgttgcccaggctggtcttgaactcctagcctcaagtgatccgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcgctatgcaaggcactgaggtgacaaagacaagcagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaaactcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcagattttgctgggctgggccagttcagctcagcaaggattgctgggcatgtgcttgaaggagaaaggtgaggatacaaaggcaatgagtacatgatccttgaccttgagaaacctatagtctaatagaggaggcacatataaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtacccacttgatatggtttagctgtgtctccacccaagtctcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtatgtctttattagcagcatgagaacaaactaatacaccacttgaattgctggtacgtctgaggggcttgactcccagtccttcgaacatggaggggtagctctttttctaagctcctcataaagtattgtatccaattcttcagaagggatgaaggtatctggtcctgtccgcaaacagagaagtgcttcttgtactgaccaggcagtgacctaacgcagtccttgagacaattccaggtgcccctcaggccgtttttccaccctggtgtttttctttgtatagacagcctatgcctggataagaacatgctgcgtcagagagttctttttcactttgcccctcaaaatgtgcacaccgacagccacagatagatcccagatgtctttttcctgctcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagactatatccacatcacagagagctggcccattgctcagggcctgggaagtggtagggagggaccttcccagaagagagatgactcaggctggtcccaagcccctcctgtagaacaaacagacaaggtgaggagcaaggaggcatttggaggtcatctggcccagcacccttgtctggaagacagatttaagttccataaagtcacttaggaggagaacatagtccaggttgaaccttgctgcctgccctctggttgaaacatcagtgttgaatcaatagaccacgtcctgtccataccttgggaattagactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgggcatggtgtcacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagcccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccataattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagcactttcggaggcctaggtgggcagatcacaaggtcaggagatggagaccatcctggctaacgtggtgaaaccccgtctctactaaaaatagaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgcagtgaactgtgatcacgccactgcactgcagcctgggcaacagtgcgaaaccctgtatcaaaaaaaaaaaaaaaaaaaaaaagaaacacaacttaccaaaccaagaaacttacagagaacatgattagaagctagcatctgtttttaccctaccctcttcccctatgacccaccaccacgcaggccttgctaatgtggggtctttgtggaggatcttcaggatcttcagtgccagaacccagcatttaaactcttatttgacagtggggccacagcagatttaaaaggacaatgacatgataaaaaatgtgttcctgagagatttaaatgcaggcctatagagagcagatgttaaaagagaagaagcagactgggcatggtggctcgcatctataatcgcagcactttgggaggccaaggcgggtgcatcacttgagcccaggagtttgagaccagcctgagcaacatggtgaaaccccatctctacaaagaatacaaacattagacacttttcaaaagaagacatttatgcagccaacagacacatgaaaaaatgctcatcatcactggccctcagagacatgcaaatcaaaaccacaatgagataccatctcacaccagttagaatggtgatcattaaaaagtcaggaaaaaacaggtcctggagaggatgtagagaaataggaacacttttacactgttggtgggactgtaaaccagttcaaccattgtggaagacattgtggcgattcctcaaggatctagaactagaaataccatttgacccagccatcccattactgggtatatacccaaaggattatatatcatgctgctataaagacacatgcacatgtatgtttattgcggcactattcacaatagcaaagacttggaaccaactcagatgttcatcaatgatagactggattaagaaaatgtggcacatatacaccatggaatactacacagccataaaaaaaggatgagttcatgtctcttgtagggacatggatgaagctggaaaccatcattctcagcaaactatcacaaggacaaaaaaaccaaacactgcatgttctcactaataggtgggaattgaacaatgagaacacttggacacaggaaggggaacatcacacaccggggcctgtcgtggggtggggggaggggagaaggatagcattaggagatatatctaatgtaaatgacgagttaatgggtgcagcacaccgacatggcacatgtatacttatgtaacaaagctgcacattgtgcacatgtaccctagaacttaaagtataaaaaaaaaaattagctgggcgtgatggcacctgcctgtaccccagctacttgggaggctgaagtgggaggatcacttcagctcaggtggtagaggctgcagtgagctcacatcacaccactgcacttcggcctgggtgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaattggttgtgattgaaaggaaagaaggaggtaatgatgagttttggtctgggaaccggagaatggtggtccatggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcagaattccaggacgtctcaaatttctggctggtacaccctgggtaaggtccacaggctggatgggttttggaacatgtcttgattgtactttttcctcttggtttggaaagcaacgtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatggaagccaagagaagcaaggagtttttcatggttaaatcttgtaaagatgctttttaaagcatattaatccattagtaatccatttggatttgggaatacggtcatatactgtttggtacaatatgtactaaacctggtcctggaaaattaagtggaaatataggtttaaactactggaacttcaaaatagcttctcagtaattccttctcagcaatcattccaattcctagatttaaaaaaatgttgatatatcaaatttccatcaagaggaacatacatatggatttttggagaggggagcagagcagaagagaaaactttcaacttttaatagtatttcaaatttacctgaaagtgacccaaataatacaagcaactgtttaccctgattctccaatacacctgcatctttaattatgctaatttgatacaggtgtcagattatgcattaacaaagacatcctttttctttgagtatgtgttttctatggttatgtaaattatggaggtgctaaacatacctttagagaactttgtatttgtattaactttttttttttttttttttttttaatagcgatggggtttcactgtgttgcccaggctggtctcaaactcctgagttcaagtgatctgccttgcttggcttcccaaagtgctgcgattacaggcatctgccaccgtgcccagctatagagcttcatttatttatttatttatttatttatttatttatttatgagacaaggtctcactctgtctcccaggctggagtgtagtggcatgacctcggcttactgcaacctccgcctcctgggttgaagcgattctcctgcctcagcctcctgagtagctgggactacaggcacatgccaccatgcctggctaacttttgtttctttttaaatagaggtctgtttttactatgttggccaggctggtctggaactcctgaggtcaagcaatctacctgcttctctctcccaaagtgttgggattacaggtgtgtgccaccatgtgtggctatagaactttttaatgtgccaaggtctgtgttcagtgttttcttattcctcatctgacttagttctcaaagtccttgcctaaggtattgctgtcctcaccgtcctatggggagataggtcactttcccaagtctgggcagccagcagcagggctaagatcaccactcagaccctgtgtttttatttttcatctcctcacatctggcgctgaatgtcaggaccttcctggcctctgggaaagacacaggatggctgttttgagaggagtgtgaaatacatgaaggcaggacttccacacacctggacgtgaactagaggtgaggtggggaaagacaggaagtagatcagtgttgcccagaccctaccttttccaactagggtgtggaccatccttcagagcttggcctccaagttggaacccgtgtataccactgacagtgtttcctgggatggtgatatttatcaagtgcagaggcccagacacagagagcttgaggacctttgtgtgagacagtgaaaccctcaaaggcaagggctctgtttcatgagttttctatctcctgctgctgtctcggtgggcctgtttgagttgacctgtcccgtcggtattagcaactggcaacagtgggtttttgttaaatacggcaaatattaagagtcgtctctgggcattttagtttattcattcatttgttcatttattccacagggatttattatgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacatgggtactggagagtgggaggcccagtcacggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggcagccacaggagggctttagacaggaccgtggccccgctggattttctgcccattgacttgggctcgaagtcacgtccatgttgctattacagatgcctcccagaacagtttatataatcgtcaacgtatattcatggagcatcttctgtctgctagacacagaattgggtgttgggctttaaagatggatgaaaggcagtacctggtctagagaggctgctacctggatggtgtgtttgccatcctcagtagtgtgtgtcccttacagatgatgcccagtgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggctactgaaatggcttagaatgccattttatcacatggtcaaattattcaatgatcaaatatcgaattattaaaaattatcaaaaggaagttccctgaaacatgaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggcccaagtttacccaattcgactgcccccacccagatagaatattcatggttagaccataaactacataactggaaattttaaatctatttttatatgcatacaaaaactgcaggcctgaagcttctaaaaataaacgttactttcatcccattatagaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtataaaataacctctgtggtatttgtttaccctgattttttgatttatgagtcgtcattgctcgctatagaagaagaaaaataaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccttttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactcacagccatgaatttcactgaagtttatgattggtccctgattgcctcacatcttgcaaagaatcctcttctagaaagcgttcttgcagttagattaacaagcagatatactgaactggtgcatgaatgaataggaaatatcccagttgcaaaggataaatctatcatgtagtggagagcgtgttcaggcaaaacatttggttctgcggtcgcttggaggattgggcccgtgctataattaatgccactagcagtaaaaggacattagggatgtcgcgcatgttgattatttcttcattttgtttatccaagtttccccgccttggaagctccgtggccattgccaaagaaagccctggagacagagcgttagccgttgctcctcgtaagcgcatcattaccttcctccgaacaaagtcctttttttttttttgtcagtagagggtgaaaacattattggattcaggagttcatagtagtcctgtatgaagctggggacggggggatagagttatgaaatggaccatttcaaatggcattatcttcccacagtgaggtacacctttcataaatcataggagagtgctcagaaaatagagcatttgttattcctgcagtacattgtatttgcatcccccctactcacaggaaagaagaaattctcaggtttcctttcccaggtttgaaaaggcagttaatcgccttacaatgaaattatatttttaaaaaaggtatcataatcaaataaaagaagtacttcatgtaagtcaaggattgtgcttttactactattttttctttttttgtaatcatggtggttctttttgcccacttatttaggccttaatttaattacggcgctgattaagttctttggttttattttttactgtaaacattgtgctgtattccgtaggaaaatgtagatgaatgtgggtcattgggaaataaagtgggtggaagtattggcgagcatttctttcccactctctacctcgcctggtctagccgctgataggtagttactctttagtatgcccaagttcaaattacgtatgactgtgattctaacacggaagcgccctccttttctagtagcttggatgtgattggtatggagaagcagagtgggtgcgtctttgtgtgttcttgacatagttaaagagtttggtatagtcaattccctttaaagtagtaggcttcttaaataattctagttgttcctcgtgctgccaagccatcttgaagaatttttcttcatttgtaaggggttaaaagtcatcaagctgattgaaaagtcaagaacctctagcgcagcctaccccttgcatatttgatactctcttttgcactctcgggagcagttttgaggacacactgtaaaaatgtatgacagcagtttgaagataagtctgttgccccaaataatcataagaagaagacagaagaaaaattgattcccgtagctctctgggcagtgggatgggggtaaagcaaggaattaataaaaacccaccagaatacattatttcagacaatcaaggagagcgttacattttaaaggtacttcatctcagaaagtttgagacatacttttcacacgtggcatgaagagaaaatggaatggaatgagcactaatgaggaccttgaacttaactaactgaacttgatggtcatcgcaagacataggggagaaatattttgagacatcattgtgcaggcaaacatgagcaagaaattgagaaatccgttcatgcacttctctctggtttcccggaagggatgaattccaaatcccgtggctcaggtcctaggtcaaagacagctctttagaaagagatgttctttgcttctttgctgactgcccatcccctcctctctctcaaggaaataagatattcatttgcaagtaaataatgcagcagtcttggatttgtatcagatcaactttgaatgaaagcctgcctttctgcgtttatttttgcttatctctcctgcttctgcttcctgttttgttaaataagggcaatgacggcaactattttaaattgctataaagttttagctagacagcgaatcaaggtggcaacacatggtgggttcttaaataatagttgtcatttgagtgctttctatatgatgtacatttcattttgcactttacaaataacctcttcctttttctgtttaatcttaaaaaagatcccgggaggcaggcgttattgtgcccatttcctggataaggagaatgaggtacgctaaacgagtaaaaagcaacccgagatccaaaccctttggcattcaagattacactcttattcactaactgttcatctcctccgactgcatcgccactcccccaggccagataacccatccagacctggagaactcctagagggagaaacagggaggacccaggcacataaacttgcagagcagctgagttatcagatcttccaagccatggggttatcgagctttatcagagcagccttgctcttgcagtttctgacacatcaccattgatcagtcctgggaaacaaacaaaatagagggcgatggctccactctgtgtggccccgtcaatggcctggacgcagctgaaaaaatccagaagagtgtaggacactggaaaagtagcagggtgtgcgattgcagggatgggaccagcagtaaaaggtagccctgccaagaccattaagcttcctgcaactccttctggatcccacaatttgaaggggaaatctttcccaccgcacatcactgtttggtggactaaatggctccccgatgtcccgaaagagcacagcttctggaagtgtggtatgtggtccctgagatgaagcagcagccacaggaacccatcattcctgctacccaaggcctccattgcctggttttctgttgtcagaagagttcattttcaggtccttcaccagatattttagaagctcatcaaggaaaggacgtttgaagaaaaacaaataaacaaaaacacaaaatcaaggacgtattgatttctgagaattcctcctgggttttgtttgtttgtttgtttgggggttttttgctgtggtattgtctgagcctatgataagattgttgttgattgatttttgtctttcaagactcagcacaacacatcccatccttctggataatctcttctaccctccctttccagataaaagttgactctcataattgtaactctcccctactttatcagcatctacatctttcagcctctaccacattgaattggaattatatgtctgttttatgtaccatgctgtgaactccttgaagataggagctgtcttatcttcaaggtgctcaagacacgtttgttgcatcagttgaatggagtcaaattataaacaggtgatgggggcaaatatcacaatatgatactctgaacatcttctctgacaaaaactggtcctcaagatacaacaacatttatatttgatttgtcttgctgtatcgaatcaagctgtggtcttgagtttcgtacacatctatgtaagcactctgaattgagtgactctttcccaaagatcatactgggatctttggaatgaatggcgggtcacccatccaattgcttttgcggagattcgagcatgtggggaatgcaagtcacaatatcctgcaaaagccaacttgagacctcctaggactgcactgctgcttatgacactgatccttagcccatctaagtaagtgagcatggccctgtaagtgaaattggagaggttccttgacattcccacatagctgcttccctggtaattcacctgggtccagaacacagaagggagattctaattgaaaaacttttcctaaaggccaggcacagtggctcacacctgtaatcccagcactttcagaggccgaggcagggagatcacttgagatcaggagttcaagaccagcctgagcaacatggtgaaaccccatctctacaaaaaatatagaacattagctgggcatggtggcgtacacctgtagtcgcaggtacttgggaggctgaggtaaggggattgctggagcctgggatatcaaggctacagtgagccgagaccgcacctctggagtccaccctgggtgacagagtgacaccctgtgtcaaaaaaagaaaaagaaaaagaaagaaaaagctttgcctgtatatgtagaacaaatgaaaaccaaataacagtggcaccagttcttctttcagtttccatggaatatcaagcacgatttgagttgagcaatttgatttgattgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttggtttgttggcttatgttcgctgcttgatctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcgtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctccagttaattttactttaattccccctacaagaatgccgagacacctctgcctattttctctttctgtgtttgttgtttcttttgtttttgttttcgagactgagtcttgctctgtcgcccaggatggagtacagcagtgcaatctcggctcactgcagcctccaactcccggctccagtgattctcctgtctcagtctcccaagtagctgggattacagggatgcgccaccatgcccagctaattttttgtatttttagtagagacggggtttcaccatgttggccaggctggtcttgaactcctgacctgagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcagagttcaccctggaagacagagtttctttctgtcttcatcctagggcacaggagagatgcagtgatggcatgtctccactctgcagacatgttgcaggcctggaaaactgtgtggtgcgtctgtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaagagggactttgttccccctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgaggaaacgctctcttcttcttgcaggggagggctggcaaattcagtgaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaaaaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactagctattatttatttgttgtcactgtttgggacccctgttgctgtctcaccaaagaacttcttgtctcccttttagaagtttccagagcgtcttcctgatgttgcatagagcactcacacctaacagatctcagaacttgtatcttttctgggtggctagactgaaaaatccattttcttatgagtgagccagaggtctgtctcttgcggcatttctgcttttgagaacctcccgtttcctgaaaggcaccagaccccaagacagctctgctgcctgattggtagatgcccatgacagctctgcttcatgcctgctgcctcctcatccctctggatgccttgtggtcctgcttgtctgaagagcataaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaataggaaggttatcctgggtgattagcatggatcagagttctcacaggagcccttcaaagcagaaggggaaggtggacaagagaatcggagagatgtggcagagggtaggcagagagattgcaagcagggaaggatttcacgtactgccactggctttgaagatggagggggcacatggctagaaatatgggcggccctcagaagctaagaactagctctttctgacagccagaaggaaatagggaccttccacctacaatagcatggaaaacggggacctcagttctgcaactgcatggagctgaattctgccaataacctgaataggtttggcagcagattctttcctggagcctccaaagaagagcccaggctggctgacaccttgtgagtggccttgtgagacctgaaacaggaaacccacctgagccactctttgcctgggacttccaacccacagcaactgtgccgtcgtgactagatacgtttttttaaggggatgataatttgctgtggcagcaatagaaaatctgatacactgtcatggggccttccacagggtggggctcaaccagccctcagctcatctagcatgtttcctcctacaacctggactttttcctgttgtcccctcccgtgacactcagctccctgcattcaatagaattgcttttgtgggatgatgagtgtgttcagagtcatactcagcctaattattgcttttgaccaaccccaacacataatgctgtatgtcatgctgtactacttttaatttcacagatgaacacatttctgttcttttaatccacctctccaaggctcgtgttaactccatctggacaaagccttgaggtatacgtgtggcttcttttgagcatcgtgccatagctgtccctgatctaccttgcggggcaaacacaacaagtaaaaggttttcctcttgaaggattgaacgcctcaatgcgtgcatcctacattgtctagtgggagaaatctccgttgtagattctgacatgtcactccacatctttgtaactttttatggctctcagccctactttcttaatagtagcagcagtatttatctactgtttattgtattccaggtaaaggatatgcgaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatgcttttccaatattccctcctaatctttcagttgaattatggtctttagctcaaatgcatgacatgatgtgtgtgcctttggagtggggcggtattagtcagtcgatggttatttccttgaggagaaaggaaaggagaagttgagtacttttcagtgtttgttactacaaaagcatggtggcatgccattgttctgagaggaagggggttttttgccttgtcagctcctgatgaaaaagatgttgggttggaaagctaagttacagcaggtgaacttgaatttgaggaaagacaaagcaaaccctggctattaaaggaacacacacacacacatacacacacacacacacacacacgtttctggtattaggaaatggagatttctaacataataaaaaagattgaacttaaaaatgacttccattaaatagggtaagaattttgaggtggaatcctttttccttgggtcagtactttctgcaagcttctaagtaatggtttctcttagacactcacggtgataaaattgggagttttcaaatgaaatctggaatgatctactggcatcatgcctaggactttggaaaacttgaaggttggcacctttggggaaaaccagacttttgaagcaggggctctgattgtctcttcttattatagtgcaaggtgtttggcagaggtgtggtagctgaaggcccaaggataacattgtccagattttcagtctttggagccataaacatccagttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgattggcaactgggaagcctaagggtggatctggcgtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcagcaagagtcccacggctgactctcattggccctcagtgggtcacatgtaaatcattgagccaatcaccgtctttctgtctggacctggaataaagaccaccttagagcatgggagcgggatccccttgatccacaccatatagactgtgaggtatgaagtacctcacagtaaagaagtcatgttattgctggaaaaggggacatgggtattaaaaagacaaaaacaacagggcttcatcacagcagctatactgctccatcaatacccatcccaggagacagtggcagtcttgatgtcaatcttgttttaggatcattgccagtggaattcaggactgcggttctacccggtaccggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgtagcaaagtgatctttttgagacccaaatgtgagtatgccattctaatcttcccaccctcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttgccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcctgtttttgtgtttgtttattaattcctatttttcccacctgacagtacgctccgtagggcatgtgtttgtttcggttccccaacgtatccctactgcccagcagaaggcttagctgttaacaagtgtttattgaatgagtaagtgaatgagtacgtgaataaatctgcgctttagaggcacttgctcaggcttgtggaataattctacagagagaaacaggaatcaaagggaaacctgaagctggctcagaagatggatgggccagcaaaggcttcagcaaaaccacacaatgctcatgaaaaatcacgcatttctctgatttgtggttattgcttccctggattttttttttttccagttgttgttgttcatggtggtggtggacaatctgaccatataccaaccaaattgactgttaaattcaatcatcagtgaccactcctgataatctgacctcctaagttagagcccctgggaagttcagccgtggttctgaccaggcaggataactatctaagtgttcccctttggacctagactgagccaaagattctccttggtctatataggataatagatttctaaaacaaaccaatagctcaggcacaattatagtggggggtggggggcatgtttaacctactttagagaacaaactctttttaagggctttgcacactaattgtatgcaaatggatgctgctaattgcaaacacaaaattcaaacctagtcaaatttgaaacctgttcatcaacagtccctttaggacctctgccccactctatgtatgcagtttaaattgctgatttatggctacataatgtcttcctaacccccagtttactgttggcttccttcagagtcattgccccaggggactcattgacggcagagagtgtgtcccctccactgttgcctcaatgcccagctcagcccagtgggtaccgtacttcaaaacctcttattgaggtccacctctgtgccaagcatttcggtaggcagtgacagaagagagtgcatgcatgaatggataaactctttcctggaatgcctgctctcatcacctggtttcaaagtcgagccagacgttctgtctcagctcagattctacctaccctgaggttcgcagctgggcatgatcgagccactctccactctcctgtagcatttttgggctttgagtttatttgacacttttcacttgctgccttatattgcgtttatttttattaattacttcagtagtcatttacaaaatgctgctgaatccaagtccctgtgcaagatgctgcaggagacaaaaagatgaacaacacgtggtctttgctttcataggttatttctcctcttccatagcaacacatgtcaaggcaaggaccatatcttattcagttcctagtcatcttttctttcttttgctttttcttttttaaattgttaagatctgccataaaaatgtctgtcagagtaggcatgattgcatattctttagatggatgggtggatggatggatggatggttggatggttgggtggatgtatggttggatgattggatggatgatggttgagtgagtgggtggatggataggtggaaggatgaatggatgcatggctgagtggatagaaggtggatggatggagggatggatggttggatggttggataattggatggatgcatggatgtttgggtggatgaacagatgaatggatgcatggatgaatgagtagttggatggatggataaatgatgcatggatagatgaatggtgaaacttttatattttactaaaaatctgcattgatagcctagtggcttgctaaaaataagggagctgcccaaatgccccatttcctttatatacttgtggagcagcagcgaaggccaagccagtgccaggggctggaaacagacacataaataagaacaaataagatacagacctgacctcaatgattttttgatatagaagcataggcacataaataaattcctgtaatgggagtctagggtgaggggtggtgggtgccataataaaaattatataaagtgctatggggaagcaaagctacatgaccaatttgttctatttatttatttgttattattatgttttttgagacagagtctcgttctgtcactcaggctggagtgcggtggcatgattgtagctcactccagtcttgagctcctggactcaagagatcctcctgcctcagtttcctgagtagctgagaccacaggcacgggacaccatgccagtctaatttttaaattttttgtagggacagggcctcactgtgttgcccaggctcatctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcagctggaggagagactgcaggggtcagagatcagggccatatgctagagctgcaatgtgggtgctcaaatgatgttcagtgcatcttcacagatggacctccacatgtccctcatgccctaaaatagatattctccacagctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctatttttactggagcatgtgagggtggatcacaactaggatggcgcgaagttcacctcgtgtaagcacaccaggctgcagggataataactgcactttttaaaaccagcaaatcattcatatttactttatgaaacctcttttaactttattttttatattttttttattttcttgtttctttttatttttaaaatttatttttgttttttttgttttgagacagggccttgctctattgcccaggctggatggagtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagtttgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacccagctcatttttttttaatatatatttttagtgaaggcggagtttcaccatgttggccaggctggtctctaactcctgacctcaagtgatccgcccatctcggcctccccaagtgctgggattacaggcatgagccaccactctaggcctgtatttgttttaattgattaatctacaatgacacatcatcatcacctaaagtctataggttcattaggttcacagttggtgatatatattctgtgggttttcacagacatggaatgacatgtatctatcatacatcatatattgtatcatatcatatcatgtcatatcatatcatatcataccgaataatttcattgccctaaaatacctctgttttcactttttaatctctttgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaaattctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgaatgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattctatctctaaaaacttaagtcaagggattttgaagcagttgtttgatttatgtatgtgaacctctcccttaggagaagaacttttctttggcaaacaccataggaacggagaccttaacaaaagaattaggactctcttgtcctgttttaatctcaaagctgtccctgcgctggtgcggctggcccacttgtgcctttgtgaatttgcagagaagaggctgggcgtggggggacacatgactaatccgccctttcttttgtttgtgcaacaactcaattcactgtcaccacatcagcacatttgctgcaaatctcagtgccctctcactttcgttttatttaatgcgtttctacattttcccaaggccacatgagctgttttctggcgcgtggtatgcctgcctcaaataactaacattgcctgggtcttggaatctgagccttcatattctccgatatattatttggtcctattgttccttaacttgctcatcattcacacggcgaaggaaattccatttggtccttttaagaccgccagactagctgacttaaacactcagctccagctacttctgaatatttcggttctttattgaaatggtccttttaatgtcatctttaatttaatcaaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatggtgccttgcagtttccaaagtaagctgaacagtgttttttaacagtgctgcccctctctcccactagaaatgcgagtccatccttttaccaagtgtggtacgacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttggggtagtgggcacaggggaaggaaggttatgtaattttaaaattcttcctttgattcaaaagaaaaaaacatgtttgttgcattcaactccaaagggtgagcatagcttagtggggagagatttggactaaaaaataagagttctgggttcaagatctgaggtaaattatttgctaggccttagtttcccatctgtgaaaaaagggagttctataacagcaagacatttaatattaaaataatgtaatgtttttaaaaatgcttgtctacccactttttcttgagattagtaagaccatcttccaattagaatgtttatccgaacttaccgctaggtatttccttgtagagtatgaaagtaaaatatcaatgggccatctctacgtcaaggttctcgttcttctcattactgagaaattatgttcctggaataatattgtacagacttagaaataagggcattgaacttaattcatttatttttcaaaaggcatgtattttttacctgttgctatatctgctgccagccaagtgctgtgcttggccctgagaaagcaaagagagatagagatgtccatgttttggaacttgacgtccattaggggacataaacatttgaaaagataacactaacaagctaattcaggtatgataataaaaaccttcacagggttagccatccatctatctgtccatccatctattcactcatgcattcatccacctgttcatccattcatctgtccattcatccatctatccatccatctacttctaggttgtgagaacccgtagtattgactctcagtgtgataggaaggccagtgtcttggtgaaagatcaaagagctcatcaaaatttgtcggatagactgcaggctcagacactgatgagacccccctgcaactaccacatcaaaaggcctaggagcctttccatgaccaaatgcccatattgatgaatccgagacaagtgagggaaagatgtcctctgtcggtgttctgaaccctgtggaaatcatacggggaactataaaagatcctgatgcctggttttcttctggagagtctgatttaattggataaggatacagcctgggcatcaagagtttctagatgacctaagtaattctcatttgcaaccaaggttgagaataaagggtgtgtataaggtgagagacttctggttaactaaaggaaataccaatgacatttgtgctttaggtctaccagttagtgggtattggtgcatggtgggacagactaaatggctacaggtcagggtcattgtcaaagagtgagggataaggggttgtgctgtggctcagaggcagagtagactgaggaagaacagctaattccagaaagccatgttgtggtgtaaaagatagtacctgacttgtaatgtctgacaccaaaaatgaccttaatttgggtcataggacaaagacctccccacctccagctatgaaagacagaaaatgataggactaggcttcatattttctagcgtaacgtttggcttgtggtatattcaaaactaagtccgtgtttgttgctgctgagtgactgggctgatactacctgtccttcagccatctagacttgctctctaccatcctcaatacttcatatgaaaggagactgtcacttcatgaaaatcatttatttgctttagcttaaatctactggagattacaactgcctcattttgtcaccttcttaccccagaaggaaatatctccacaagagagcaggtatttattgagttatgactgtcaggcatggaacagatccattggtcagaaataaggaaattgtctctaccttcaaggttctcacagtctggagggaacagagagccatcagggacaataggtccctgtgccatcagctactgggatgtatgactttccagtagaggtacacagcacttgttccaaaaggagcctatgtagctttgggagttctctatttagtcaccttattttttttgtcttcttgttaaactagcatcctgttttactgaatctctgcctcagttgctttatttactgtatacatacatagctcttttgaagacttgatgtcaaaagtaaagaagttcagaacctacggggcttgctttgggtcccaaattatcttagctttctggaaagagaagaatctataatgtattctccatggagtatctttactcacttgtgatgagatgtctgtaaaagtaatcagctccatacatctgggcatgatgaccctcaggcccttgagactcaggtgttctcagctcatggtgcaagttcccctgaaagaaagactcaagccaagcattcaatggttatgttccagatcatagtctcctaaaagccaggggtcctttatgcagggatggtgacatcagaagttaaaaggtctatgcagattaacgaggaaaaatgagggaaattactgtaaggtttttaaaacatgatagttatatatgaactgatgattatataattgaacgtgcctaaattgatgtagttctctgtaaaactagttggtgtaaggaaacttggtctttgaccatcaaggaggttgcagtttgtggcatggcacaaagataacactcagcagatatatagctatgggatacatggatggatggatggatgggtggatggatggatggatggatggataggtagatggatggatgcgtgggtgtgtggaatggtgggtggtaggtgggtacatagatggatgtatggatgggtgggttggtgggtgcatggatgggtgagtaaggggggataaatgaaaggcttgttcttctgaagggactctttacaaagagtctttgatcttccagcttcacgtgcaagagaatccccaaggtgagcttgttaaaataagcatattctgggtatcacttcctgattttctggttcagtaagtctgaggaggaacttggggaactttatcttttaaacaagtacctcaggttatcatagtagtcttgctgtcctgaatcttaatgcatctctatttctgctacatcttccatgaagttgattttgcagaaatcattctgtggttccacattgactgcatccaagacctattgccttcagatttacatcaagcacaatttggcaggtattagggatggacccagcagccaagtctttgttgccttaaacagatcccttgtctcttgtcaggacctccttccaggctgctcctgagcaagtctggatgtgacttctacctatgatccagtgggttgggccataaaggagctttggaaagggacagtcttagggtgaaaaagagggagaggcttgccatctgaacaggaatctctcccagaggagagaagagaagcctaggctttaatgaggacagccaccctgtggatgactttctgtgtgatgttatgtggaggtggcttcttttttctctatcccattagctgaattctgtgccagaaggaagagatttggagtcagcaaggcatccttttttttttttttttttttttttaaaaaaaaaaaaaaagaaggaatgtgattgtgaaggaagcaagaaaaggcccaaaggctctggacaagggctaggaggctgaggagttttacacattcataatttccttgtaggccaagcttactctcagggatgacagtcattttctaagaaagtgagattgcttcacattgcatttaaaggcttaaataatgtattctgtcagacaattctctgaaatggttttccaagtgaatgcatcagaaagtgcctagaaagaatgcctggcacaggaagaggagggcattcagaaaatgtgagctgcttgcatcagaatctaacttgagatgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatataaatagtcacccagtacgcattctttgctgtcttgcttcttttactcctcattaggttgtgggatttgcccacgatatttcattctttattgtcattcttctttctctgccactgccatcctaccaacagtttgtattatgaaaaattgcagacgtacacaaaagttgaaagaattgtactgtaagtactctgatatgcaccacctagattctacaattaacatttccctctatttgcatctctatccatttaccattcctcttgtctatccatcagtctatcttgattcatttcaaaataagttgtaggtcaggtgcagtggctcacacctgtaataccagcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacacagacacatattgttttttccattttaagatacagaaagtgggccttaaaggtgctactgacttgctgatatgctttggctgtgtccccacccaaatcttaacttgaatcgtatctcccagaattcccacgtgttgtgggagggacccagggagaggtaattgaatcatgggggctggtgtttcccatgttattcttatgaaagtgaataagtttcataagatccaatgaatttatcaggggtttctgcagtttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaacatatctgaaaatgtggaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgactcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgacagaaaagaaaaacccattttctggggagaaattcaagctggctgcagaaatttgtgtaagtggcaaggaacctaatgttaatctcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaatgtatagctcaggctgtggcttcagagggtggaagccccaagccttggcagcctccatgtggtgttgagtgtgtgggggcacagaagtcaagaattggggtttgggaacctccgcctagttttcagaaaatatatggaaacacctggatgccccagcaaaagtttgctgcatgggtggagccctcatggagaacctctgctagggcagtgctgaagggaaatgtagggctggagcctccaggcagagtccatactggggcactgcccagtggatctgtgagaagagggaaagtgaactaagctctttaaacctcatatgtttccatcagtaacatgggaacaatagtaacaattccacagagatagtattgatggttgaacaagatgtttaaatcactagtaaaatttggccagacacggtggctcatgcctataatcctagcacgttgggaggctgaggtgggtggagcacctgaggtgaggagttcgagaccagcctggtcaacatggtgaaaccccatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctagcataaactatgttactcaacccagttctgtcgtcgtcatttttttgtgttggctttgcccttcccgcattgtgacttgatcccatttaagcagcaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaattttggatacactgtgtgaccagctctgaggattccaagcttttttgcgtggcttcttacctatcagctaaagaacctagctttacttatccaacttagatattaaatcccatgatataatttatttttccgtgtgaaatatctcaggaacaaaaaagtcaggttgagttttctaaaggcactggtttaagaggctataggttaagaggagataacagacatgctcagaaacaaatcatttcctgatagctgtttcagatggaaccaaatggaaaacagtgcttctttccgtttactgtacaccccctatcctggcatctaaacatatttgtaatcatactgtctatagaagttttggttctgcttttgaccttaacactaaaatacccttccataatattataggcttttcatgtacatcgtttttaagatggctataaattccacttagtggctatgactgtagttttttttttaactcttcccctaatagtgaaaatttagattgtttctaaattttccttactataagtaaggctaaaaagtaacatgtgaatgttttgaatcaataaatatagtatgtattaataatattgagctatttcttaagattacattttcagaagtaagatcactgagtcaaagggtgcacactgtttaaaggagcttaaatatattgcaaaactcttttcatggtctgctgatatcactgaaaatggaggtctggattcaaatcacatgtgccaactgttctactttggcagaattacctactgctttgggcctcgggtactaaatttgtgaaatgggaaaaataatagttcccacctcatagagttgcagtggagattgaatgagtttgtagataaaaagcgtctgcgttgtgtctggtacatggtaaggggttcgtaaatactgagttatttcttattaacatttattattgtctccactggaagaagagcctgtagaatatgcagactattcaaatgcttcctttggtccattgttgtcctttcttttctcttctagaactttccccatagtcatgcatctgtccctgggttatctgatatgtgtttcagcctgttttcccaagtttacctgcctctctgagaagcccatcagccctgagagatacctggaaggaaagaggaaaatgcgtgattcaaatcatgttgcaagtggatgaatctagccccaaacaactgggaggcaactactcctgcctgccgaggcctttttttttttttttttttttttttttgagactcactctgtcacccaggctggagtgcagtggcatgatcatggctcactgcagcctcccgggctcaagctttccacccacctcagcctcctgagttgctgggaccacaagtatgcaccaacatgcctggttaatttttgtggttttttttttttttttttttttcctgctgagatggggatttcaccatgttctccaggctggtttcaaactcctgagtccaggtgatccacccatcttggcctcccagagtgctgggattacaggtgtgagccactatgcccaataccccctatgtagacttttaaagaaatacaggaaacagccaagactggtgtcattcagatttagcttgggagagtctagtgggtgttaggttcccacaggatgaaggatcaccatgaacggtcaggacctgacttaggaggactcagaagctggagactgcagaggatggcacagagttccaaatctttggggtgtgtaagagtaggagaggcaggatgggagaggatgggagtgatgccacataaatcaactctgttgcagcctccggggccacatcagtagctgcaggaggaggagggaacagggagacagggagcctttcttcctttcctcacccccagttctgtgtttatacttctcatttagcccataccccactatattaaaagaagatgtataagtgtatgtgtttaatctaccattccttgtggcacagtgcatggtctgcatggcacagtgtgtggtctgtatggcacagtgcatggtccgcatggcacagcgcgtggtccgcgtggcacagcgcgtggtccgcgtggcacagcgcgtggtccgcgtggcacagcgcgtggtctgcgtggcacagtgcgtggtctgcatggcacagcacatggacatgattcatacatgcaagtgaatgagtgaatgggcgatttccagactatccagaaactgtgccccatagtcctacccgtaggaatccaacagggaactgtcaccaccgacccgaggcaggaaccatgtgctctgagccctggccattttgtgtagatggagataaattgtcattgctaattgccagagaccaggtcctggtggtagccaaactgttccctagggagttctcaccaaccttgcaaaatgagatggcaatcttcatcgtggatgcaattatgtttcattgttaaccatcacaagcaacgggacattatgatgactgttataagttggtttcacatgtaaactttgacctcagagcaatggggcaggcttttcccaaggaccctgttgagaggttcatgatggtgacaaaaagcacaagccccagctgccaaggaggctgatatcgggagaggcagaatgtgtcttttctttcttcttcctcttcttcttcttctttttgaaaccatgctcattggttttaggaatcattagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggccccagtggcccttgtcttgttatttcctccattagagacctggcgtataattgtgggagggagaagccagtggagcagtcaggggactccctggctgtttctgtgtctggtcttatgggtctgggcactgaattcagtcacaaaccctagcatgctcctttgctacctcaggggacaaagtcaagaaaataacactaggattgccaccctgctctctctctctctctcttttttttttttttctttttgaggaagggtctctctctgtcacctggctggaatacaatggtgctatcttggcccactgcaccctccatctccctggttcaagggattctcgtgcctcagcctcccgagtagctgggattacaggggcacatgccaccatgcccagctaattttgtatttctagtacagacagggtttcaccgtgttggccaggctggtctcaaactcctgacctcaagtgatccaaccgcctcagcctcccaaagtgctgggatgacaggtgtgagccaccacacccagccactctctttcaactagaacagttcctctcttctttgttgcatatttttgtatttcatgcaaggtgctgtttatgaacaagggagtttcctgcagctttaataaagaagagaaaagaaaagaaagaaaggaaaattcgcatgttgaaaacattgtactaatcaaaaaagccagtcacaaaggaccctatgttatatgatttcatttacatgaaataccccaaagaggcaaatctgcagaaacagaaagtagagtggttgccaggggctggggatggggtgtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactttctctagttcactgtgaatggtttttgaataacatcaattagcataacctcatgcccagcatcgtccttattgttgagagcacagcagtgacaaaggtgcaactcttgctcttgagcgatcacagtttatttggggaacctggtactacctaataaaaccaggggagactcgacccaaggcattgtgtttgagctaggctttgaacaatgtatagaccctcaccaagtatggaagtggaagagtaagacattcaaggtagaaggaacagtatgaggaaagtcagagagctaacaaagattatagtgtaatgccagaatcatgagaaatttgctgagaattcatttgaggccataatttaaaaagataggaggagccatgtgtagaactttcacagaacagtgtgtacctcccctccttcttccttattagtcgtgattcttggggggcaactaaacccagcttttggcaaaagggagtatgttggttcatgtaccaggaagtcttggagtgatggcttcaggcacggctggatccaggggctcaaaaatataatcagatgatttgtttgcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtatatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatgctgaaatcccatctctactaaaaatacaaaaattaggtggcaggcacttgtaatcccagctactcagaaggctgaggcgggagaatctgttgagtccgggaggcggaggttgcagtgagccaaggtcacgccactgctctccagtctgggtgacagactctgtgtcaaaaaaaaaaaaaaaaaaaaaaaaaagagagagataggctgtttaacaggtgtcgtaggtcatgtatctacagccatggaaagagaatggagcactctaatggatccctgacgggtcaaatggagcaaagtgtgcttcccagaagagcataagaaaaaggaagggtactgggtggaccaaatctattgttacaatatcccttatattccttagggttcctttttttcaagttaaagcattgagtcatgtctctgataaatcgcccccccaccccgatccccaccctctgccgccccggccttctttttgtgctgttgggttccaaactttacctgaggattttcacatgcacatctgttaaatgccatttaaagagaacactaacaagagaaagctagttcatttttcttcctgggacctcagtttcctcatcagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgccggaaggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtgagcgccgtgtatttcaaagcaggatcttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgttccatttacattgaatggcacatgtcataaagtacataccgctgcacatcccaccctctgtttctgtttcaactgcagagcctatttttctttcccttccagctcagctgccttctcctccctgacctcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagacccgtaattgattcataagatcccttcctccgatcgcattgaagagttaattatttttcctgcagttgggactcagctgttgtttccactgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgctttgcagaagtccgggctgtcatcctggcgtttgggtacttatgttccctagtggagacagccgggtagactggggaaggtgataaaagggagaaaaatagaactgttctagaacgatctccacttttaacagcacaatacagagaacagagctactcaataattagccaaccaagtatgaattctcatatgttcttaaagtatctgctgatttcttcaaacatctctaacaacatgtctgatgaatacgaagcctccctttatttatttattttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaaaagtaaatgaaaagtatttctgggtatttttaatgacacaagtttctgtgctgatatgcgggcaggggttcgggagtgggggcaccagggctcatgagccgagagcccctgcttcccttggaaaacggaaatttctatctccaactagggaaaaatttgcatgtgtagaattttggttttttcttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagagaacggattcttttggatttgtgttagagaaaaactgtctctaatgaccgcacagcacaaagcaaagcagttaaatgaataaccgccttccagtacagataataaagcaggagaattttgtgtgtcacatcaataaacatcttaattgaacagcacgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattattgcagttttgttttttatttagcacaaacctaaatattacacgtagcaaatgtcacccgatgcaactgtctgtcctgaagaggaggacagattattctgtggctacctaatggtgtttacagagttgccactttgccaaaccccaagacccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccttgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactctggaccagaattgattgccaccaataaaagatactccagtccttaaaaagtcaacattgttatgttttacttagttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgtggtcctggatgaaaataacactggaggtaagaaaccttggcctagagggttccccaacctttttttttttttcattatggccccctcccccaggagccttttgagatacgactttcctaatggtctttgcccatgaaatctgaataccacagatgtgctgaatgcctgttcgtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcaagatggaattcagcctttcagacaattctgccaggcccttggagggtgggaggaaacaggcaagacctctggctcctagaaccgtaaggacccttgccattaggaccaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgtatatcctgcaccgttcctggcacagagtaggcactggataattatttcttggatgaaagaatgaacaaatgaatgaatgaatgaaagtttttttccttgcaaatctccctgcacactttaatcttaccagcatcttgtgaaacactcctacttctttctgatctttatttcttacgtagttttgaaatgagaaccgatgaagctgcttttgctcatggtacctcaggtcctcgctcactcccagcactcagggctgtgtggtcagagtctcagattcggagcatgtgatgtgcgtgggcctgtgactaacagccacatggcacgcaatggtggcagcctgggaggctgactgagcaagtaatttctgcttaagcaagaacgtgaggggtgatgtagttgcatgcactttgccatcatagcttgatctaggtctcagcctgggatcttgcagctgcgaaaagcatggcgttgcgtttccaagcctgaacatccacacccgcgaagataagaccatctcttggattaatgtgacgctgaaataaaataatccaaagagaaaatgcctgagacccaccaggagctcaccagatactacttctatcttccccactctaggtctttttactgcaactaccgtttaaaatactttttccatgaggcagatcttagtgctgacagtgtcagtgtctttaatgcctggttcagttgcaaacatggagggcagaggtttgatagcatccaaagtatgcacgccgcactccacctcccatgcccttttctttttctcagggccatcagaaaggaagtaactggcttagatttgacacctctttttttgttcgttttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcaactgtttgttttgaaccacttattttggcaagacttcttcagacaggagagccctgagagctcttcaaaggctgggcctgatggtgtttgtcagagaggttcgagctcttaaatttaaatggcctcccacagggaagcagaagtccttttggatcctccagaggactgagatcctccagatgctgttcatttgccttattcgttatgaccatagaagtttgtggggtggcactctttattctgtcctcgccccgcaagcaaagcacacaccacaagctataaggagatgagctcagtaggcctgtcctttactttattttccctattagaatcccaccatagacgccctctctgcatgtgtccttgtctgggggagtcgcttaatttcctttttctttgaggggctataaaatttttgttgttacaaaaatgaaaggggagaggagatagaagaaggaaaacagtgaaagctcagcctcgaaagaagtgcttaaaggaaaggaggttctgacagagggctcggatcatcagcaggggcagggggtgcagggggtgcctgcaagtctgtgaccgtcctgaaggacccccttcctaggatcccaaacatgcactcccatcccagcctcacaccaagctcccatctgggaagcagcagacacacataaaagcaaggaaacttcaaggacgctttttgttttcccctacttttaaaaaattgaggtgaaattcacataatataagattaaccatttcaaagtagacagttcaatagcagtacattcacaatggtgtgtaaataccgcatctatctatttccaaaatatttgtatctccccacaataaaagtctgtaccaattaagcagctactacccattcctcttccctaccattctaccttctgtctcagtaggtttgcctatttgggatattttatttaagtgggatcatacaatagcatcatgtgttcaaggttgacccacattgtggcatgtatcagtacttcattcccttttatcactgaatagtattccactgtatattgataccacagttggttgacccattcatccatccatgggcatttgggttatttccacctttttgctcttgtgaatccatgctgctgtgaataattgcatatgagtatttgggttcctgtttttaattatgttgggtatatacctaggagtggaagtgctgggtcacgcagtaattctttttaactttttggggaaatatcaaaccgttttccacagtggctgcaccatgttgcattcccaccagcgaagtgcaggggttccagtttctcacactgtcaccaactctgtcagtctattctggcactgctataaagaaatgcctgagactgggtaatggctgaagaaaagaggtttaattggctcatgattctgcaggctgcacaggaagcatagaagcttctgctactgggggcgcctcaggaaacttataatcatggcagaaggtaaaggggaagcaggcacatcttacatcgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatccaaaccttatcaccagcgcttgttatttcctcaggtacattttgatgtccctccccactttactctcccctacaccttgaagcaggtgcaatcattttaggctatgaggaccagcatcgaccttcatcagcatctgctctcctttacggccaggtctccttcgtcctccctgctcagaatttcagtctttttttttttttttccctatacagacacaggaagtatatattttcctctcgaatatcacttgggtcttatcttgttttatgctacatgcatgtggcttcccccgttacaaaaagaattcacattattagagaacatttggaaaacatacagaagtaaaacaagccatccccattcccacctcccagagataacgcctgtgttttagttcatctccttctaacctttatagttttttttctatcatattagttaggcattggtttggctccaagtgaaaactgcttctgttattaacatcagcagcagcaacaagaagagagaagtttatgtctgtctcggaatacgtacgtgacaggctcccccatcgaggtgctcagatatggtggccactgcatgattttgctcaggactgaattagaggcaggtgaaaggccctcactccctggaatcagctagcgatggctaaggctcctgtgagggtttctacagaggttccacccagagaggagagtcaaatgggagtttctaccgatgctcttgaaaggatcttgttactcagatgtctctaagacaatgatcagtacccatctctcagagcctgtgcagccgtccatgcttgaggcatgagatgctgaagataaaggtccccagtggtccaggtttttccttctcagcttggaaagcagcaggaaaactgcactgcatttatccaaagggtgtgattggtaagtgtgggtactgatatagaataaatcaacgtggctgggtgcagtggctcacgtctataatcccattactttgggaggccaaggtgggtggatcacaaggtcaggagattgagaccatcctggctaacatggtgaaaccccatctctactaaaaatacaaaaaattagctgggtgtgttggtgggcacctgtacttccaggtgcttgggaagctgaggcaggagaatcacttgaactcagaaggccaaggttgtagtaagctgagattgcaccactgcactgcagccttggcaacagagcgagactccatctcaaatcaatcaaccagtcaatgtgtgcccccttttcctccaactcccaccccaaatccttgctgaatcatacctatccttcacctttataagcatctagtttttaaatctttgctgtgaagttggctgtgtgagctccatttgacagatggaaaaactaaggtagtttgccaaagatggctctttgccttcaggatttccatgtctttattttgagtaaacacttgcactgctaattttattccaacaatgtccttggaatggttttagttctcttggctgtaaccaagtctacacgataccacttgaattgacaacatcacagtcaaacctcaattttcacaattaattgtgccgcagttaattaaattgactgcctggcaatccagtctcaattaaaatactaatagtttatttatttattttgtcttttacgaagcgttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatcctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcactttcctaaactctgcatgtggtctccatgatgtcctggctgtgttagcatcagaaatggctttgcccacatctcccaactctgccctcttattaggatttctctgcgctggctgatgcctgagccatctaatgatctttacgggaataaccaaaaatgctgggtggggggggaaaacgccagcagatctctttagggcagagtagggagggacacggacaatgtgggcagctgtccatgcagcacgtatcacatccaggatgatgtttatatgaagcatcatttttttttttttttaggtggagtcttgctctgtcatccaggctggcatgcagtggcacaatctgggctcactgcaacctccactttccgggttcaggtgattctcctgcctcagcctcccaagtagctgggagtaaaggcacatgccaccatgcccagctaatttttgtatttttgttagagatggggtggccaggctggtcttgaactgctgacttcgagtgatccaccggccttggcctcacaaagtgctgggattacaggtgtgagacattgtgcccagcttggagcatcttaatttaagccctctacatccctgcacggtagatacaaccagctccgtttccaaggacgaggagcaacagagtgaggtcatttccctgagttacactgaagatggtctaatttcaaagtccttcctgtgtccactttgccaggtgccccccgaaaagcaagaagactccttcaagcatcctgaagatttggatgctacaactgtatgtcctgctggagagaccctcccagaacattgaaggctccagtgttttgactggcagaatctcagtttcaacatctgtctctaagggctctggacctatgctgggtgaaacgtgttgtctgtaggatttggcccatctgagcctcactggggatgggctaaactccgtggggtttgtattccttctccttcattgctcagaggaaaagaagaaaaaaaataaaaagaaacgaccccaaacagcctctttcgtgcacacacgcctaagaaataggaacatgaatttgcattccttccaactggtgtgtttccaaaatacagacaggcaagtttgaatcactttgactttgaaagcgtgattttgagcaattatctggggaaaaaaatacctcctcttcactaaataagtctgtcaaaaagagtcatagtacagcgtgccattgccagaatacacgtgtgtgctggtaagctggccccaaccaattaaatagtgaaatgtcgactgcattcaggcccttcctggtctgcagacagacttgtgttagttcattttcatagtggtgtgtatgtatctttagactttaactgacagattcccacagtgagtagagtagggagttatcaattacatggttagctaggcgctgctattgtatgctctatggcttcttgacaggagcaggcagagaaggagggaaggactaatatttctggtgcaggaggactgttaatattttagaccgggctcctcaaacatgtatgcttatttagtgaggagaaaatgtgcatttgaatcctgcaaaccctcgagaagtttgcattaataaatagtgattaccagaatattctcttctaaaatatattttatttatcaaatgaatacccttctgagcccctctttatccttcctgtgatggctaaactaatttcatcaaattttgatttctgtgtggtgatgttgtgaacagtgcctgaaataataaaattaccctgagcagattgcatataaaactgtttgcaatgggagaagcagtctttggggctgtggtttcctttggctgcagtgtaatatattcctttgtttcttttgtgaagtatttattgtgggtctcctgtagtctgagtttcttgtggaagtgggcttgtgttttgcttttgtagactgacactgagaatagcatccaaacatctttttcccaccaaggcatcaaactccatcattaggaattccttcatagaatcaaagaatcagaaagagctgaaacatagaccacggacactcaaattgtttatcctgaaatgaatgggaaaacctaagctgaagaaaggaagtgtctggccaagaagctggcgggagagtagaatcaggaaccagggcctcctcgtatctggtctcacgcttcttccgtggtgttctttcttaagttgagcattgcattctccttggataggatggatattttcctgggaaggatgatacatgatgtatttatccataaaactgaacaggtgttatgtgtgccttttctaataggaaagaccatcatgctatgaaaagagaggaaggggagaagaaatggggtacgttaagatctcagaatgagttgtggggctaaatgttcagcctgtctcccttttctccttgccacaccactagattatattttctagactctcctggtgttagatttggccttgtgacttccagccaatggaatcggctgcaggatgaaactagtcttgatccctgaatgactgcgtggagcacatctccttctggtcaataaggcatttcaggagtgagagataaacttctattgtgttaaacccctgtgactttgagacatatctcctacagcaggtggagttagcttaactaatgcagaacgataggactggtgaagcagtccatctgttatgagagctattctttttttttttttttttttttttgtgagatggagtcttgctctgttacccaggctggagtgcagtggtgcagtctcagctgactgcaagctccgcatcccaggttcacgctattctcctgcctcagcctcccgagtagctgggactacaggcgcctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtctggtataaccatgtggcacatacccctgtacatgtttgccaagactgctatatggtagagcttggaattcttaggagctttatcaggtaattgcaagtcccccacctccaagaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaatgtttctgtctcaactggttgattggaacaacatacaaactgacccttaggaaccttctaccaaaaatatcctgtgaatcttcatacttttgtaatagcgtttagttagaagtggtcagactttcttcgtcctcttttcgtgatttcctctgtggtgtctgtggatcgataccggcagctcaggtaaggaacgtgtgcaggggatgtaacagaaaggagaaagacgaggaagaagggtgcatggagcgtgcaggggaagaactgattcttttttcagttaatcggctcatcaaggttctggtgttgaagtctgatttcatttgccatgttaagaggatatggacagatactgggcaaaaggaaaaaaaaaatattggatccttgcccagctccaagtgttgctgagtcccttgccccctccaccccgctctgtcaggagccaagctctggccgcccagtttttggactttgtaactgtttccgaacggatcagattccatctgaattgcagatggctttagccccagcagcagaggctgccatgacatcggcatgcgatttcttccaggacttaactctggagagagctccatttcctgttgatcatgagggttttacaggcacaaacgctgtcttctgtcactctgtcacagtgcattatgtcagaatagaggaagcagttcagcccgtaaatctgtgccaccggcacgcagggtgttgtgttgtctccaatgtgccttgtcaacaccacagggctaatagcagtgtcagggtccccgtgccatgaatcacttcacatctctggctagtacagatctctccctgtcactagtggaagtcgcctgcactacattcagaataggggccaggcgtggtggctcacgctgtaatcccagaacgttgggaggccaaggtgggaggatcacttgaagtcaggagtttcagaccagcctgacaaacatggtgaaacccagtctctactaaaaatacaaaaattagctgtgcatagtggtgcatgcctgtagtcccagctactcaggaggctgaggcaggagaattgcttgaatccaagagatggaggttgcagtgagccaaggtcgtgccactgcactccagcctgggcaaaagagtgagactccatctgaaaaagaaaaaaaaataggcacagacaatttacctggatcctcacattgcaatgctgaccactccggaaggagtgtagaagttgcagctcatgcctgcattccaaatggctgccttctgcagtcccgtcagccaggatccctctcatacaaacaccttgactggccgagaaatgcagatgctgtgtcaaaagttcatggctcagagccaacaatgcactgtgctgacctccaattttccttgaggaggggcatcccagggtcagaattttatgcaatgcaagcttgtccacgatggcatgggagcgtgtgggaatgtcaagatgaaccggggctccgggagacatttatggagtcaggagcacacatacattcctggttctgtcagcatttccctaggcgagatgagtcacacatttatatttttacatatgcagcgcgcttgcaattttccactggggaagatagaaaaacttattgaaaatagttaatcagttttacaaagatgccataggtagaggtgcttccagacctatagttttgaaagtcacctagaggataccagtctgactcagagctttatgaaggcatattcctaatatcctccctgtgctccacgaagaacaattggtttggacatgaactggtttccatttttagactccaggcccacagtattctaagtaggttggggctgtgctgattgtaccactctttggattttagtggattttctttttaggatttcatgtaagtaacctgtgcagagagtgaggataaataagaacaagaatgacaaaccgataggctacttgacatcattccttaattccaggtcactggcggacatcactcattcatcagtactctgtttttctcccaagaatggatctgactcttgaattctctttaatagagtgttctgggaggctgttaccaattgaccagggttgatgcacatgttgaaacatctttgccatttcttgatagcttcagaagagattttaaagtactattattttgatgttgttagctttcaaagattaattccacagagatttttgggcatctttttgataatacacattatgcttgacttgggagtttcaggatgcgcaagagactccttttgactgcaaggactcagtaaaacaaagtatttcaaggtcatgctacaaaaagtcccaccaagagcatggtcaggaggtacagtgcacttacccacacggatcagagagggatcagaggaggctggctggggaaatgatcctagggctttcttaaaggacacagcgccatggttatttaagtacagcttttaaggagaactaacttgccactttgatagcagtataggactccaatatttctcatttgtaattttcagaagcacacgggaggtctttgaaatttaatgtctccctgcatcacaaaccaaaagacgagtcagtttataagtaggctgtgcttattaactcagtcctggctttattgattgctttaggttccatgatctttggcatgtgagtggttttgctttgttttgacaatgatctttttgtaccttgtatcgggtaggttggaatgtgtttgaaaatttaagaatattttcctagcaaaggcaggatttttcaagtttgttcatgctggagctcctgccacgtattttgtccttttttcttttttctagcaactctcgagaggatgagacaaatggattgtgaaactggaaggagggtttctcattttttaatccattgttttagtgagagtttaaagctttcctataaaatatgtgggttgagaaaaattggaaaagacctcttcaaggactttcctctatgctccctcatgtttcaagtggcttttttgcatgatggtgcatatgtctttgtttctgtacagggccctccatgttcagaggcagagtaacgtgaattcatttcgcgctaatgagagttgcgatatgtcggcccaaactctctgtgtccttttcttcttgggctgatgaacttgtcaacttttaaaaaatgtgctctccaaaaatttccagcaggactttcccaccttgctgtttaaacagtgaatcagccctgtgggctttgctgcttacaacatgattccggtgaaaccacaggtctcgtcatgtcccttctgtatccatggtagtcccagtgggaaagaggtaacaaacccaaattgagtaatttcaagaaattttaataacaaaggggctattttataaagggggggtggtcaaggtgtagggaaacataaaagagagcgaatttctggtctggtgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctactcgggaggctgaggctggagaatcacttgaacccgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaatactccctctccccaggagaggtcccagcggaataaacatccccgccccttcaactctttgccattgttcaagccctgctagaaaccagatggcaaaaggaagttactgatgtgttcatattggtcaactttttcaggcacgaagaccagtacagaaggatggaaagtgcatttgggtagggaaatgggagattcctgcatagctgtcaagttagtttcttcccagagagaaagaccggtggctgtagtctgtgccccactcccagcctgtcctttctcagccgtggcttgtgtgcatccctggggccggcatgttgctgcgagccccaatcgatcagtggagaaacgagctctggtgggcagtcaggcaaagcagatacacgtgcttcttttcagctttgttggaaggtttcattttgcttcaggaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagatgctgaacccttattgtatctccccagggttagtgagtaattgggaatagtgttccatcttggatgcccccatccactaaccagctttcctcttcgggtggttctaagaattctaattcaattagaaggccttctttttagtttgattagttcaatatcaagagctaaatacattagcttatatatatgtctgatgaactcatctttgcttccttggatccccaagatagaatggccctaatgcagtcaaaccaccctgcagaatcttaacagcaccacaaatattgcatccaggcatcctgcccatgctggcttgcaggctggggatccctgtccatagcgcccatggctccaccaccagtcaaaggtagtggggccagcagtggactcctgtgtggttcagctctcaaaaatgtgaactgaaagacacagaaaaagacttgtgtttggggataaatactgagactgagcagtcttgtggattcaggaattgggcatccagttgggaccctttgcaagaagggtgttagggagcagagagcatgagtaagccggaagcagagcaggagagagaatggagcaggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccggggcgagcaaattgcttgaactcaggagttcgaggctagcctgggcaacacggcaaagccctcatctctacaaaaaatacaaaaattagctgggcttggtgacagacgcttgtagtctcagctactcgggaggctgaagtgggaggatctttagagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctagggaatggctgtctagcttcagtggatttccagggtccggagctactaaaggtcaacagctgtgttattgcaaactctgtggcctgcattctatcaatgccaaaatgcacatcacactgacaacagctctttgtttacaccggggagcccccaaagccccagggtaattccatcaccacccaagttgtaagatggtagagcgaacaggccagaatgtgataaagtaaaatgaaagaagaaaaaggaggaaggaaaaagagagagggagaagcacatagaggaaagaaggaagaaggaaggaggaaggagggagggagggagacagggaaggaaggaagtctggcaagagggcacagtcagacctgccaggatccctctgctgtcttaatcaagctttgcctcagtctttctggactgaatttgtctctgtgttcacttggcattttttaaaaggagacaaaacaggtgatgaacacagcatgagtgatttttcccttaagagagaggtgtcatgctgagaaagaagaaccgacctccaggggagcttgtcttcagaccaaaaccctggcaaggacagcctgtttggatcttggtcattttgttagatttataaagtgcctttgaacagagcaggacactctggggacaagtcaaagcatggcagccttcagcttcccaaagaagagttgtggagaaggaaaagtgaaggaaagtaccttactaagtcattgatggcacattcagcccttgtcaaagtcaaagaagaaatttggagaaattctcaccactgtgcttaggagtcaccctgaactatttcttggatgaaattaccaccctcccacttttggcaatgagacagcaagcttggaatttggagtccatgttaaatccaggtcccagccaggcacagtggctcacgcctgtaatcccagcattttgggaggctgagatgggaggatcacttgagcccaggagtttgaggccagcctggtcaacacaaggagacttcatctctataaataataaaaaaattaaaaattagctgggtgtggtggtgcacacctgtagtcccagctactcaggaggctgagatgggaagatggcttgagcctgggaatttgaggctatagtgagccatgattgcaccactgcactccagactgggagacacagcaagaccttgtctcaaaaaaaaaaaaaaagccagattctccacctaccagtggtggggccccttgggtaacttgttttcactccctcagaacctcagtttcctttcctatacaacgcaagccataaggttaacccctcctcgtggtgatgttaagatgaaacaggaaggtgaggggcttaacacatttccgtgttcccataagctttcaggagatcttggtagttttcatctcggtcttcattaccatcatcactgcttcagactcctgtccatgtggggccctgtggtcttgcgatcacctccataaatgttcctttgttcccgcctaacacaataccagccacaaaataattctcaacacatattcattagtggatgcaggggcgaaatgaaactcagggggttgggaaactcacctgaaggatcttctccctctccccactttcaggctctcctttcacacgcatgcattaattcgttcattcttggaatctacccacctgtgatgtgctagttactaaagatgcagcaatgaatgaaaggtaatcctgtccttgaggcattcacaggtaaagaagcctgcttgggacattgggccgtgagctccaacaatgtcactattcttctaggctttgtggacctttggtcaccccttctgtaagaccaactcccttatctgcctgtacagtgttctgcgaatcccggtctctactaaaaatacgaaaaaaattagccaggtgtggtggtgggtgcctgcaatcccagctactctggaggctgaggcaggggaattgcttgaacccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatggatgtgagcgtctgcgtaggtttttatttttctctctcagaatgaaaggtttgattcgtaccagctccccatcccttcccacgatcccatcttaatgtctgttgtggaagttggcccacagaagcctcaaggctaaccaacaagaaagatcacttcatatgcattagctggaaggtaacaagaggaaatcgcctgccagggtccctgactcccggaggaaagtgtcctctgagccctccttgagggacataaatagccccaaaagtcactgaatgctaagttggctttctccccaaaccttctaagtaggcaatcaggatttaacgacccgcaaatttccaattttttagtttatgaaaaaatatatctacatataatttttgcctccattagagtctcatctttaaaaaaaaaaattattcagtgacttcctccctctctttccaatgaggaaaactggactatttatgctgcattttaggctttttttcatatataatttttcatataaatgcacattttccccttctttcggggaggaaatttaacttttgtggaaatgtgatgtgtgtttaaattaccaatttcataggcaatatgtctgataattgcagagagatactgagttaacttgtagcaatgagtttctgtgacaaagggaaatcagtttgtttgcagtaagccgaggataacggcgccgaaactttactatttgggggtggggggaggttggggaagggaggccctgaaattgctttttataattaaaaagggaatctcagatgttttatatcttgaatatttacaataaaacctttaagtgcttgtcaagagggtaatgtgtcattaactggggactctgcctcgcctctcctctcggacatgacagtgcggctggataagagaagagtaattatagttcagcagggctgccaggtgtgataaatgactaatcagcacgcaggagcctcagtcctcaaaggaggactattacagtgttatcagctgcgggcctgggtgtacggagccccgaacagggatggggacaggaccttgcgctgtgcggcttggcatgctgctccagagtgagcccatggctgtctcttagttttgtcaccggcggctttatgtggctgccacggggggacaggaaacacacaggggctccagcaatctgcctggtgctaatatttatataacacactcgccagactccatggcctgagtccgggggtggcttttcggggtgcagcttggatggcatcagaacctgcaagaagccaagacgcctgttctccacggcggagcccgctggtcggtcactcctgttcctttcgtgtccgttgggtgcaggcattatttccagtgtatgtgaccgcttcccccgtgggaacagtgtggcattgttccctgggcaagccaacagctcagccctgtcctagagaaccctggagctacgacgagggtaccctggacccctgtcctaaatgttctttgactctgcttagccactgaggatgtttgcatttgattcatttgcttattatgatcaagaaacgttacctgtcaacattggataaaccatccgagggaaattaatcaaaacccccttcagacaaactgcatcacatcgattctctccttataggccttcttgttttgtgttctctgtgtgtgttttttttcccctagcgtgctgaagggtggcattggagtaccatttaaagaataatttttaagaaatgaacatcaggacatagacgtctgaatatgaggaagtgcctcatgtgaaaaaggacgtaatgtgctttaaagaaagaagaaggagataggacgacacttttgatacaaaggttatttttataatacttgcatttttatcggttcacgtattttaacagggagccctgactgaagtcacaaaaattatgactccggcaccgaggtacttatctgacaaatgcaatgcgaatggtcttgttcttatcaatgagatcagatttcagaaatgaatgcgaagaccgaggcgttgctttgtgcacagataaccttgcaggcgcaaactcccaaaccagaataaaagaattctctatgaaataatgggccaggaagcccaatcgcgtcacactgtaatagacagtggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttcttttttttttttttttttttgtttttcctcccagcctctctcctttcccattatgcacaatgcgctgagaaaggattcccagtccccctggtaaaaagtctgaaggatgccgaggagttcactgtgcccttagataataacagtttgtcttggctctgatcacccctttttgtgacttagctggctgggaagtagcaaaagtatcttccaagctcagcttctctctgcttgcattctttccaaatacgtgattccaaagcccatgcccaatccttgcactgaagcttttagcaggaaaggtgaacagaggcatctggatgcatcgcggccagtctgccccttgcccaattccctcccctctcctgcgtacaggtcatccctgagaagtgtgcctgtggactgcgttctttggggtaggacatggaatgggaagatgaaaagaaagccttcctttttctgtcctcagccgtaagaaagaatggtttcttcacagtgccgattggtaaaaccaagttctttgtaaattatggaacccaagctggaacttggagagcattcttctaactgaagataaatatggttgccactgtctttataaaaaaaaaagaaaaagaaaaagaaagagagaaagagaaaaaactgcaaaaccgcaaactggcttgttcttatgtggttgatggggacagcaagattacatatatagccagcatttgattctcaggactggtaaagtgtgaagaacagcagtgacattctagtcttcaataaatcactataaaaatgtttatgaaccctgcaatttactgtcttttatatgcaaattgaaaggggcatcattgcaagtgtaaaggagacccgaggtggcctgaaggaagtgtaaaatgttgcagtaggttttggagattgtgtgatcttaaatgggatcatttccaaacgattttgcgtttatacctctgtgacagttcgattaatttattaatgagattgctgtaagttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagaccccttttcagctgggtgctccctggaagatggatcttgccttgtggatgtttttctaccgtgacagaagatagaaaggatgaaatagaaagagtgtgagtgaattctgcacccaccccccccccccagcttccccacctgtaaaatgatttgctcaaagtttgcaaagaatggaggcatattcaaagtgctcagcactgggccggacccatgggtatgaattcataatgatcagcttcattctctccctttccctctctctccacacctttccattcctcctaactaatgtgggagagaagagaaaattacagtgagagatggtggtcagtttacaacagtatttagatgagaattaagattatgtccattcagggagactctagtgtgctctacatccccccaaaatgtggggacaatatggcaaatatggccaggtacagtgacagaaagtaaacagcccatgaaaacaggttgctctgcaattctcccaactgttcccttcccgcttcccacctgcctcgtatggaaaacacccaaagtaggcactgtttatagagccatcgcttgcagaacatctccccggcctccgacatatgtgccataaatgctgcagagctgcgtccacagtccctgctccggagaagagcattttgcttgttttcaaacacaagcatcctctcccgcgcctgggagggcgaggtgcggatcttttcgccttggcagtccctcgctcaaatgtgcgtctctggcaagtcctgtctgctgatagttgatagtgctgccacagagcggctgtcagattccaaaggcatcataccatctgcttttccaatcttctgctcttcaatgtagacatatgttcgagtggttcgtgtgtgtgcgtggtgaggggggtgctattttccgggggaagaggaggaggagaggatgcttaactccaagagtcctcaaagcaaactgaaataaaattttaagtgatgccaaaataagcagtcccagcaagacatgttataatataaggtcctttccttaaaaccatacctatatcagctttggaaataacgtacctcttaactgcatggaaaatctagaagattcgtggcttgggtctgtttctattcttaccacggtgacacgcaaaagaattttttaaaaaataggtttgttgttatttctgtatatctgtatgggcctgacctcccttttctctgggctttctactccagatttttattttatttttacactttcattgccctttgctctttctggctttcacctaaacaatagcatgtatatacaacagtacctataaaattgacgctcgtgtcactgatcatgccaagaaacctaatgtatggtgaatttgcactagtatttatttcctccctccctgtctctcccctctcctcccctcccttcctttccctcctacccctctttctttgtattattcccctagaaggaaatattcaagctggctttagagaggatagcaattgtaaggtcaaccaagtatgggatggggaccggaatagattttctctgcagatttcacgctgccttcccgggaatttctgaatgttttgcagcctaatgtttagcttccaacattctttcttttttttttagacagagtttcacccttattgcctaggctggagtacaatggcgcgatctcagctcacagcaatctctgcctcctgggttcaagcgattctcctgcctcagcctcccgagtagctgggattacaggcatgcgccaccatacctagctaattttgtgtttttagtaaagacagggtttctccctgttgttcagggtggtcttgaactcctgacctcaggtgatcccgcccgcctcggcctcccaaagtgctgggattacaggcatgagccatcgcgcccggcctagcctccaacattctttaagaaaactgcaccatgagtaaaatggggacgtttttctcttctgctgggacccaggacatgttggactgcacatcagttcattctctctgatctaaggtgttggctgctcttctcccttctccactgggctctgagcttcttgagtgaagggtctgtgggttttcacgctttgtactcgggcccagagcagagcctactgccttcacagaagatgctccacatgtgtttgtagaaggaacttggaagacagtcagttttaaagattttttcactgagggactaagagaaatagaaacagaggggattggccacacctgaagtcattctgtgttcaaatcttggctctaccacctatgatctgggagctgttagaggagttaatcgatgtagttaagactcaatttcttagtatatacaataggtgtaatagtaaaaattagatgactttgatgtgtgtaggtaagcggctagcacagtgctcagcatgcatgaaggactctttcattatcgttattaactgatgtttttaacttatacattgaaatgtggaaacaagccttgcttctattgaatgacttcttgaaagtgccagtctgatccttgaccttcaggtgcatctctaaattctttcatgtcagggtctctgaaatctgaacacatctcaaagttcccttatgcctggcaggggcggtgtccgactttgttattgcctatgcatgtataaatgtcccaaatgccagcaaccaaacttgcaggatgggtgttgacagattccaggaaagtcccagatgtaacagcggaatattccaccttctaggaaccaaatggctgtgaagtggagagacaggcagagctagaaatattccggacgtggaaatcaaaagtaggtttgcgcaacacaactgcagagccagctcaagaacccagcgccagtggctgatgcttcttctttttttttttttttaatggattcttctaaggatggctgcatcagccaggggcagcgggtcatacctgtaatcccagcactttgggaggccaatgcaggcggatcatctgaggtcgggagttcgagaccagcctgaccaacatggagaaaccccgtctctactaaaaatacaaaattagccaggcgtagtggcacatgcctgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgctcttgatggtacagaaaatgatctgcatggaggaaatctagacatcagcgattcagagtcaaaatgttattcaggggagagagacccttcatgtgaagaaattttaggaatactttaattattttttcacttacattttatagtatttattgtatgcaccagagtgattggtgataaaaatggaggcctacttaagtctaagagagttcttgtgaaagtgggagggggatgagggttggaaaattgcctgttaggtgccatgttcactattcagatgatggatacactaaaagtgcagacttcaccactacgccatatatgcgtgtaagaaattggcacttgtacccttgaaatacataaaactttataaaaaattaaaaagagttactgtaatgattataaaatgaaaattctacgtcatgagaaagcattgtgccatattttcaccgggagcatttttttttccttaggggaaatgaaaaataatggcatctatgatcttagatttagtaaaacgcagtatcttcttccccagctgaaatagcgaaagggtctcttcaggctcctgggataaaaaccaggatccttcatgtgtctgagcaggcttcccaccatttgactgctgctcctttgtccagacacatttaacaccatctccctgcaccccttcactgggctccgaagctgcgttcacacggcacgtcattggcagctcatctcagaaggttccagctttgcctggcaaattctcctccttcctttagatcccatctctggtagacagagtaatgagccccgaagatgtccaggccctactcctaattccatggaacctataaatatgggaggttacatggcagatggggaattaaggttgcagatggagttaaggttgctattcactcatcttcagattgaaagatcatcctggattatctgggtaggcccagtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctctcccagaacttccagaaaggcacgaagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcaggaatagtgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacacatatcccacatccaggtgccagtcagggagctgcgatttaatttgctgctgaatgcacttttgaataaagggcctagaagatgcagtctcgaggaaccgaggccggttagagacaggctggcagctttgcctcctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagagaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagacttcaaattgagccagacctcaggcatgaagggaggggagagagggggaaatgtggaggaagggggcgtttgtgcagtgggaagttggagaaagtacaaatgaaagcctctctgcagtgaacctcatgactgctttagagaggtgcttatgtaataactgcagtggtgtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgtaagtgtatcgacgtgctgtactcctaacacattatttgttatctgaaatttagatttccttgggtgtcctgcctttttttttttttttttttttttttgagatggagtttcactcttcttgcccaggctggagtgcaatggcgtgatctcagctcactgcagcctccaccttccaagttcaagtgattctcctgcctcagcctcctgagtagctgggataacaggtgcacaccaccatgcccggctagtttttgtatttttagtagagacagggttttgacatgttgccaggctgctctcgaactcctgacctcaggtgattcacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactccctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcacagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtataccgggaacagaacatatatggtttcatttcatcctcccattatcaccgtgaggcctcttccgcttatctattgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagggtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagtcaccactgtatagtcctgagctcactgggattaaggggaagggacacagactccacctctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacctggccaacacaccatgccttcccagtctctggtgttactgtctgcatactgtagaccatcatcttgtttgcatacttgtctgttatctctttatcatccgtctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccagtacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaaccagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccatatacctcaagtaataaaaaggcacagcaggcacttgggttttccctcagcttgctggggccgtgcacctatgtgagattttattatttgtaattttgggggggttaatttcacagcttaattctggcctttatgcatttagagctcccctcttgtgtttcagaaaggaggagttgttgttttcttttcacttgagtttaataaatgaaaaaggggaagggagagggaaggaagaggaaaaagcacaaatgtgcttgtttttggatcagcccctgtactgggcacatggatgcagtcagtcctcagtgtaccccaggaaagaggaaactgagtctccatgtggctttctgtctggcctttctcttttgcttgccttgtgctttgaatgcaggcctgctgtttgcctgtggacctcaggatttgtaaggccatctccacccacctacagctaagtttcccaagagccgatctccagccgaagtccaaggttccttgatgacccctgggaggagatgcaacacacagtttcctagaatcatttactccccaggctaagcacagtcacagaaatgaggtagctgtagccaaggatgatggcatagcacattcgtttcttaggcgtgccacgtactaggtggcttcagtcagcagaactgtattttcccacagttttggaggctcaaatttgcaagtcgaggtttcggcaaggccatcctctctctgaaaactctatgggggcgtcctctttgcctcttcccggcctgtaggtatttcctggcaacctttggtgtttggggcatgttgtcacctcattgccatctctgcctctgtcttctcaccaccatcttccttgtccatgtctctctatgtcttcaatgttcttcttataaggacaccagtccttggatttagagtccaccctaattcactgtaatcacatcttacctaagtccatctgcaaagaccctatttccaaataaggtcacattctgaggccctgggtggacatgcattttagggaccctttcaggccaccatatatggattccagagtgaccagtagaacatagctcaggccaagagagaaactcaaccttggtgaagttgcatgagaacagaaggcagccctggtccctgggagaaacccatccatactctggttacccactggccattcctggggacaggcggcaggtgtttagtcccctctctgcaaccatttgcggtcacctcttatgtgctaggcctggtgctcagcgctgagtgaacccatatcaacaaggcatggtcactgcgctagggaagtccctggtccagtggggtgagggtggcagtggctggcaacaaagacaatgagcgctgagattgaactacagaaagcagaagatggggtgacaagtttggcctgcggcaggaaagacttcccagtctttaaggataagtggcatttgatgagttgcacaaagaggagacctgtcctgggaatggaggagaagatgtgaagcgcgggaagtccagggacacacagccgtgcagagacccgggggcctcagcaggttagagtgtctgcatggcaccggcagaggatgaagacagggctggggaggggcatggggttagcctaacaagggcatcaggtgccaggttagagtttcggtttctaagctgtagataacaaaaatttcttgaatgcttttagcccctgatctgagttacgctttttttttttccttccattttccatccaacagacatttgtgaggcactgtatttgttttcaattgctgctgtaaccaatgattacaaatgtaccgtcttaaaaacctaaatgtattatctgacagtcccataaggcaggagtccaacacaggtctcactcggctaagatccaggtgtaggtggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccactttaaggacctttgtgatagttttgcacccactggatgacccagaatcatcttcctcttttaagatcagctgattagcaacgtcagttccacccacaatcttcatttccctttgttgcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagggacttacataaatagagtaatcaggggagggcccctgagaaactctaaaacatgaggaaagggctcatgatgtgaagaactggaaaggtgttccaggcaaaaggaatggcaaacacagtggccctgagacactcagagaaatcactcaggctgccttcgaaaggatgtattggagaagatgaggccaggggattgttagtaactgttgcaaggatccgggagaaagatgatgaaggccttgtagggcaagctggataagagcacccaaaatatccataaccgaatccccactacataggcatgctactttatatggcaaaagggaatttgcagaagctaagcactttaaaattattatctccttaaacctcactgcagagttataaggaaagcactgttatcagatgaagaagtagatttcatcaagtgactcacccggtatcatatagctgcttagcggcaaaaccaggatgtgaatggagagctctttctcggataccaaagctatttaatatttatcattgactaataatggtagagaaagtaatcatcataacctctgccctttattagtcactcatggtgtcacaagccctttacaaagcactttgcatgcaaatgattcctcataacaaccttgggaggtagttactttcattgtattagctatctcttgctgtgtaagaaattaccacaaatttagtatatttgttatctcatagctccataggttaaaagtcctggttcaggctgggacttctgctcagggtctcatgaggctgaaatcaaagcgtcagccagggatggggtcttatcagaggcccttggttactaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagcgagggcccagccccttttaagggcctagcgattagatcagtcccacttaggattgaatcccttttgattaatgcaaaaccaactgcgttcaggcctccatgacatctgcgaaattcctccccctttgcttggtagcctaactcactcaggggggcaaattatcccatcatattcacagttgccgcccacactcaagagaggggattctataggaaatggaagtcttgggggccatcttgaatcctgactaccatagtctgtgaaatccccatttcacagatgttgaaactgagacttagaagcattatgcaccatgccaaaggccatggaaggacagagcttgggcatgctcccgacaccaggtcatactgatgtcactctccctactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcaattatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctgtggctctttttcacaaatgcttatggagctctaactgggggcaaggaactgtgctacggttgggaagagaggagtgggcaaaaggagacactggggcttctgtgactttagaggcccatcatcaaattttcttttttttttttagatggactttcgctgtgtcacctaggctggagtgtagtggtgcgatctcggctcacagtaacctctgcctcctgggttcaagcgattctcctgcctcagcccataggcacatgccaccacacctgactaatgtttgtatttttggtaaagacaaggtttccccatgttggccagccttgtcttgaactcctgacctcaggtgatccacccacctcagcttcccaaagtgctgggattacaggtgtgagccaccgctcctggcacccatcaaattttcaaaggaagaaatggaatggtgcaaccatggtacatgggaaggaggagggggacacacaagactgtacctatcatgggggcttcgacctcatctgggaaggtggttggagagagtgagtcctgacctgagctttggaacttatcaagttgagagagaaatttgataatttgtctattaacgtgtgaccttgggcaagtcattgaccttctctgaacctcagtatcctaggacttcagaagcgaaaggaagaataatgggtcttgagtatgcctagaattgagcaagctgctatgcttgcaaaggccttggccagctgctcacccaccatgtccctctgttcccactccaccttactcatgcctagacttcttgctttttaaaaataatccacccatgaaacaagtgtttatttacaaggctggcttccccaggaggctttcacaaatgcttaccgagcatctgctgtgtgccagacaagagtgaggagctggggactcagagaggagcagacgagggagacactcacattagagagtggcgtgtgctgagggaaggtgcctcaggcgacagatgggaccagggcctttaactcagtggcagcttcagagacagatctggaaccccaggactcaaaggacctatgtttgctaatcaagtgaacacggaggacctgccactgggcagggcatccctgaccaatccacaggtgatggcgggacagctccaggccctggggatcccccagggaataagccagattaaagcccctgccctgtgaggtgtggcaaagaaacagacaattcatgaaataaatatatgataaataacatatgagaaggcagggagtggtatgaaacaaatcagggaaggaggagacggagaagttggagaagacagtggattgtttctctgggtggtcaaggaaggcttccaggcagaggaggtttggccatgggtaccaaggggtagagatgggaaccttccaggtacatggacccgatgctgccagcagaggggaaaccatggccctaagggcagagcacactggggcgggggtgggggttcagtgacagtctggtggcctgtgtggtgaggagtgcgggagatgggaacagagagcgagagggcagacggggtcatgttgtgtgggacctcggaggtcctgccatggctttggtttctacttggagagaaatagggaggtttgggcaggctctgagtagaggagtagcacgatctggcttacgatgatttctaacatctcaccatctttacttctgtatataaatatatgataagtatacctttatatatgtgacatgtatctttatatatgatatgtatggttacatatctactcactcacacatccacacacacacacacacacacacacacacacacacaccttttttggaaccattgaaaagttgcagacatcatcacggctcaccctgaaattccttagcaggcatcttctgagaataaggacattcttctatgcaaccatttcacatccacactaagaaaattaacactattacgtagtattatctaatatgccctctacattcaaattttcatgtctccaatcctgccccctttggaacttctgttggtgttcgatctggaatctgagaattcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtgatgtgccaccatagccagctattttttttgcattttttagagatgagtttttgccgtgttgccgaggctggtctcaaactcctgggctcaagctattcacctgctttggcctcccaaagtgctgggattacaggcatgagccaccatgcccggcccccttttttaaaaaacaaaaaaacaaaaaactcttttgtgttttagaaatggggtctcactatgttcttcaggctagtcttgaactcatggcctccagtgatcctcccgcctcagcctcctgagtcactggaatttcaggcatgagccactgtgcctggcctctgtcaacttccttatctagaactatctttttcctctattgttttgtccctcacttctgaatagttcagggatccctctggctactgtgttgagaataaagtgtcaaagccaacagtggaagcgtggacactgggtaggaggcttttgcagtgctctcggcccgcgctgtccaatagaactttctgcagtgatggatgtcttctatctctgccctgtccagtataaaagccacaagccacatctggctgtgtggcacttggcatgcaactagtatgacatcttaatttttctttttgagatggagcctcgctctgtcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcaatttgaagatccacatatggctgagggctactctaatgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcctggctgaagaaaggcatcacaaagaaaatgccaccagcaggctgggtgtggtggctcatgcctgtattcccagccctttgggaggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcctcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctggtaactcttttatcttccctggagttatttttttcccttctttctttctctttttctgtgtgctcttctaagagtaaaacgcatgtccccccatgaagtcactcaaagctcaggcgtgtgcaacagggacagcaaaagcacacacaatgatggccagagacactgctcagtgtactgtcttccaccgggacagcccactcaccaagggttaggtcctgtgctgactgggtcccgggtctcctcggaggtcggtttgcatcacgtggatacactaatctacccaagttgacttggagaaccaatctgaaatcagatgggagctcccggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggattttttgctctcctccttttgtcagttggcatgcgatatgcttctcaggcagtaatttagagactgtcaattcctgagagccgctggggaactgagcaatcgtctgcatttcgtcgctttagcccgagctgggtctttgagctggcagagaccaagatctttttctgggaagggatggtcctatttaaggaaggccctggattttgtcaagtttgaaaggttttcaacatcttcccgagatggtggtcatgggagtagtggttagggtggttatgacgcatgggacgggagaataccatgcccacccggtgatttataccaaaagatgctttcctggggtggttctgctggcagtcgggcagtgacatgttattaatgttttcctgttttctattgtccccgaatggaaaaacactgtggaacctttaaattttctcaagctgtctatgttttcctggatcgtccctcaattttccgtggtatgaaaaatgtaaatgttgctacattcagttcagggaaatccagccgttgctccagatccttctaagatttttcaattccagagatgttttcacctggaagattccccagatttggcaaaaacaacccaactcctagccactgctttttgagcagctactcagtgcctaagactttgaatagtttattaatcatgtgtcactgcagcaaaggggacatttcggccctgatttcagagatgaaagaaccaaggcatagaaattgagtcactttctggagtgtacacaactagtaagtggattcgagttagttttgctctattccaaggctacttactatgctatttttggtttcctacttttgttcaacttatatttatctgattatctgattctcttttacaagcacttagtgagcatcagctgtttcaatgagcatttatttactgatacctgtggtggcacccaggaaggactaggaatgctctgtgatatgtaggagaaggatgtatccactgggcaaaggtacctgcgagggatcaaagatggaaaggcagaaatccaaggactacgtgtgacatgaaaggggcctttctcctgctgtcatcctgaacctctgtctttcaaatttggatgtgtcgggggccacaggacactactgtgcatttgcctgtgatttgccattgggttggagtacttctcctgagtttctgcagtgttctaggtatggtcttaggccctggaataagacagtgtaggaaacacagaaggtgcctgatttcctgggcctagctaaggggaaaaagcgagacaatggggtcagaggaagctcagctgaacagatgaagttgagatgaacagaattccagtgccaccatgatttccagccgtgtgaccttccacatgctttttgatttttcttgaactcacttttcctttgtttgcaaaatagtaacaatattttccttccaagtgatggtgaggatttaagagttaacctgagtgtctgctgcatagtaggtgctcaataaactataacgtctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttatttttattttaattaaataatttatttttctgagacagactgtcgctctgtcgccaaggtggagtgcagcggtgtgatcttggctcactgcaacccccgcctcccgggttcatgtgattgtcctgcctcagactcccgagtagctggtactaaggcatgtgccaccactcacagctaattttagtatttttagtagagacaggatttcgccatgttggccaggatgatcttgatttcttgacctcgtgatctgcccgcctcagcctcccagagcgctgggattacagacgtaagtcaccacgcctggcctgatcctgacttagttacggttacctctctttgtatctctatatgttctcaaattccaacctgtctttgtaatcctctatttaagctatcgattacctccaaaaggccctgaatgtttcagaaagaaaggatctactggcagcttctgaaggcttctgtaataccttgtaccccaatgagtacaatgaaatcattaggggttctttcctctcctttggaatgaaactgctgcttaacttttctcccactgatgagatgcggtgatgctgtcacagttgggtggttgctcctcctgcagtcttcttcccattgcatgttcactctcttccccacttgcccacgagcagcaactcctgtttcttgtttttttccttttctttttcttttcttttgagacagagtctcgctccgtcgcctgggctggagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctggggtcgaactcctgacctcaggtgatccgaccacctcgacctcgagaagtgctggcattatggatgtgagccactgcccctgccctagatggtatcaccttcaaagcttaattaggaagaataatatgagcactgagtgtaactccaggtcgggtatattatgtccctctgtgttctctagctagttatctatccatccatctcttgccttgtccacagaagttacaggtaggctgccgggcgcagtggctcacgcctgtaatcacagcactttgggaggccaaggcgggcggatcacgaggtcagaagttggagaccatcctggctaacacagtgaaaccccatatctcctaaaaatacaaaaaattagccaggcatggtggtgggcacctgtagtcccagctactcgggaggctgaagcaggagaatagcgtgaacccgggaggcggagcttgcagtgaaccgtgatcgcttcactgcactccagcctgggcaacagagcgagaatccatctcaaaaaaaaaaaaaaaaaaaaaaaaaaaaaaaaagaaagaaagaaattacaggtaggctagagcacggatgagcaaactgtttttataaaggaccagagagtatatatttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacgttttgatatgaatatttccacccccattatttgcataacaaattacagattatccagaacaggtgggctgtacataaacaggctggtgggctggatttgtcctgtggactgtagtttgctgacatccaggctagatccttaatatacaatgaagtagtaaaacacatgtaaaagtaaaaagcaggcgaaatagaataaaatacacatttgcacaccacagtatccaaaaaggttatgtactggggctaaagatttggcttggagtttcctggtagtcaaggcaaaaaagggaaacaaaactagttacagagtttctcggacctatgagcaaaaggatgtccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctgacagttgttaattaaatacctactcatgctttggagccaaagccaaatagtgctctgtaaacattatgatttgtcagtaatcaatgtgatttgtataatttgtgagcaatcagatactttatccaaaagcggattattgacctctgtgcccatcttgggagaaattgccacttggtctgtgtctacacagacccaagaggagaagggatttgacaatggtctgattaattgaatcagtggtttgggggagtgggctgtctgtattgatccaattaaatagataattgtcagaatcgaggtcatgtctataagacaccaccatttcaaagccaaagagattgtttcaaacatatcatgctcaccccaatcaatgtgggccgcctcctccacatgaaatcaaccagaaagtgattgattctgcagagccataaaccagggtctttcctattttcggcaagtggttctgtgctaaatacagtgctttgaaatttttgttccccatagacccaaggatgatgattcattatgcaaataatggggatagaaatatacaaattgaatgttagggctgggcgtggtggctcacccatgtaatcccaacactttgggaggataaggtgggcggatcgcttgagctcaggagttggagacaagcctgggcaacatggcaaaaccccatctctacaaaaaattttaaaaatttagccgggcaggcatggtggctcatgcctgtagtttcagctattccggaagctgaggtaaggaggatcgcttgaacctaggaggcagaggttgctgtgaggcaagatcacaccactgccttctagcctgggcagcagagtgcgaccttgtctcaaaaaaaaaaaaaaaaaaaaaaaaaaaagaaaaagaaaaaaaaagttggaatgacatcagactcaaaatgtgtcacttcgcagtggggatgcaattctgagaaatgcatggttaggtggtttcatcattgtggaacatcatggagtgcacgtacacaaacctagatggtgccgtctactacacacacacttaggctgtatggtctagcctcttggtcttagcctacaaagctatgcaacgtgtgattgggctgcgtactgtaggcagttgtaacagtggtatgtgtatatctcaacatatctaaacatagaaatagtacagtaaaaatatgatattataatctttgggaccgccatcatatatgtagtctgtcattgactgaaagttgtcatgtagcccatgactgtcgtctcttttaggggaaaaaacaaaagcagaaagcaagcaagctggtatcctgcgtatctgtgagctcaggaagcagctgcatgtgcatactggataagcaagggagactccaaccccgggctctctaagggtgtaattgttgcaggcacactgaggggcagacctctgggtcttggttagtggtccagagagggaagagagcaaaggtagaaggcttgagtttaatttctgcatcagactcaaaacccagctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcattaacatgccttatctgacatgtggcaataacttctgcctttcttatgtcatctgcatggttgcagtggatagtcactggacaattgatgaacaactactacatgctagatctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctctttgtggctcagtttcttcatatataaaatggggatcatgatagtctctgtcccaggggagttaggaggattaaatgcaacagtaatccaaccacagtatgaaaagacaggctagcacatacaacacaatctataaatgtttgctattattgtcatcctttttattagtatatcatggtacaagtttgctgggtagaaagatggcgatggggaaggggacatttcaggccaatgtgataataaaatcaacagacaaaagaagggagagtgtggtgagtaggataaagctctgtacagatgcaaggggaagggtgttgatgtcaacacgcatgcagcttcccacacgtcgtgtggattcttttctgtgctctccattacggaatctccctgaaaataagtggtcactttgaggtttgatggtttaattctaccacaaaagtataaaaagcaggcagcctgctgtttatagatttttttttaagtgagggagtatgttaatgagcttagattgtcagggagctaaggggattcttgacatcaaattgtgggtagctaaataggtcaccccaagttattcagcatgggtggaagaccaagaggatacacaagcttcaaaaagttttcagggagagcaagagatgttcatttacctcattcaaaatggaatctttaatgctagtccagtgcttggccagtacaaggccattatatatttgttgaatgaatgaattcgtgaatatgtttataaagacaaggaaacgccattctgcaaatctacgtgcagtaaaatagtttttcagtcactttgccttcatttgtttgacattcttggaatatttgggctctacaaggtgctagggtaaggcacgcaggatgcaagattagcgagatattgtctctactctcaagaaactcgctttctttgggaatcatcacctgtttttgtgtcacggaccccttgggcatttggtgccctttgcagaataatggttttgaatacataaaacgcacgggatcacagaggaaaccaatcatattaaaatacagttgtcaaaatattaactcatgggatctagtaacaaatgttcttccttcttaacccattaaagaacacagctcatggtcggtccattaactactaattatcaaaacagtgggtgaaaacgatgtttggaaatagctgcgactctcgcgtgataggaaaatatctgtgatttcgattgcgacaaacacacagatgcttctcacacgatcgcagtgcattgcctaaatgacagtaatgctaaactccagtcagatgttagtgaaaaataaagatgtaacattttggccatctgtgtacaccccctctttctagggttccagccacagaccctcagattaaggagtctgcactagcttgtagcttgttcaatcacacatacacacaaaaagtgccagttataaaggagcaggaggttttctggagccaggatgagctgggaccaacaccagcaactgtatcacccagttcactgagagttaaaatcacccatgtgacgttctctctgcaggcacatagtaagtgctggataaatgatagggattgatattgaccagctttgacacatgaataggagagggttaggcaaagacaaagagagatggggatgccaagtaccctctgggcagaggaaaccatgagtgcagaggcacgtaggcctgaaacaggccagaaagcaccaagcaatttgcttttgctggtgaaggaggtataaaaggtagagttgcaaagactggggatggagctttaggctgggatcagcgcccaatgggctgggatgacaagtgcttggggcacattggcagctgcgaaaagctcgctctgatgcctgtgtggggacagattttgggggcaagaggactctccagcaatctgtggcaaaaaaaaaaaaaaaaaaaaaagtcccgcttgttatcaagcctactggcttatctgttatttcttggacatgccccagtcgctagtaaataaagctgtctactttacattttgtctctgtgcccttttacagccttttctcggaggagctgagtcccattatattccgaaagcatatgttcccgatgattgctcattctctttccaataatatctttgcaggacaaagaggaatggggaagggaacatacttttaggatgtcagtcccagttttaattacaagtgttcctggttgtggcattcatgtaattgggggctgatttatgccaaatgatatgcactgatgtaaggggctggagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcactttctggctttgtgacctttctgcaggttacttctctcccctgagcatcagtttactcagctgaaaaatgcatctgctaataatacctatggcatagggtttggggaggattaaataagataatgtaaatagagtttagcgtggtactgtgtatatagccagcactcactgctgttggcttattgaaaaaacaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaataaaagaattactgttctccctttgcatttatgcattgcatgtctctgttgaattcagagtgctttatagacctctgatcagcttccagcatcctcttggtatgagttctagggggagatgaggaatgtgcctaattcccttgagtgatttacttggtgttaccctggagttgtgaggacaaaaggatggggctgactgagactggggatgttcatcacaaagtgttcaggttacatccaggctgattactggccaggagactaggcattcatagtggggcgtcctttaaggtctgaagaggacagtgaccatccaccacaggcaaacatgtgtgtgttaaaaaggaatgacgttttggtctgtgctacaactgggatgaacctcaaacattacgctggacgtggtggcttacacctgtaatcccagcactttgggaggctgaggcaggtagatcacctgaggtctcagaagttcgagaccagcctggctggtggtgataccccatctctactaaaatatggtgataccccatctctactaaaaatacaaaaaaaaaaaaaaattagccagacatggtggtgcaggcctgtaatcccagctactcgggaggctgaggcaggagaatcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagacagaaagcaagctagtgattgcagggggctgggaaagaggggactagagaatgactgctaaagcattcaaggtttcttttggggttggttaaatggtctagaattagatcgtgttgatggttgtacaaccttgtaaatatactaaaaaccactgaactgtacactttaagtgggtgaattttattttatgtcttatttatttattcttttagggacagggccttacgctgctgcgtaggttgtggtgcagtggcacagtcacagctcactgcagcctcaaactcctaaggtgaagagaccctcccaccttagcctcctcagtagctgagactacaggtgcgtgctaccgtgcccagctgatttttaaatttttttttctttgttttgagacggagttttgctctgttgcccaggctggagtgcagtggtgctatctcagctcactgcaagctccgcctcccaggttcacgccattctcctgcctcagcctcccgagtagctgggactacaggcacccaccaccatgcctggctaattttttgtatttttttagtagagacggggtttcaccatgttagccaggatggtcttcatctcctgacctcgcgatctgcccacctcggcctcccaaagtgctgggattacaggcatgagccaccatgcctggccctgatttttaaatttttcatggagacagggtctcaccttgttttccaagctgatctcaaaatcctggcctcaagcaatcctctcctctgcctcagaaagtgctgggattacaggcgtgagccaccacacctggccgctggaaatacatttctaaagaggaatgggagtcaggctggtgaagaaacacgtgagtgtgggatgaggatggggacacagagtgatgtgaggcctacacaacaggagttcaatcctaggacctgagctgatgtaaatgaagcaccgccaggcccagttggggaggaccttgtgttcctgctggagagtgagagtccctccctccccattccactcccaagagcagtgaagagtcaggaaggtgggcttgttttgttttgttttgttttgttttgcttgttgagcaagggaatgcggttcccctgtgtcggacttgtttcagaaagacaatgtcactgaggctggggcagggagattagctgagaggctcttgcagttatctgggaaggagctgtccataaaggcctgagttaagacagtagccctttgggttcgatttagtggtggctccccaaaagatatgttcactggaacctagacatttgagaaaaagggtctttgcagataagttcagttgaggatctcaaaacgaggtcatcttgggtggaccctaaatccaatgacaggtgttttcagcagagacagaagtgaagaaggcacagaagagaaggcggtgtgaaggtagagactgagatcggagtgattcccccacaagccagggagcactgagggctgctggcacccccagataccaggagaggggcacaaataggttctcctcagagcccccagaaggaactaagccttctcacacctagactttagacttctggcctccagaatactaagaaaataaatttctattgttttaagctaccacacagatgcaggaaactaatataccctttaatgattttctccatggcctttctgataatcctttcatccttcatctcccctgtcgccgttttctttgctttgcttgcttgcttgttttttttttttttttgagacggagttttgctcttgtcgcctaggctggagtgcaacggcacaatcttggttcactgcagcctccgcctcctgggttcaagtgattctcctgcctcaccctcccgagtagctgggataataggtgcctatcaccacgccgagctaatgtttttggatttttagtagagatgggttttcgccatgttgtgcaggctggtctcaaattcctggtcccaggcgatctgcctgtcttggcctcccaaaatgctgggattacaggcatgagtccccatgcccagcccctgttgcccttttcaaaacactaagtgcatcatgttaaccttccactcgcttctttaagtttcctcactccttttaggtgaacaacccaaaccctcatatgccctagaggcccttttcagccctgttgacacttcccttctctgtgctttagtcaccctaccctcggtcaactcctaactcctgcctgccacagggcctttgcacatcctctgccggggaggctctcccttcaccttcattaggttatcagatctcagctcacacatcacatcttctgagataccttccagactcccctggccacggtcacttcctttgctgtggactctctgggaactgtgtccccttccttctcacatcagcttgcagttctgtacttgttcatgtgatcattgatcagggtccattttctgctccagacaatgatctctatctagaaagaatcatgcctgcttttctgcactctcctgcctctaggggagagaacacagagcctggcatgtggtagactctttttttttttttttttttttgagatggagtctccctctgtcgcctaggctgcagtgcagtggcgcgatctcagctcactgcaacctccgcctcccgggttcacaccattttcctgcctcagcgtcccaagtagctgggagtacaggcgactgccaccacgcccggctaatttttttttttttttttttggtatttttaatagagacggggtttcaccatgttagccaggatggtctcaatctcctgaccttgtgatctgcccacctcagcctcccaaagtgctgggattacaggtgtgagccaccacgcctgggcggcacgtggtagactcttaatgaatttttgctgaatactgagtaaataaagaaaagttaacacagtggagtccaggtacagtggctcatgcctgtaatcccagcactttgggaggtcaaggcaggaggatcacgtgagcccagcagttcaagaccagccttggcaacatggtgagaccccatctctacaaaaaataaaataattagctgggcatggtggtacatgcctgtagtcccagctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaacttttcattgcaaaatgaaaattcttcattgttattataattacttcaaggagcaaggccattttgtgtaagctatcctgggcctccctgcctcccattttacaccctgtttattgatactaagaagagcctccaactgaataagaactaatgacttctgcctgccatcattttggaatgtccaattccccgttctggagagcctttgattataacatcagcctgtcatttggacctctgacctgaattatatgaatctgaaaaatctcttcctttcctatcgtgaattcggtcattgttataagccaagctttgcaaaggtggaacaccttggagatacttatctcctccttactctacccaagtaatgactcatccttttatacagaatgtctcttttttgatttagatgtctttttttgatatagatgtctcttgatatagaagcatttctcgggatggtttttgtggttgcctagtgtcttctaaagacccctgaacatagcatagaaacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttacccaggatggtctcgatctcctgacctcatgatccacctgccttggcctcccaaagtgctgggattacaggcgtgagccaccacgcccgactgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactgaagagttgataaaaaagcacaaattgtaggctgcaaatctatcatttttctttcctccttcttcctctccctccctcccatcctttcttgctttcttccctcctctctccttccttccctccctttccagcttaactaaaattttctgatacttttttcctgaattagggtatgttttggggggaaaaaacgcttcagtgcgtgtttctttcgacattacacataagcccccatggaaagcaaattgaataaatttactctctaaacttctttccacaagagtaggtttataatttattttctttacattatctggataattacatttggtttgcttacatagatggaggcgaatggttttccaatcttcaaaccaacctatatcacaaaagcattctgaaaactgggaagagatcacttcacagtttcctgaaccactagaaaaaaaaaatgttcataaatttatagccgctgacattgaagttggagaaaagagcatatctagtacctatgctatgtggagaacactctccatgtctttgaaaaataagcacaatacaaattatatttgaggatgacctgccaaagggttgattatcctggaaacatgttttctcaatggtccatttgggcaaacaggccagctgaggtatctcaggatagcaacaggataagcagaatcgattgatgaaggagggagcctacctctggaggccccaggctgggactttgggtacagatgcacaggagacctttgccccaccccgtcacggctgggcctactcagttccacgtctttgagttttcacgcggaaactggatgtttcttacatcctcagctgcaggcatggggaagagacgcacatcagccattaagaaaaaggtatgcagtctacatgcctcttaatttcctccacatacacagtaaacccatcatgtccatcagcaccattgtcaaaacatctgtgcaccagtaaagggttctgatgtgtgataaatttatttagctattactcatctgaagttatactattttaggatcttggggcagtgaggactttggaaatggaacaggatgctcctttaagttagggtaaaatgaagtctataaaaactgtttttctatatcctcctcctaccccacaaagaaagttagggtaatatattcttatataaaattgacatttttaactttaatgagaaattgcttgtcctttaaactttaggcattgatgcgcttaattatgcttttcaacaagattttgcatttttaatatttccttttagagcttccaggaatctcaattattaattgtaccctggatttattggtctttggactctcccgctagtataaagactgtagattcatcaaacattgtttactgtcttcaaacttcaacagtgttttaactatcaaatagaaaatcgaaaggaagcataaacgcatatggtcactttactggtataataggggccaagagccgttgtgttttataatttcttgatgatcctggtggtaggtaagccaaccgctatgaactctgatgagctctggtttaccccatagtccaaataaagaatggtttctgacattgtatgaccaaaaaaaatagcatctgcccaaaagatgctatttataaaactgttacaaatggagcttattgttcaccagaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggtttctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagaggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatataatctatatatagatatctatataatatatataatctatatatgatatatatatcttattatatattatatatatagatagatatctatatacagatatctgtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaatatatattatgtatagataatttatatataaatatgtgtatatatatatttgttagggtaaaacaaagtctataaaaactgttttcctttgtcattgcccccaccaaatatttatatatatgtatatacacatatgtatatatgtatgtatagagagtctattatatatattacatatacataatatatacataatatataatagactctataatatagactctaatatgtagtctatatattatattataatgtatgtaatatataatatattctatgtaatatataatatattctatgtaatatatattaatatgtagggaatatgttacatattatgttgagagtgtatatattatatatgggtttctatatattataataaacccatatataatatacataatagactatacacatatacagctaatatatatacacaatagtctagtatatattatacatgtaatatactttccatacatacatatataatttggggggcaaaaacatatatataatgaatataattatataattcatataatatatgtaatagagcgtgtatattatttacatatgtatatatatatatatacacacacacacacacatttcaactttcttgaactcctgaaccagccttagattgcctagtaccagggttcttctttttttaaaaaatttatattttattttaagttcaggggtccatgtgcaggtttgttatataggtaaactggcgtgatgggggtttgttgtacagatgatttcatcacccaggtattaagcctagtgcccattagttatttttcctgctcttctccctcctgccaccctccaccctttggtaggccccagtgtcttttgttcccctctttgtgtctatgtgctctcatcatttagttcccacttataagtgagaacatatggtatttgcattttctgttattgaattaatttgctaaggataatggcctccagctccatccatgttcctgcaaaggacatgatctcattattttttaaggctgcatagtattccacggtgtagatgtaatatatatataatatatatataaaatatatattatgtatagataatttatatataaatatgtgtatatatatatttgttagggtaaaacaaagtctataaaaactgttttcctttgttattgcccccaccaaatatttatatatatatacacacatatgtatatatgtatgtatagagagtctattatatatattacatatacataatatatacataatatataatagactctataatatagactctaataattattttttaaggctgcatagtattccatggtgtagatgtaccacattttctttatccagaataaactattttttatactggttttaggctcacagcaaaatcgagtggaaggtacagggattttccagatttcccctggccctcactaccacatgcgtagccacccctttatcaacatcatgttaactattttaaagtggacagttgagtggctttaagggcattcatattgttgtgctaacatcatgaccatccatctccagaatgattttcatcgtgcaaaactgaaacgctgtacccacagaacactggctcctcatcacctccccaagcccagcccctggcaaccaccattctcccctactttgtctatgaattcgactactcttggtacctcatataagtggaatcacacagtgtgtgatgtgttcttttgtggctgacttatttatgatactggattctcagcatcatgggagttaggactgtctgtcgcaccatcaaacaggcatagctggctggctagaccatgtcacagggatgttggaactgggtggcactgactggcccagccaaggggtcacgcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataaatgaaaagcaccattattagtaatgtcaataactttcctgacatccatttgggcattgtatatgttttgataggattacataaataatgaaattgtatgcaaagcatcagaatgcaaaaggtgttttctccaaggtgtacacactgcctgggccttgtactctggccctcaattttcttaaacagctgcatcttttgggggctctgttaagacatgctactgtctttagtattttgccccctcaccgaatgatcaggagactggcttccccaatgccctgggcttaattcccagatatttattctgttgtggagtgattatctgttcctggattgtctcaaaggcattaatctttttggtatccaacatcttgaatgcttctgtgtcattttcctttctttttttttttcaaagcacttaattatttaaaaacaaaaatacttctctgatcagagcatacctgccgtgctcaaagcacttgcttacttggaatgccataaattacatgaaggaattattcattgtatcacgaaacataccttccagtctcccgagtagtgtattaggctaagtatggtcttttaaattattactttaaaaataaaagataatggaattatagcattaaatacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaaaaaataaatatctgtgatctcatcatttgaccgtcagtattttcatttttgcatgtgccactttaatttccctaggcaacactagctagtggcccacaataagacgtagaaaacaagaccacgtaccttccagaatcattggccctggctctactcctggaaacccagtccatctctaatccctttgatttccaatgggaggcaaatccaggggagttctagactgtctagaatattgtaccaagaacaaaaggccaaccccattagacagtggccaagggaggtgaactaaagttggtgctgtgaacagggctaatggtttgtgatttacccataagtggaaggtgtactccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgatctcaggtgtaccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctatcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccactctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagctcctaaggaagtgccagagtcagggctttcctctgcctgaattatcggagctcttggcttaatgtgggagaagagatgaatgatctgtccttctatgaaaggcttaccaactccattcaattcacagtggctctctgaagctctgtttttggaaggactgtgaggctgtacctgcacttgattgaacgagtgctgggattgattagtgatgtctgcagtgagcgaaggattgggaagagtaaacaggcatgctgcatatctgtcatcatggctctgagtgtatcctgtttcagaagagatgaactgtgctgtagagatgttagcatcaggtattttagacacatgaagagaggatcagattcagtggaagtgccaaagggattctttcagatgggcaataagtggttctgaagatacgtatttctcagtgtgttatcttggctccatttagccacacaaaaggaatatgggtatagtgatgggtctctcatggctcacgtattaactgtatttgttgttactgcttctcaggcactctgttaagaatgcagggctcttcctcagactcagggcggggcctgggctttacagcaatggttttcagtttgtaatctctctcaaggaagggagaggagcacaaagctgccttgactgccagcaccatcagaaaagtgacagcagtcttggccctgtaattgccaacagtaattcatttgttcgttctctctctctcgctcctgctcctgactctgggggatgcttcttttcctaccctgcctggaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaccctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcagttgggagagtgcaggatccagttcaaaaggatctgtccccccgtgaaccccaggacagggtgagaggccacctgcacactttttttttgtcagctcacaccctgttggccctttgcaaatatttgtctttcctcatgcacgtggttattcccagaaagatccagtgaattgtctcctgaagataaaatacataaaagggcgtttcaaagtataaacagtgattttaatgaaaaataagaagaaaatgcttatgatacaacattaggtggaaaacgaaggaagaaaaattctgtgagtctaattatggaaaaaattactaagatatgttttaacatgccctagacatgcacagaaaaaaaagactggaaggaaatttattgagatgttattgtttatgagtgttctaattatgatttttaacaatatattatcagagttttctgacaaagaattaactttttattttttttgagacagagtttctctcttgtcacacaggctggagtgcaatggtgcaatctcagctcactgcaatgtctgcctcccagattcaagcaattttcctgcctcaggctcccaagtagctgggattacaggcacccaccaccacacccaactaatttttgtgtttttagtagagacagggtttcaccatattggccagactgctcttgaattcctaacttcaggtgacccacctgcctcagcctcccaaagtgctgggattacaagcatgagccactgtgcccagcctagaaataacttttaaatcagaaaaatacattttttaaaaagatgtaaagcatacatagaggataacttacaaatctgcatttcatgaccacatatatctattgagttgcccctaggatcatttttttcaaagctaatgtctgccacaaatgggagttttaataggttataattcatatgacttagtgttaaacctctacgttgggattcttaaatttaacatggataaactgaacttgatttcctgcattaaaaaaaattaaagaaatgaaagttctgactgttttattgtagctggggaattctttttgcaggtgatgctcatgttacggttttgaacccaggactttgcgttgcagttttgttcaggggttgcagaataccgatctgactttgcaggaatgactgtcttggtgcataagccattaacctctctgcgcccttggattgcctcctctcctgccagcagaagccaagtcacctcatctgtaagggagtttcattgaggactaagtgggaccaggccgaaaacgacccccttcccccataggaagtcacagaacagccaagccctggaacaggaggagcagcttcctcctgggcacagctgtgcagaaccagaggcgacgcatttgcccatcgtaaaggctgattagaaacagttgggtcccaagcagaatccttttgcccatgactgtgtccatggtcgaggtgtccattgtcactgttgccagatgccagcactggcgagggttttgccttcctaccgtaggcttcttgacccggcacctcggaaagtaactcctgtccattgttccttgtgccatctttcttaagaaaacatgaggaggagcagggtgatgctagatggaagcaggagagcctggggtcttagtttcagtggctctgacttcagttttctcacctcgaaatctcccttctctgaacctttttgcgtgctcttctgtctgtctgatattcatcatctgactcatctctaccagtcaggagttgcttcttccaggaagccacattccatggactgatacgctgggctccatgccatcctggggttctcttgagtacatctggaggggtgtagtgtgttgtaaatgcatacgatcatgctggtacatttcatcaaaggtggcagttacactaccagttgtgtgcccttgggcaattagcatcaccctgctgtgcctcagtgtttccatctataaactgggtataataatcattcctaccccataggttgctgtgaagattggctcacatcagtaatgtacttggaatggatcctggcataaaaagagcccttggaaaatgatagcgttcatccttggtatgacctccaagttctttgaacctcaaagagccaagtcccacatctcaggtacatttcagttcattctttctgagttgatttttttttttttttttgagacaaggtctcattctgttgcccagactggagtgcggtggtgcgatctcagctcactgccacctctgcctcccaggcccaagcgatcctcctgcctcagcctcatgagcagctgggaccacaggatgcaccaccatggccagataattgttttgcatctttggtagagacaaggcttcactatgttgcccaggctggtctcgaactcctgagctcaggtgatctacctaccttggccccacaaagtgctgggcttacaggtatcagccactgggcctggcctgagttgataatttttgtcatttctttctcacttttctcaggaaaatcatgactgtaaaacagatcagttttgctttagttcccaccctcatcatcaacccctccccagctaccctgcaaaagagtcacagatcattgggataactagaaccacagagatccccctagacttgtcagccagggaacctgacactcttagaccttcttctgagtgctttgtccttgtccggagagctcggggaggagcaaggttgtactgggatttttttccgatcacagaaagtaacttagctagctgttgcccagccaatttgcccaagggagaggttgctcctgggttgcaggacgcatccatggatggagcatgggttttgggctgtggggggacaatgaggtggttcctgaaatccctagttactagcagacaagtgcatcagacaagtgcatttcaccgttctgagcttcagtctcttatccaagcagaaacatggccagaatgcaatgtcctaatacatgtaattcattacgtgtgttgtcatgtaatgtaacacacctattggcagtctctgacacaatacagatattgaccccatggtcttgccccaacttaaataaaaataaaaacgaatgcaaaagaggaatcttctttgcactcgtgtgatgtctgttaattcttggctttcttccttcataaggttaatcatctccctgtcacccctcccgcttgtcccccagcctctgtgtgtcaccttctctctgagctcaccctctctaggaagccttccttgctggaatgcccattccctgatataaggattccacccaccacgccccttgcggttccttgccggtgtcctgtcctgggcagacataagccctgtgggttccagtttctcattaggaacctggatgatggagcagggatcatgctcattaagtccgcagaactcatcagctgcttagcagggggccaaggagggctgagcctatgacgggtgaataagtctggttggcctctgggagtacgggatcagaattccaagtgactggggtcagtagcaggccaccaagagccatcccacctcagaaagacagaagccatcactgcaaatggcaagggcatgaggcagtttgaaactggcaaaactggacctttcatggaatccagggcttgagctttaatgctttacacttttgttttttcattccatacgcttttgctttagcttcctggcaaaattcagacaaacctagaagggataataacttacattcaacctctgcttgctctgtcctttctcacacgtgtttagagaaactggaggagcccgggaactgctttctcctctctaagagtcttggtggtttcttgtgtggaaatgaatgggaagttcaccctggttctgcaaaatgggtgcgaaatgtaaaatgtatataccttctatcctactctttatgttccacaaattttggagggaaactgattaactctctagctaccatgttccaggtgcctgcacctgcttgctcttggttaacctgcacccacgttcccccgcctgtctctgaagtattcacaggtggaggctcagatgcacacagtgattgagtgccctagctggggttggaaactctgtccatgaactccaaagcccacgctctcttacaccctcccaaaagctgaggcttcctcactgtcttttgcattatgtcatgggtggaaacatgcaccttccctgaccttttggcttggaacatggaagttcattgactttgttgcctagcagggcctggagctgggtttcttgcctgatcaatgtatatcattttgccaagagacagagtctgtgctggagagattgattccctggttatttatcttcctctgcccagtgtaaattggtcagcctgatcctattcgcatgataaaaatcataatgtctcaaattacttactcaataaaatgtgggtttgtctattattagtgattattagggttataatgcagcatggaaatttggagcaaattaactatacatgcaagctgttgggctcaagtgcagttaatcatacgcatacagtgccagtgggcagaaggttttgcaagaatagcttcaggaagactttgtgggaagacagatgaatactcagggttttttttttttttttttttcttctaacttgtcctccttgatcaggatttctcaaatgcacatttgtctaatatactgttgaaccatgcaagtaccaaaacaaaacaagaaacccagaattatagctcaaatttaattaaaatagcttttattgcttctattcatgtgtccctggattttaagtgatgcgtcagaatttcatgatgagcaaatgcctatggatgccctcatttctcatccttcttgactgtctgctaagattcactcttggtcttgtctttgagcttttctgttcagtgatgtaatgggacaggctctcctgtcatcaagagttcccatcatacctgggcactgccatttcctctgtggtagatgcttcctggacacgtgggcaggtgagaggtgctgactttgcctacttgcagctgaagagaagagagatgtagctttgaatggccacatgagtgtttttttaaatgaaaaaaaaatctatgtataacttgtttcctgtgagggtgccaggaaactttacaatgaacttcgtgaattaaacctctaccagatgaatagaggtggtggcatggtagcagaaattaggattaaaaaaatggtttttgatttatgaaaaatttttctgcaggaaattttgatttgttctttgtggattctgaggataaaattaagaccaacattgaggatgagagacagaactgaactcaacttaaaatagcttcagggaggaaaagcaagtgcattagataagtaagtgggaagtccaggggtagacgtgagttcaggcatagctggatccaggatccgacagcttgcatgtgtagttaatttgttccaaatttccatcctgcattataaccctaatgtttgctaataacacacaaacccacattttattaagtaagtaatttgagacatgatgatttttgtcatgtaaataggatcaggctgaccagtatagactgggcagaggaagattcataaccagggaattaatctctggatccaggctgaaatgatattatcagacacctttctttctctggtcctcagttttgatctcttctctgctagctttattctaagacaggcttagatgggatgtagagagcaaactctggaagtggagtacctctggcctccaaggccagtagttgtagcaaaagtccagggctgccgctcattcactctgctcggacctttctggtcacttgtcttctgtggtttggtccttgtggccagggacaatgaaactctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggcggtctgatacagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcacgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctgagcaggattattgtagaggggactgatgttgaagaatggaaaagaaggcagtgtcagagaatgctgaagagtgtggatcttaaagtccaacctcaaggcccagcgctgccacttaacagctctgtgaccctgtaaagtcactcagcctcattgagtcccccatcctcccctgtgtagaatgaggctaatgctagtgctcatttcatagagttgctacaataatcaatgagataatgtgcataaagatttacatacataataactgctcaataaagggtagatgttaaaattagcatcagcgagctctagaagatgctaagttctctggaaagatcagctctgctcctgtcaatctctccaaatgttagattttgcctcaaattttaggcattcgttcattcatttattctttcgtaaattctatcgcattaacctttacaagtgttaaattaaatcttttccccaaattatgcattagaaccaagttcttatgtggtggatgtacctcatttcagcaagagctttctaagggtacagaattaaatatgcagcctctgggattcagtgatagctcatgggacatttgacctacatggaaatgcaggctggagttgcattttaattggcaaggatcagcccagttgtccagcttgtagcttggagtgtggcctggctcccactccagagagatgtacatcatgatctgcgtgggtgagaggatactctcaggaaatgggcaaagttgccagctgacctctccagaaagagagactatgttgttagtttcccttacttggatgagaaatttctccattcctagtctcattttcccaatagaacacggaggcagaatttaaagcctcaaaacaatctgatgcacatcagctatcaatgaaaaggaccagcttggaggcagaggcacctgagttttgcatcttggctcaatcacttactaactgcattgtgggttaacacagtgtgtgtgtgtgcacttactaactgtgcaactgtgggcaagtgatgtaatctctctggagctcgtttttccttttttcttttcctttttttttttttttttttttttttttttttttgagatggagtctcactctgttgcccaggctggagtgcagtggcgcaatctcagctcactgcaacctctgcctcccgggttcaagtgattctcctgcctcagcctcccaagtagctgggactacaggtgcacaccaccatggctggctaatttttgtatttttagtagagacgggctttcaccatgttggccaggctggcctcgagctcctgacctcagatgatctgtctgccttgccctcccaaagtgctagaattacaggcataagccactgcacccggccacagttttcttttctatattgtagggataataatcctcccttgcaggactgtgctcagcacatgttcattgctcaagagaagtagccactgttattattattgtcagtatgtatccaagtgtttagttcattttctctgcatttgtctaactcccttttttcccttgaactgtaaagctctcagcccagggatatagtagcaccagcacatagtagatgatcaagaaaaattagtcattctctctggttcttcctttcctgtatcctgttgtctttatcagttcaggctgctgtgacaaaagtatcacagactggatggccttaaccacaattgttttacatggttctggagactgggaagtctaagattaaggcagtggaaggttcactgtctggtgaaggctgggctcctgattcatagatgtctgcccttcttgtgcatcttcacatggtgggaagagggtgagagagctcaccggggagtgtttctcccagttcctccccagtacacagaaaaacaaagctttctgtctcaccaggaggactccacggtgagcatagcttggctcagcccagcaggagattttgaaccgactctggtagattcttcctgcagccattcagctcccacctctttctctcaaaaagaaatccagggctgggtgtgtgtgggcaacttcaccctgctctctttgtcccccaggcctgcactacaacaaatgtctctttgtgtccaactcttcttccatttctagtccttcttttctcttcttctcgtacttcccatattcctaatacgattggttactcaaattcttaaacaactcacaactcattatctcccttccatgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaaagacacaaattgtccttaccctcatggattcaccatctatttaaaggccacaaatacttgtgtgagaagcaagtcttaatagtctgaagtattttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgtatcagtgtcctgtggctgctgtaacagattactacaaattttgtggcataaaataacacaaatcgattcccttacagttctggatgtcagaactgggtgactttctcctgagactgtcctgattttttttttttttttttttttttttttttgcttgtcagtttgttttgggtgatgcagatggaaggtaacgtcacagggcagctgtattccaggtacttggtgactcttggttgcgatctgatgactggctcacagtaggaccatgacgtgagcagatttgtagtcctgcatgaatgaaggaaagaaagaaatctgacaactcattgattcagattcacagactctgcattttgaaccagaatacacccgagcaattacctagcacaaaatctcctgtctgcagaggagttgcaggaaggagaattcactatatcctctcctgaaaatatcccttgtggtcaaggtggctatagactggcatccctctgctccctaagatgccagggactcacgtcttctaggatatcaggggaagatacagggcaatgggcctcagatcacagacacggaaaatcattttctatttcatggagcatggagaagcttccttcaaaaagctagccttcgactttctattttttgaactgaagggcaggccaggagggagctgacctgtgtagagcttggaggttgtgttttcagctgagaaaagtgatcctgaacctctccatccttgcaaagctcagatggaagcccaggggccccagccctccagccccacacacatgccggtgcacctggactgccactctacctgtttacaaattacccccattttctgcttggttcagcagcaactgattaccgtcccccgtgatgtaattagggcttcagagttcacgtgtgtctattatgagctctcctgtgctttgtcttggtgcttcgtttctgtagcagtaatcatatatatatataaaaatttggtatcaattgtttggctaaattatgcacagtgggccatcctaacctgccattaacataacgtatgctaaagaatgtgttgtgtttttttcttttctctgataattatactctaaagcatcaattgcttatttgagtaaattaaactttgagttgttcttatttcttcaaactttcaaattgtcttgcctgcagcagatgcagacccagcactccggctgctgccagtggaggcaggagcctcgttaccacctttctgagaaattcaagtgccacacagtggtcaccagcattgtagctgccctgatgttccgggctcagctgcaatatagcacatctctaccaccatccccagagtgacctccagaactgtaagggacccccgcctttggtacagagatgggagttaaacacaggtgtccactggagtcatgattcctctattccctggacaaatatgcaatgagaatccctgagggacaggcactgtgctagatacccgagatacaaaagcgacaaggtttctatcctctgacagtttatactttagtgcagtggtcagcagactgtttctgcaaacagctagatagcaaatattttagactttgtgacccatacagtcaccatcacaactattcagttctgccagtgtaactcaaaagcagccatggctgttacataatgagtggctgtggctgtgtgccaattaaactttatttacaaaaacaagaggagggccagattttgcctttgtcaaggaagtaagcataatagtgcaagcagcacgtgcccgctctttcacactggggcaaacacaggggatttattcggcacaattgagtaatgtggatgaggctgctcagggctggcagttgtaggacgcaaaaccttgaggggcatcgatattctggtacagctgtcacccatttgcagcacagctgggacactccacagagaatgatcaggaaggccaagcccagatggcattgttgaggggctttctcttaagactgcatctgagtggcagggcgcagtagctgacccttgtaatcccagcactttgggaggccgaggtgggtggatcacgaggtcaggagttcaagaccagcctggccatgatggcgaaaccccgtctctactaaaaatacaaaaattagcctggcgtggtggccggcgcctgtaatcccagccacttgggaggctgaggcagagaattgcttgaacctgggaggtggaggttgcagtgagctgagatcatcccaccgcacaccagcctggccgacagagtgagactctgtctcaaaaaaaaaaaaaaaaaaagttacttctgagttaaaatatgaagagtgagcagtacccagccatgcagaaggacatggagtggtaaaagcatgtggttccattaagggaaagactccagggcaagaaaaaaacatgtcatgcttgtacctgagggaaggccagtgtgattgcagagtatggggcaccctggaggtctggaatgggaggagtttaaacaggtcattagagcttcaagatgaagcataggccagtgacttggttgctgctgctgcgtaaccgtgtggcaactgagtggctcacggcaatcagtatttacttctcacgtgtgtgtggggttcagcagaactaggctgggcttggctgccctgccctactggtcctgctggttttggtggggcttccccctgtgtctgtgggtcagcttgttttgctcctgcatctttgcatcagctgggctttctgccctaggctggacatgggtggggcactttagctggggtggttctcctccacatgtctctcatcttcctgggaccagcagggctagaccagacatgactttcttatggcaagggcagaaatgcaagacagcaactcaaaacacataaggactttcaagtctagacccagaactggcatacccattcctctgtcacacactgatgccccaaataaatcacatggctgagctcacggttagagagggaggatactgcagtcccaaagcccggggcatggatccagagaggagggtgaagaatgggcccctgacccaagactgcacttgtatttgagttgcataagaagctgctgaggaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaacgagaaattacagcccagattagcagccttgagtgctccttgtgaacacaagacactgacccaaatcacacgtcacggctcttcgcccattaacgcttatagcaggattattcccaaggaagctgtagccattatatttgctgccatcacaacagtaaaataaacaggtgtgactgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacctaagtgtgcaatgctttaaatcagtaagtttgtttttcattaacataaaatccaaaacaggtgctgtgatcagcaagccgctgtcctccaagtggtaattcaggaacccaggctccttccattctgtggcttcaccttgaccaacgaagaccttttgaggttgccacattctccaggccactaacacttatgtcattggctacaactcagtcacatgaccatggctgcctgcaagggaggctgggaaatatagtttgctgtgtgctgggtgggtgggagggagcgtccacattagtgaacagccaggcagtcgctgcctcaaatttctttagggttatcctttcattccagcaattgaatttgatttgcactgtttcacttctctacaagggtgtaaaaagtagaggttcctcttgaaagaatttcctccccatctaattaggaataaatagtaacttctcttagaagcaaagttaattcaaagacctgtgctaacattcttaaatatctgctagctgtaatgaagaaatcaatgtactttatgttcttagctcccacagtttagcctaaatatttgccctggcatgcttatactggtccaagcaagcattaggtcatagcctgttcctcttccttatttgaaggtgtttttacctttctcagcattccacaagttacttcgtccttcctttgttctcctctgcctttgcctcttttttctttttttattttaattttttttttttaattatactttaagttttagggtacatgtgcacgttgtgcaggttagttacatatgtatacatgtgccatgctggtgcgctgcacccactaactcgtcatctagcattaggtatatctcccaatgctatccctcccccttccccccaccccaccacagtccccagagtgtgatattccccttcctgtgtccatgtgatctcattgttcagttgtcacctatgagtgagaatatgcgttgtttggtgttttgttcttgcgatagtttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacatatgtttattgcggcattattcacaatagcaaagacttggaaccaacccaaatgtccaacagtggtagactggattaagaaaatgtggcctttgcctcttttaaaaagttctaagttgctagccagtcggaacaaatacagaatgtgaggtccctttccagccaatggaaaccggacacagcagtagagtacacgtgtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagcatttctaacaatcatattgcttaagaagtggatggcaagaagataattactaatatgtctgcaattgatctgaaattgacacagttgatctaactgattcatggggaccctgggagtatgtttgtgtatttgggggttgggatgggggggtgggtggagggtcagagaggtggcaaaagcaggtgggaacagggttacagagcaaagtaattagatgccctttagatgctcttagttaaagaccatgcaaaaaggatgaaatcttttgatcatgttcttcacaatattagaggtaaaacatgaactcaacgcttttaggaagaaacaactggattgcgttttctattttattgacagaaactagatggggaggccagggtgtgttttattattgcacacatacgtaattacaaagtctttgcttttttcccctacataaatttattttgagatttaatttccaccaattagaacccgaatgaagccgttttaatgtgattcctgcatcccagcaacgtggccctgcttcttagtgcgcacgtaaagaaacaatcctggagtgaattttaagtacctaaagttgtgttagactgcaaatgaatatccaattcaatttgtaggaaactttagattaattaggtttataatttgcacagtaaggtaatgtaaatgtgttgctacggcttgactttttgcttaatcctctgagtggatatttaatctttttaatattagaattaaagcaacttggaagatatgaatattaatctaattatattccgatcactttaatttctttaatgttttaaataacaaaacaactttacaaattggtttaggttggggaacgcttttagaggattttgcatctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggtaggaagagtttgccagcccgaaaactccagtaagcaaacagctttatagtaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggctgtggttaggctgacataattatgagctgcatgtaccaatatatagctctttacccacaaaagcatgctgcaacggggaatctttcagagataataaaaggattcatcaagtgtctatacgatagctacttaaatcgctattgttttagttaggcccgcaaaacatatcccccagctatcccggtttcttatctttcttacttgatatttcaggaatttcaagcttttgtacagcttgttcagttgcatcctagaggaggaaaatgcttttggcgtgatttccatttcaagatgacaacagggagaagtctttccaaaatgcgcgtgttgcaatttcagatttaatcaggggaatacattaatttctggaactaattacagattttaaaagagtgatgggtctggtacagtggctcacacctgtaatctccacacttggggcggtcaaggtgggaagatcccttgagtccaggagttcaggaccatcctgggcaacatagtgagaccttgtctctatgaaaaaatgaaaaataattagccaggcgtggtgtcgtgtgtctgtaagtcctagctactcaggaaggtgaggcgagaggattgtttgagcccaggaggtggaggctgctgtgaactgtgatcacaccaccgcactccagcctggatgaaagagtatgacctttgtctcaaaacaaacaaagaaaaatcataaaagggaggcagaaaattaactgaagaaattgtgttataaaaggcagtgttttaagttctagaattaaaagcaattgcagcaaataccaagtgagattttctgtattttgagagtttgtgtgtgcaatggttttccactgactaatcaggctgataaaacaacctgaaaatggctttcccatggagtttatatatttcgtcagagacctaaaatggtataaatgttcaataatagccagtgaatataaaactaaataatccatatgagacaaaacaggtagaagaaaaaaacattcctcctcagatatgcaccttttaattgaataaagcaaacagtaacagtgattaccaggacacttgctgttttctgttattttggtttatattgcttaattagccagcctttctaattaacattacattttgctgagttcacattgtgataaagatgaatatcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcagaaagaagttacttcccattccccacctcaaggccctgtccaaactgaagattcatgggcagaataaacaattgctattttttaaaggtgtatgtttggggttgtttcctacagagcaatgaataaccagagcaaacacccaagggcaataaattatgaatagtgaatttaatttttctatgtgacctatggaatcagcctattttatggcagtacaaagtatatgtagcaaccaaacagtttcttctttcctaaaactcaaagtgagtcagacttcttaggcttgtagatgttgaggactaagctttgctctttatcttctctttatggatttccctttggaagcagggataagaagagggaaggtctcccagatgtaaatttctcataaatatttgagctccatttcagtaattctttcattctctgatctgttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagtaataggctgtcactagaccaaaaaaaaaaaaaaaaaaattcagcatttcttttcattggaggttaccccagaacacttaaactttggagaggaaaatagaacccctgaagaaaagtgaattctcatgacaatttgtacattctttgaagaatgactgtaatacatggaggagttaccttggacccatgtgcagagtagtgtcgtgaatgaggcctgtgccttgtcctgtggtttaaggataggtaaatgtatctggggcagagggttgcctgggacaaaggcattataagcttattcatttaacttgagtacagggtttctcaagctttggcactgccaacatgtggggttggataattttttgttgggatctgccctgtgcattgtaggatgtttagcagcatccctggcctctacccactagatgccagtagcatcccttccccctcttgtcacaaacacaaatgtctccaaacattgccaatccccctccattaagggtcatgtctcttggctgggataagtcttctctaccgtatccctttaactcaagaagtttttcttgctaagtttatgtgatcttgaaaatacggtgagattgaacttgattttctttaaaggacaaatatctgcttcttccaaattgtcataggaatagttcaaagctaaagagcctttcaggcaggctgggcacttcaaacctacaaaacatagtgctaaaattaaggagtgtatagtcgtgtgtttatagggacaggatatttattatctatcacttttgaaaatgtcattggcattatcgttcacttttacaaatacgaaggaaaaatatgaaggagttctagaaaacaccagaagtgattttgccgccatgggcctgaattgaagagcttaacccactaatctgttatgactgcttggggagtgctagcgcaggttctctaacacactgagagtcgtttggagggtagtgtgaagtggcgttatagttctccttttaatggttgagacaagaattgcctggacctcttttaggatacatcaccagtcttccaatggcaaacgtatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcttgtgataggttcaattctcaggctccttctcattagagtctttctgtaaagaccattattatttctgttatatttcctgtggctgagctgagccgcacttggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaataggcaaggtagaagacataggtggtcaagaatttagaaagacccggactcgaatcccagctctgatccatctcagctctgccatattgccaagttccgctgagactccatttactcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctggatagagagagtcaggcagatataggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaaaagagggatggaaaggaggaaggaaggaaaggagggaggaggcaagtatattagtcatgatatagggaattgaaaagacattcacgttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcaatgtttacgatatacttctactaaaatattattttattctatactaacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggagattgttatcagtcataagctttataggaaatatctccttttgaaaatgacattttaaattaatgtgaaattgtgttttaatttaattcacagggagtcataaacaggtgggagaattatggaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaatatgggtgtgatcttgacattgagatgtagagcttgacacctgcatataaagtagaaactcaacagtgtttgagaatttgccattgcatctcagtcttttttatttatatgttttttctttttttgagatggagtcttgccctgttgccctggctggagtgcaatggcgcgatctcggctcactgcagcctccgccttccgggttcaagtgatgctcctgcctcagcctgcctcccaagtagctgggattataggcgcatgccaccatgcccggctaattttttgtatttttagtagagatggggtttcactatgttggccaggcatctcaatcgttttactaagaaatttggaggccttgagaaatgggtaaacttgaaacatttaaaaaagttgttctgctaattatcctaccacgtgtgtcagagacaacattaccctcttattacttaaaagtaatttggactggttcgcacacacaaaaatagctttattaacaacttgagtaatttatcaagttcagattctttttttcctccagaaatgctgcttttggtacactgagaggtcattcatttaaagtttgtccttggcaattccttattgaatagattccattttattttatttacattttgtacaaagctgataaataactgaaaccaaattagctcaaactggttatatttctgggtacaaaccaggtgtatagttaatccattgttgtttctgtgtcgaccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatctccctctccagtgaggcttttggccactggccgttaattggtaaggttcttgaaaactgaagtgatggtatcagcatggatgcccgtgctttctgatgccactgaagatggatagaagcttcaagttatgctttgtgcagactgaatttttccaatttgtgcttagtagcatcttattatattagaccagcactgactggtgatgaatagcaagattgctcccttctaagggcttggcaaaccaagaagaatgcagtgacatatgtcttatgtcttcaaaagcaactggacacttgaagagtattttctagtctcattttgtaaacccaattacgagcggagctacaatttttatctttgtttaatgtaaccaatgaggccattgtcactgtatggagaatagctttagtccatattctctgttttttaagactctcagtctccttgcaggtgcctttggagagttaggtgtttgctgtgatttgagggatagtggccaataattttattgaaatgaatattggttaattaaagcttattgtatgccatgggccattctaagaacttccatccacccaaaagcactatgaaatagatgttgttatttcactgatggaaaaacaagcacagagaggctaaggaatatgctgaagcttgcacagctagtaaatggcagaacattcagactggaattcagacttatacactcacattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctaaaatgttaggaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatacccattcaacaattagaagctgctgatttctggacgagagttagtttatttagaaagtaacactcagagacactgggacagagaacagatccattttaaggctgtgtgagcactgatccatgacagtattggttcaggggcaaagaatgggaggaaagaaaaagacaagttatagctgcactgaaaacaaactgggcatgtcctaattttgctcagggctacttctcttagagtcgttaaggttttgagcatattaacagcaatactgatcatagctaatatgcctctatgtcaggctctgtactgggttctttgagtatactcaccacctcctgacaaggttttggcagccttacttggtagacactatgattcccattacatacatggaatgtacagtaactgaggatcactgtgatattgggaaagtgggacttcagacgctagcctccccttgtagtgcctgcattcttttcacagcccctccccaccttagaatcattttcttcaagggagagtatggtttgtgatgcccttatcagcaaaacttcagctagaagatgcaagggtgaaatacacctccccaccccacgtgatctcatagcacagaatgactggccaccccagactgaaggttagggagactgggggccccagactcaaggttggggagactggggagagggaaagcgaggaagaagcgtaagtgtatcttacagtttaaaaccataatgggacatatcattttcttagttctccatttattaataaaatgcccaataccttctggcatgtgctttgaactgcttttaattatcttcagttggatggagaaaaggtaatggggacctcataatagtcgtggagggacaactgggatttatttccatagggaaggcagagactgtttgccagggaaccaaggcctttcaaagttgaggacacttcccggtgccgtgcggtgtaaatcacagtgcaaactatgcgattatcccctgcagaggaatcgagtgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccccttgaacagtgcttgagagtatttccattataaatgtcgaatcggcattgaaggaacatctgttttaagtcaacttagactcaatccaggaaaaaaaataaatttctggctgtccacctgctcaaaaggtcaattacccacccaaatcagccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttagatatggttacccagcccaagccgcctctgctctttatagccgtgtttttgaagtgttcttattttttgttccgaaatcggaatatttcctggcgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaaaccaaatggagaattccaggagcggatttggaaacaaggttgggtctactttggcctttaagccatcactagaaacactgactcttgcgcgctagagtgatgtttttccttctcttttggattgacgtgccagcacctcaagaaacctctgtgaaaaatccacaggtcttcaagaaccagaagaaaacagaataaaaatagctcaaaataaaaatgaaaatgaaaatagagcaaacatccatttctgtgggacctaaagagttgggaaacctaaacaaccagatgatgatagctgttgctgctcttcctgaaatcaattttaaagtaggaattgtcaaagataatgagactagtatggagcaaaaactggcaattttcagttaaccagaatgttgcatgaattagaaccccagattttcctggagatgactctagccaggccatttgaggacaagttgccaaatatttgtattttagaagcctcagaagtgtgcacaattttctagttctcaacaaggcactacagcaacatgtctagtgtttatgtaaatgatctttataaatcctctagctgatagagagttttcttccatcacaggcaaaatgtgggtttagatgcaatttgtaatattgttgtacaagagtggggtcctttcactgacatatacgaagtgttgtaatacaaggcaaagaaaatacaaacccatccttagtcatttagaaagacaacctggttgagaatttaagatgatggtttagggcatagcttgtggaattcgatgggttgcactgtaagtttcagtttccttatctgtaaaagtaggaataatatctagacctaaaggttattttgaagattaaatgagataatgcgtgaaaagtgctgactcagcacctgcagaacccatgcgtcgtcatcatcacgtttgttgagggatttgaggcgtgtctaggaacgcagatgtggagacacctggagcatcttcaggagctgtttctgcggattctcatgtggcttatcaagcacaggaaatagttttcctggaaagacatggagcaaagcagttatttagccgtccatccggcactgccaacctcttcgtgttcctgcaaggattaaatgagagatggtgacagtagagagtcagccctgagggaggagtgtacaattcatgggctactattccatgtgtgtgggtcaggagacgcttaaggcattcacagcactgggtgtgaggaaggatgcaaataagcttaacttatttatgaattatctgccctggaatggcattctaatgttgtgttggaagagagacaagaatgtgctgggaggatactcagtttataacggacgttctgatggccagtgcaaatggcgccaggaatctgtgtttatagagatggagcatggatgcccctgagcacctgtgtgtgtgcgaagggtgaatgggttgctgggagttcgtcggttgtttagggaagcacttacgtgtatgcctgtgtgtgtctctaggactcactctccacttcccaccttacttattattagtgttcttgtttctcttcgctatggggaaatgcagataaaccgtaaaaacttgatagagtgaacaaaggcttcggaagcttccttagttcttataattgctcaatgggttcttcttgcctgctgcacaggtaaaacccagttcactgagatgacattatggcaggaaagaaagagtttaattaacacaagtccagccaagcaaaaggacaggagtttattattacccaaatcagcctccccgaaaatttggaggctagtgttcttccaggatagtttagcaggaagggagctagggaatggaaaatgctgattggttggggatgaaatcattgaagtgtggaaaatggtcctcgtgcactgggtcagcctcagttccagttgaatcacaagtcccaggcctaggtggggtcagtgggtcatcaaaatgcaaaagtctgaaaaccattccaaaaaaaccagtcttaggttctacaatagtgatgttatctacaggaataattggggaagttccaaatcttgtgacctcctatgcctacatcttagctgaattcagacccctctcctaatcctaaccttgtggccttttaggagctttacaaaggtggtttcatttcgggaaaggctgttatcattcttgctttaagattaaagtataaactaaattcttcccagtgttactttgccctatgcccagggatgagtgaggactgccagcccgtggggctagaagcaagatggagtcagctatgctgtcatattcctcttatggtcacaatttcacaaaggtggcttcattctcatgaccattgctcccaggcattgttcttgaataccttagaaagtttcattagctcatgtctctcctctttgtaccaccttccaacatttccctactgccttggacattaaagtccaaatccagtctgttcatcatgatctgtggagcctttgataatcgcagcctccagcttctccttcacacctgtctcctgtctcctgctttttctttttgtgcactgcccaagaaccttttcatctactaatctttgagtttgccgtcctctcttcctaaatcactcccctccctccactgttccacgtgggacgttccttccagagaggcctcccttaagcccaccttccatacctcctctggttatcctcagtcatgaggccctgcttcctcccgcacactgagcacaggcagtacctgctttactcatgtacttgtttattatctgtgtcacccagtgggacatagtagactccatcagggctgggaaggaatctgccttcgtcaccattttgacatcattatcaagtgcgcaattaggctcacagttgagctcaacataggatctgtggaaggaaagaaggacagaaggaaggaagggggaagggaagaagggaggaagggagggaaggaaggagggaataatttccaggaagcctcattggatttctttcccccttatttctgaaagctcacctctttacagctggcaaggccagcagaactgaacaatagagccggattaagcaagcattcaggtgcccacttaattcaatcggcgaatttgcatttctcaggctctgtgccatgagagcctgccgcctcaagggaccacctgccttctaccagaaggactttgctccttggagaatttccctctggcaatggtccaggtcaaacgaggtaccatacaaatgtggcttgtcaccattttccagtttaactttctcaagccttggctgcctcgatttcattccagactacagtagcagctgaaaaggtagctaccattgcagtcgaagacactggcagatgggactggcttgttggcagagatggcagagatggcagagatatgaactatctctgaaagggcattctgcatgccacagttaagtgctctgttgaaggacggctctggaagggagcatccgcgaaatgaataagaaggtggttattagtgaggtctccctgaaaggagcatagctggatgcaatccttggaggccctgtctagggcctgtctggggctccagctttcatagggccggccatcccctttgctctgggtgagatctgtctttgcttctggtgattctgatattcactatcgagaacgattgctttaaaacacatcagatcaaagttttctaaaatcagagtaaaagctaaaacctttgcaaggtcctgcatgacttgagtccctgttcctcccttgacatcaaaatggctgttgtctgctctcgctctctctctttctctctctctgcttcagctgtcctgacctccttgacctttcttaaaaactttatgaaaactccacgtttgggcttccctccacctgagatgctcttctcggctcctgtgagggctacccctttaccctttatagtgtctgcccggacatctcctcactagagaccttccctgaccactgccacatggaatagtactaatacttcatgctcatcctctgcctgccctgggtttttaatttgtgcgtgtgggtggggtggggggcgggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattactgaggactttgtggttcgaatggaatgagtgtgctgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcacaggggatgggaggggggctccggaagatccctaacccattgtggacacaccatttatgttagtggaatctggtaagagtgattgaggagagagcattgggtgaatgaccctgtaatccttataaaaatagtagcaacggtaactaatgatgtttatgaactgcctaagaatgccatgactgtgtcaagcacttcccataactagctcatgtaaagcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctaggagttcgagacctgggcaacatggtgagacccccatctctacaaacaacaacaacaaaaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttgtcttacgcacaggcgtaagatatgcatctatcttggtgtgcacctgagaagtagttatgtctaagtttccgacttgacttggtagagtcatttgatcagtaaagcgcagagcagatgaactacctggaaagaaagtgccggaactccccacgtgtgacatctcacttcggggaaaggtgggccctgcgctgcgcttggcgaaggtaaatgcacctgggtatcctcttgacctggaatggtggaaaataaagaaaacttcagcatgtagcaagtagttgtgagtacgattaatgctgtttagagttgccagttctcttacgcactcagcgaaggccgtgtggcttcgcattaatcaccaccaagccaacatgagcttccagcaaaagagcccagtgattgggaacaaattcaaaacagctttatttcattgacagacaggacctttttgttaaactgtggtttaaagacctttacatctctgtcttgttcacacgttactgtagtcatttacgtaaacttaggaactaagaaccgacttatttatcacaacctattggcaggaaaagggtcacataaaaaagaatctttattggtaggtttttttttttttttaaagctaataaacagtgctagtggaaagtatgctgttatcaaccattattgaagtaagtgggtttctggactgaaaaaaaataaagaaaacatctaaatgtcagtgtgcaaatagaaagtagcagtcaattaaatgaggcagtgtgtggtcaccatagatggccaatgtctgtgttattagggaaagaagagaagccgggaaggaggaggaggtttctggggttaacctgtgttttgctaactggtgttagttagtctcagataagagctctatgtaaaccaactttggcccaaattgactcattgaaaaacaccttgtttcaaattttttccccctctatgaccaaaaagttacccaaacctttgtgtcacatatttaaggatgttcaaggcaaccaattagtattcaagcatttagaattattttgaaacatcttctgtgaaaaacaatttatttcctattccaaaataaatgcagaatattcctaatatagtttgatagttcctcctcaagacttatcattcaaagattgggcaaattgacttgaaagagaaaagttaagctatttccctaataccaaggcaatgcaggtcagctgcagtgcctaatgtttataaaacttgtaaatgttgaaacccacacttggtctgagagaacatcatgctccagtttgttcttaggaatgtgtttctgatgtgtgtgtgtgtgtgtgtgtgtgtgtgtgtgtgtgtgtgttttccagaaaccaactgggaagggccctaagctgagattactgttgagaagtaaattgtgcttttaaagtgtcctccagcaaaatggtctcctggctgtctttggaaatgacgtatcagtccagatgccctttttcttgatggattgctaggatttttactcaccaccgatggaaaattctcatagtctggaagggtggagcgtctgccttctatcatgattgtacacagatgagcaaagctccttggcaatgagtgaggcagacgggcagtcaggttcggactggtgcagcaggtaggctgctgctagggaggaaggaagaggcacagaagttcagggcgtgagagggtatgcgagagatgtcaacaatccaggagctggcttgcttcttcctttagtcagtggtgcaagcttcaagtggataattcaaatgaatcaatggaaaggcctcttttaacatttgatttgtttcttcaaagaacacagatgaagtttttctcatctctttagattagtgattctatattggtgagggagtggaagagaaatgtgggtgtgttgactatattctccacagaaactttttgaagtagcatcctcactcagcacagaacattttgacaatacacttccagggcaggtggtttcttactatgtccctccctacccccacatactttgggactcagaatgtagggagtgtactctcgagggatgcggcccatacgtgaatgcatggaggcagcatataaggttgcaaagcactgaccttctctttttatgattcccatttattccatagactgtgaagtctgcctgtacatttccaggctagcagtttttaatcaaatgtatgatcactttcttctgatgaacacagttaaggggctttgttgttcaggtgagtctcacattgtactcctctcctaagagcatttattattacttgctacatacatttttgacaacctgacaatgacttttttgtcttaatttggagaaaacatactctgagcttttgaagttggtgtacttgttaaaggaagccagaaaagcttttcaaccatttgagagggtgtgaaatacagaaggggttgtgcgtttcttcccccctcatctcttagagccctgttacccaagagagttcaccaattacccaaaccaagtttcattttgttttctctctagtttgaaaactgtttttattgcttcaactctccttgtctaggagagctgtttcaggtttttagagtcctaagaaaggcttcactggctctctgccagcctcctgtcccattacacgctcaggcttgtagtcagttactctctgctggttttgctaaaccactcttgggtctttcttggcctcctgccccgcattccccttcacgttgtaaacgtagctttttaagttggtcccttgattgcttcaagtaattgatctgttggcctaaaaatgagtggctctgattcagaggtaggagttaaaccagattctgcctagggacaagtgtgttgggagctctgcttctctggagacaatggtcagcagtgttgcaaccaactccatgtctggtgcaccagatggtctcattgggtggtagggtggccaaaccttgtgtgagctggctcacttgttcattcattcattcgtttactcgttcttttttgtattagcttaaaaatgcttatacgccggccatggtggctcatgcctgtaatcctagcactttggaaggcagaggcgggaggattgcttgagtctaggagtttgagaccagcttggccaaaacagtgagactccatctctacaaaaaaagaaaaataaattagttaggcatggtagagtgtgcctgtagtcctagctactcaggaagctgagatgggaggattgcttgagcctagggggttgaggctgcagtgagctatgatcataccactgcaatctagcctgagtaacagaatgagactgtccccccaaccccccaaaaacagaaaacagtattcctatcatatgcattctcaactctgcagaggtcctgggtcacatttcctgcaaagttgcactgcctcccataggcatgagacctccacatggacagaatttcatgagtgttcaccttggtgttgctactttgcaacatagacttgaagattcagagaggagatgtggtaagagtttatttctggacagagaaaagctacaccattcatctagatctcattaatctgtattcattttgacatgcttttctgcagttgacgtttttatttattaagcgctttacaagatattcagtatcattatcgaagctataattattaatgatcaaagttagcagtacttgttttagctgtcatcttcatcatcaccatcaccatcaccatcgtcatcatcagggccacaacagcctcttcttttctcttaaatcttccagcaattcttcaactttgcctgtatatttatcatacaacataatcctagtatttagtaaatgcttagtctttgatttcttattttcaaatgcatgtctttagaaccagaatgtgtgtagctgttttctggcctgaatttgggctgagatgatgagaagtttagttgccactttcagcttagtggaagtgttttccccatttggactccgggtcattgacaaacgtcatcactgtttttagttgaaatgtgcttccatgtggctgttcatcagcacacccatatctagacgtgtgctagcctcagtgagagttgcagaatctgtgtattcatttcctttatctagaaatcctcattatggtacataaaagagctttctatcgcttttttacattatagtagttattcgttattattattattattattattattattattattattattattactgagacaccgttttactctctctttgcccaggctggagtgaaatggcacgatcgcagctcactgcgacctccacctcttgggttcaagtggttcttctgcctcagcttcctgagtagctgggattacaggtgcacgccgccatgcccggctactttttgtatttttagtggagacagggtttcaccatgttggccaggctggtctcaaactcctgacctcaggtgatccacccaactcggcctcccaaagtgctggggtttcaagcatgagccaccgcgcctggctttgttattatagagttatatggatttatcattttaggtggagatttgagtttatgtctcctacagacagccgtagactttgtttcattttaagatcagtgttgcagacgctgctgagtgtctccaaatgtctgttctccctttattacctactaataaaatacctaattttcaacagcctgggaagagactatatttccctgcttgcctttgcagctagagtgatcctttgatgaagttctagtaaatgggacgttagcagaactgtcgtatctcagggcttccgtagggtttataactgatccactgagagataagttgagagcttgagagtcaacctttagaaaagttcgtaactatttgtcaaaattaagcttatgtctgttccaggtagtaattttaaaatgggcttatattttgtatgtcctttttaatttcctttttctagcaattctcaatgtttttttaaaatctcttctggaggagggtacccttcacaaagttatttgccaaaggtctgagaaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagtccgagcaggcaactccgaccccaagttggagctgtgtgttgaagatagaagagcaaatatgtagaaggaacctggatttctatttttttaaaaaatataataaatcatccagccccaaatgtcaggaacctgggtttctaatgatggttggctgtcacccccatttcccacactttaaatgagagaagtaaacatctgacttcctaaaaccaccgttctcactcaaagccgaatctcatcctgactgaaatgtcactagtccttttttttttttttttttttttttttttttttggtcatattttctccatttggagaggctggctgacccatcaatgggcagtgtgggggaatggagagacctgggattttggggacaacagtgaccatgaggggatctctacactcctacttggaaatggagtagcattctacacttaagtatctccctttataagctaggaatactaagaacctaagagtctccatgaggattagatgaggtaatgtttgtaaagaatctgagatatagtaagttgatcagcatatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacattcgactattccctactcctcagtgaccccaaagaccccagagaaactcagtatgaaaaatcactatggaagtgcaatagttattactttgtttggaattcactacaacactgtttctcaaaatataattcctgagtcacttggaagattacaaccaactgaattagaatctctggaaggcatcctaagagtctgcatttgtatgaagcttcccaggtggttctgctcagccctaagtttgaaaactactggcagaatagtagcagagttacttattctacattcgttttttaacccattgtaaaaatcatacatgtatgttcaagacaccggcagatcacaggaagggaaaaaaaatcacttatgcttccaccaccttaacctagaaacctttaggacttttcagtacttcctttctgtctttttcccctatacctaagtttttatttacaatatagttgtagccatatgattgttgctttcattgttgcttacatgtgttaaataattttgtctctgtataataacaacctctggcgatttttcctttctctctctctcttttttttttcttttgtttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaaacatattaagttatttttcagaattatgttttttcctgttgcttttgactgtaaagggcagacttaaatttagttaacatctgctctaacgttggatcatgtgtggagtccccagttttcaacattaaaaataaagtatttgttgaagtggggtttttttcttcttacagtatatgtagaaccattttcttgaaaatgtttcttagaaatttgttacttagaagatttgagccaatgatacattgccgagatttgtaagagtaagaccagcctacgctgagtattattttctcaaaggaatattatgaggcacatcccatcttcatatcagggaacaaactgtcacattttagtgaaatctgtgggttatgtgtgaccacacacagtgtcgtgtttgctccctttacagaaatctaagtaaaagaatcactttttcctagtatctggatgacttgatttcttactatcttgggccttcttggaaaccctgaaatgtagccttttcatcttaattcacaaagtgttcattctcacccttttccttcatgagaattttctgaagctattgtgaatctatggaagactcaaggtagtatctttttcacagcattcaaaaaaatgctgctggctccttggcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagccccccacttaggtgttatgtgactgtggtcgggttattggtaacatcttcttgctcagcttcctgacctgcagaatgggaataagaatacctagcacatagggttataatgaagatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtatgaaatgactgtttttatagggaaaaacagtagccgatcatcaattccctaaggttccacgtaataatttgtccaggtctcatagcaaaaaggtggccggatgaggatttgaacccactgctctccaacccctaagcccgtgctttgtagaattaatcggagctctaaagtacttgaccctgggcctgacaccaatcaggagcttaaaacccattagtttcttttttgttttatttttgcccactattaaaatgtgccaaagtaataagatcaaacagggcccctgcgttttgacaaacatccgaattctgaatttcagcgtggaacagggcatggaaagcaaacacaatggggaaaattgccgtggccggtcccgacaatgtgtggattaaaaaaccacacgcatgcacagagacctgatgtgaatggtatttctgagtggaagctaagtaggagctgaaaatggccttttaaaatacagaacataaggatgcaattcacagagatggtctaaactgtaaacatgcagctgtggggtttgtgaggctcattgcttacataccgacagcatacaaattgtcaagtacttaaagttccattgttgctgaaagggcctccacccaatgtccttaaatggtcccccctttttttttttttttcaaaccacaggatttacatctctcgtagcatctaatgaaataccagcaagaattgtgtgttggtgtaagaaataataatctttccaaatccttttgttttgttatcatttgctaatagagatctttgaaagaaaattcaaagattgaagtttgtattctcctaaactcctgcaaagaagtcctgtgcaaggatcgttcactagtgttctgcatcgttcttcttactcaactctcccgagaggcattgtggacgcctgtggggttggtttttggcacccatccctgaccccttcttctccaggaaactctgttcctacctgctcctcttgtggctaccttgggaggtgccatttttatcaaggttagtgtgtggttaagcaccttgccacaagctcaggggaaaaaaaggtcccctccccagattttttttagaactggaagtttccatttcctggcactgctgaaagctctaggacataaaacttgggagccgatggccttcaggctgcccataatgtgaagagaggtcatttcagacattcagataaagtctgtggctccagtatttttctaggtcttgctccctccctgaccttttcacagtttggtgacacaactcttccttgaattccataggttgacaaattcccctgagtttgggttagggttttgttacttgcaaggcaggcatcacagggctgctcctggccatgcatagctttggaatcacttctctgattctcatggctcgggaaggagaaagtgtcctgtgtgtggagatggcagggtggctggagttgagaggagagtcccttgaatgccacgcaacatttctctctgtaggtgtcctctgcacactgtccaaactccatttttaaccttgactgcatagtaccatgtacattcattaagcatccctcgccataggagaatctgagttcctgggagcatttaacacagttcctggccttgagtaaaaacttcataagcacttgttgaattgaactgaatttgttgtctgtgtttaaaggacttgatggataaagggagatttaacagtttatagccagattggactcaaccatgatgatttctggtccatcttttagaatggcttcacttctcttggcctttatttctccaagtggtgataatgagacctatccctaacggttaaagtgacatggtccatttaaagtgcttaaaccaattgccaggcacataataggtgctcaataaatacttcctttatttccctgttaggcctctcccaaccagagatcaaagatgattggccctgaagttatttttccccccaaatttgatagaaatcagtagagatgctaaaatataatacatttgacctgcattgatcaaggtaggctaactgctataacaactttacaattagtgccttaacataatataaaatgacttcttgttcatgtaacatccaaggtagctgtacctagttgcaatgctctcttccaagtagatatttagggacacgggctccttctatcttctgtcaccaccacctttatttttagcatccgcggtcttagcaacagtagaaggaaagaatggagataagacagtgggtatttaatcaccttagcccataagtgactcacgtcacttctgactaccatatccaatttttgcctctctttttttcttgggttccccccgacaaaaaaaaatatgacagaagtatcacccatccagccagccagccatcaatccggtatccattcatccatccatccatctaggcatcccaggtgactcattcctgtgaccttgggagacagtctttcttcctagaggttgtttgccccaaccccctgttacattcttgaaccatatgtttcccattgtttgcacttcccctagtcacctggtgctttaatttttgcctgtaaccttctgaaactttccttaaatgttcggctttgacctgtcattcactaagtctttcaccatccttcactcatcttacctccttcttctgtggcatttcataaatttaatgattgtaattgtgattacaacataattgtttgtgtctaccccaggctttgcaacagggaactatatcattattttgcagacacaacaaattctgcaagcatgtatctttggaataaaggagagagggttggacacaaatgtgattacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttacgataccacgcactgctttaggcactgggaatatagcaggatatacaaaacagaaaaatcatggccctcatggattattggttgtgagtaataggaacctttcaatctaacttaggaaaaaacgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctctgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatagaattcaattcttctcttgccacaaatcagctgtttatactcctctttgcacgttgcagaagatcaggaatttgcacattatagccacaaccatacccagaaccagattgtctaacactgaatctcgaatccaaattcctggatttggatggactcaatctggacccagtatctacatttggtccagtcatctgtatccggcatcggggtcttgttgaaaaaccatggcttagccgggtacagtggctcatacctgtaatcccagccacttgggaggctgaagtgggaggatcgcttgaagccaggagtttgagaccagcccgggcaacacagggaggcaacatctctaaaagaattttttaaggaataaaaaggaaaagcatggcttttattctaagagcaaaggcattttgtatatttggcaggtatcccaacagatgcatcacccagtctcttaaattaagataataatttatttggcaagtgaattcttctagtgtagttagatagtgatgaaaagatttttatacctccaaacacacacacgcacatgcacacccaccaggctcttctttacttctcactcatagatttgaaaacaactattatattatagaagttttttggtatagctgccaggggtcattgtttccatcccctgtgtggagataagaaaatcgagatccagtggagtgtggggtgctgagagaacaagtctatgttttcttgagacaaagtcttgatctgttgcccaggctcgagtgcagtggcagcatcttggctcactgcaacttctgcctcccgtgttcaagtgattctcctgtctcagcctcctagggagctgggattacaggtgtgcaccactatgcccagctaatttttatattttcagtagagatggggttttgccgtgttggccaggctggtcttgaattcttgacctcaggtgatccatccactttggcctcccaaagcgctgggattacaggcatgagcctaactatcctcattaagccatctgctttctgcagtcattttcatggcgatgtgttataacaggacagaccttgtactttggaatcaaacattctcaactctgctatctgctctttgtggggccctgaacaaaaatctttactctctttgagccttcgcttcctcattggtcaagacttttctcactgcattatatttgagtgagacccgtatcaatggattgaaattctcagaaacccaagaccaggaatagcccagtgacaggaatttagaccatgccaagtgtgaaccatggcttgcgggggctcctgtctcacgctggatgctcctgcctggctgcctctggtctccagcagaagacctgtcgtgcttgagtgacaaagcagattgcttcctcccacctctgtgggttaggacccctttttctatcctagtttcactctgatgggcgagttcactcacagtgaaaccgtagcaaaacctcaaggtttggcttaactgcaaaggggtggttgatatcagattcatacgccagaaccagaagaccactcgtgagaaattctgtaagcacaggagtgtggtttatgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagcggagttccagagcatccatctcctttgtaagacacagataataccaactgcatggatttgttatgagagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcccgagtgttttgatttcatcctatacctatagttacaggccatttaagatccacagtctgctcttttagcttctgccagcacatttggacatctgtgcagttcccagggcaggtgaagagttgttcatgtgatgcaaacttttgagaagggacgtgtagggaagatgggagggaggtgatatttattgagtattttctttttgctttcagctttataccttgtgtgtgcttacagaggtcatgaattgtccgctgttgtatgtgtaatccgtggcagatgtgcataataagttcaggaggggctcggttttgggaggccggggatactagaagataaccctaaaatgtggaaatctacatcagagagtggtgtgagtggttcccaaaatgcctacctggcactcctaccaaagacacagcagagaacttggggcctcttgtttcagccattttcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgacacttccagatggaaatattaagagccagtgtgtggttcaccctgaccccttcctatgccccagcaattaaggaagcaatgttcagatgaaacccatgtcttcctcctgggtccctgagtgaccacagtcaacagagcttccctgttggccattactaatgtcaagaacaaagctgtgtaaagtcactaagattttggaggtatcggctgttgcagtagaacctagcctatctcacctgacacaaacgttttctttctcacaaaacctcacaccagtgttgttttattcatctgcttatgcacgcgtatggctgcaacatccttccaaaatgcattacaggctctaatgcacgataagacagttaggttcgaaggaaaacaaagacaattgcacggcacagagggaatatactgctacggtaaaccgatcactaacacccggccctgaatttgcttcaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggttaaccactcgcatcagttttaagtctccacaggcagaaccagaccatcgtgaacttcttgatttacatggtggtggagagtggctgagaaaccagggagaaacaggaaggagctgattgaggagaccaaaggagggtggggccgcagctctcaggcactcttggtgttcagaaggccagcttgaagaaagatgtgcatatttgcaaatgcatttcttgttcctagtgaagaggtgaggaaggacactgactgtgctagagctgtacaaagagaagtagaactctaaatagagaaaatatgtaaagatcaataaatcacaccaaaaataagtcataagaacaacaaataataccaggaataaataatgtaaaatataaataattcctaaaatggtgataacagcttatgacaagtaatttcttttttttgagatggagtctcgctctgttgcccagggtagagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcacagtgactccttgttagggtttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctcccaaagtgctgggattacaggcatgagtcgccacactcaattatacacttaaatatacatatatatatacaatatacatatgtaaatatatctgcatatacatgtttagggacaaaaacacgggagtaccatttctgtctttgtctctctctctctttctctcacttgactctgttgggagctatattagttgttttctctttccaaaccaccttctggaggtctcttagattttcccaatgatgaaggagctactgtctaggttattacagtagtaatagtggccaagaaaatgatatgaggttgaagtggacagatgatgcttttcactcttctgggaggttcccactgggtggtctgctttgctgagctttgaaaaagagcttttcttcttcccagttcactgggccgatgtgggcacagcctcaggttttggtttttttctcctttgctccttcaccacctagaaaactaatttcctataaagaaaatttctctggaaatgcaactttctcaataggttgagtctactcaaagactgacaggtaaaagtggtccacatagaaaaacctgtttctctattttgttttcaaaattatatcatctttataataactgttagtacctagaaaaatgcatacattttattccttaccaaaaccagttaccctatagtcaaaaggcattcagaagtattagcagaaatgtagtcagtagccaggcatagtggctcacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtggcactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgagaaagcgtgtcttctggtatgtttcttgatacattttgagggtattgagctctaatttacttaagatgaccttttgaaaatagattaacttatcaaaacttgtggtggaagcaagactttgtcagtacagtactatccaaattctaaagtaatgaatgcttctctccctctggagttagagacctgactctggggtgtggataaagaatttgtgtcctggccaggtgcagtggctcatgcctgtaattccaacactttgggaggccaaggtgggaaaatcactagagtccaggagtttgagacctgcttgggcaacatagggagactctgtctctacaaaaaataaaaagaaattagccaggcatggtgctgcatgcctgtagtcctagctatgtaggaggctaaggcaggaggactgcttcacgctgggaggtgaaggatgcagtgaactgtgattgtgccactgcgctccagcctgggtgacagagtgagaccctgtcccaaaacaaaataaaacaaagagtttatgtgttcagtaagagctgcagtcacatctctagtacagactctgcagagcactaggaagccccgtgtctgaatgggatatggtgagagaggcagcctagggaatggagatacctgggggtccccatctgctcctgatggacagctcagatgaccccaagaccctctaccaggcactgatggagtaaggatggagatgggaattgcattttagaggtaagaagccaagtggcatgatgaggagagtattcatgaaatttatggaacagtctgggggaaatgccatgatttcaagcccttcacctaaatcttcaaaagtggcatggatcagtgcctctcttccccagccaggagcgtgtgaagcatggggacctccggaatgttctcagaaaatgcttggttcttcctgtgttgagcagggaagaagctgaagctagcatgggcaggggagaagaaagccagttacatatcaaagaatgcttatctccgtagacaccactgtgtttgagagtcacattgggtggtttgtaggcagcttttcattttcacagccagtcaggcaaggcttggaataacttgtctaagaatcctcatcttaaccctgtgctagaacaacaagcttggaaggagccagccaacaggagaaagccagagcaagactctgtgctggacaagaagtcctgagcactggggagttgacttcatattggaggcagagaagaattacctgccgatggctgttggcccatggcaacaccctagatcgttgcatttgtggtcctgctgaaagaggagacttaagttatagagttattggtacttgcaacactttctctggaatttggccatttctctgctcttttagtttagtacgttctcttggttgcgaggaaatcactgaagccacctcacgtaatgtgagcatgtatgctcaaggggaccaggaaatgctgaaagttcaggcctcggaaaggacaggatgtggaaggatgttctggactcaaggaggcctagggacccttggcaggaggcattcatgggtctgtagtccaaggctccactaccatctccttggcttctctcttccattctagcttcttctgcttattcatcacttttgcttcctatgaaattggtgcatcctggtcttggcctctttgagccctctgtatagtgtgagctcatctggtactcttgactctctcaggctcctgaaggagaaccatcagatagaagcatctcatctccccaggccatgccactgggcctcagccaggcttgaactagctaggctcagtccacggggtggccttcaagcagcctagacttggatccctaagcacagcctgtggatgggacgttttaaggtaaagggaggacgcagagcattgcagcccgttggttgttttctccagcacagccatgcaaaatccatgtagcggcaggaattttgcagctggagttgctcccctgagactctgatcagataaagacagggtttgctgaacaccgtaggtctggccctgagccgtgggcagcctgatgagcacaggtgaatggtgcaagggataacctcacagtcatcagcaagtcttatctgggccgctgcaaatatgacggagtcagaaaaatgacaacataaagaaatgcgatgttttctatgggggtttctttttgaaactaaaagaggttttctagactcactccatggagaccactttactttccatttttctcagatgataacatctgcaggggggctccttctgtgggtacatcatttgtcaaatatgtggtccatattgagaaccgcataatacttattaattaccacagttgctacttaccgtgggctgctaagactgctttagatatactgcagatattcaaagagaattcatcgtccacccaacggcaaagtccatagaagcccaggatgcattctgaccctcatcctttaaagcttactgaacatattgatcacctcttttccaaaggatacttcctattggagtgtacttttaaaatctattttttttgtcttaatgtttagtgtaatgagggagtataggatgaactcaatgtaccttgaacatagctgttgtcaggaatgaagccaatttcattttgcctgaattagggccctttggtgtcttttctgtatgcagttaatacagttcgtgtgctgtaccaagggtgcgaatgtgacttttcatcaggaaggccgcatatggtgggcacagggcctagctctgccgttttatagctgcataactggtttcttgaccttttatgagtctctactcatgttttatatggagacattagtcatctcacaagatttttgtaatgattagaatatttgtaaagttcctggcaaaggtttgattataaattagcgtcatcatgaacgttcaaggtggggaccttttttttttttttttgaggcagagtctagctctgtcgcccaggctggaatgcagtggcatgatctcggctcactgcaacctcctcctcctgggttcaagcgattcttctgcctcagcctcccgagtagctgggactacaggcacacgccaccacgcctggctaatttttgtatttttaatacagacagggtttctccatattggtcagggtggtctcgaactcctgacctcatgatctgcccgcctcaaagtcccaacgtgctgggattacaggcatgagccaccacgccctgctaaggtggcaatctttatacataaaaaacaggaatgacttcttcgaattggtgcactagagaaatgttttccagtcgcctaagcgtttaagcatggtaaacagattaccatattagttgcccagaccttgcaaaacttcatagtgtttgtttgtttcccttgggaggctgttctgagaaggaaccttttcattcctcggagttctgatgtgttcattggcccctgttgtcatgctggatatgggggcggttcaaggggggcttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggctgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtggatataatgtgttgcattggtgtctaaagccatgctcagtatatagttatatatttcattcattcatccgttcattcagttatctcacgtttctggagggccctctatgtgcaatacctagtgatacagcagtgaacaaaggaaatccctgccctcagggagctttcattctacttggggaaagagacgtgaaagaaatcaagacatgcaagcaaggataagtgctgtaaagataattcattcctgtttagagggctgaggacaggaagacgatgctgtatggctctagacagggttctgtgatgagtggcctgtggacagattcctgtccgaagaggtgcagggtgcaagggaggaggggacggcaagtatcaaggtcccgagtgaggcacatgctcggcggggcccaggcatgccaccaaggccaggaggagagactgaggaggcttggccatgccctgccttgttggtttttagaaagactctgttttggttattttgtttttctttttttgagacatctggagtgcagcggcatgatctcagctcactgcaacctttgcctcctgggttcaaacaattgtcctgcctcagcctcccaagaagttgggactacaggcattcatgccaccgcacccagctcaaatttttgtattttttgtagataccatgttggccagcctggtctcaacctcctgacctcaggtgatccacccacatcggcctcccaaagtactgggattataggcacaagccaccgctccaggcctagaaagactggattttaccctgattgagcgagggaggctctcgaggttttatttggttctgcccagtgaccagccaccataaccacatccttcccccagactttttcctcttcctataaaacaaaacaaacaatgtgaacaacaaaagcaaaaacaaaaaactaagtagtagttggggcatttttattttaatgctgcttttttttttctcaccttttgctatatgctgatcccagtgcatgaaatttttttgtaatctcattcctgtgttgaagctctttcactgctttcgtgagcacagatgaatttgaaggctgccaggcagtagcaacatataccagcttccccactgggtgttcattctacccaatttttgttcatgtggacttcaggaatctgggatttatgatcttcggatttggctcttggcttgaggcttagcctgtgcagtcatcttggagagagggtttactaagcaaagaacaccccagaacaatctgggggaactgtgccctttgcaagagagcagttttaaagtaccctcgggcaatttagaagctcctactgactcaaggatattcttacctcttcgttaaagcagctcgcctaaggactttgctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcgtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaacccctttttccagtaaaagtcgttggcgaggagtgaattgtgatggaaacagagacagatgtatgtacctttcatggacataatttccccaagactgaacacaaaaatgagggtttttggagatctctctggaattaatgtaaacgttgttgaaaacatattattctatggctccttcataaaccctaggccatcccgaggctgtctcactcaggcccctcagccctcataaccccccagctccataggagtggagtttggatttcaactagataaggcccattttcatggatggacatgtgagttttcatctataatatagaatgctattttctagttaggttggagcaaaagtaatcgcggttttcaccattatattcaatagcaaaaaccgcaattacttttgcaccactactttttacctagcagttcaacagctgtaaagaaagatgctgagctgttggttacgtaactgtggtacagccatttcatagacaagtctacatcaatgaaaagaatgacacttctaaaggaaaaaaaatgggcaaaaattatgtgtttacatctatcagaaaaacaaaacaaatgtcacggtgtggttgggaggaggtggggagagaggcagattttggaggcgaaagatacacagaaacactaaatacctgtctattaatactgacagtagttgcgtttaggggatgagactctaaatttgtttatttaaattttctcattttaaaaaatgagtcctttcaattatgagatcaaaaagaaatgttcagtggcttattgtgacccaacatttttctgtttgatttagatagagcttttatttgcctaaaaattgtgcttgcaatatatatgatgatttttttttcttttattaaatgaaaaagagtcatttaacagtcacagtggctcagccaccacccgcagcaggcagtgggcccacttcaccttcccagcaggcctccagtgcccggtgcagggtggcccattggcacccacaacaaacatcacgacattacttttaccgcacacttcctgtcgaggcacaggcagtgcttcagcctttttggtaacttgaatgaacatcaaaaggataatcagatattagttaaacttgttcctcttctccaatcattgatacttttctctcttgcttcccctccccctgcccttcgacacagagtgacaggcctgaagtaaaaagggaaaaggggaaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcatttacaaacaactgtgcatgtagggttgcttgcaaaagttcgtcgtgtgccgatatttcattaccacttttgccagcgctctcgtctgcatttcctgaggtttttcttttttttttttttttctttttttctttgatacggggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttcaccatgttggccaaactggtccagaactcctgacctcaggcagtctgcccacctcggcctcccaaagtgctgggatgacgggtgtgagccaccgcaccaggccatttcctcagttttaaaaagcaaataagaaacaacaacaaactgcatcagagtaaccgtttcaaaaacccatctcaggtctgttttttcttttttttttaagttagcattttctagaagttttggtataaaatatgtacaaggatacatatataaacttagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtgtcatcagcccaaaccagatcagcgtcgtgggcgatttttttcactttactgctgaggggatttgccaatcgcctggtcagcttctgaattcttcgggcacacaggaggggcgacatggttctggcttatttctaagtccctttgaggtgatttctggtccacaaattgaggcaaaataatcctcacaatttcttggatattctctgccccagccccgttctattgcaaaggaggcttctctaaaaggcttcccaatgccttagaatctacttaagggtatttttgctggagaaagagctgctgtctttgtccacctgtcgttttcctttctaccccaacagggctttctccctctggctgttttatttagcgggagaagacagaagagatggaaaaatggaccctgcatttatagctgttccttcaaggagctcaaactgctttcaggcatttccttattacctcattaatcctcataatggtcccttggcagaattattcttattttcagaatggagaaattgaggcacggacaaaataaatggcaggtggaaggtcagagagccaggcagcagaagaggtgggggcagcaggatggcttctggtttctgccctggtccatcagtcagaatgtcctcttcagatgaggagatgcagggtgaggcgcgggggagctgacattgcataaataataaaacaaatggagccacatttagttatcactcatctagcggaagtcgatcttcttgggacatgagtaggctctaacctggcaggtttttcaacatggaaccattatttgtcacatgtgttctgtgtgccagggactgagttcttctcaacggagtttacatgtgagaggagcaagggacaaacctcacaaataggaatacagacctcagaaagccgacttcacccttgcatactcctccaggttgccctcgcctcccgcctggatcactgctcaattctctctctctcttttttttttttttttttttttaagacagagtcttgctctgttgtttaggcatgatctagctcactgcaacctctgcctcccaggttcaagtgatgtttcccacctcagcctccctagtagctgggactacaggcatgcgctgccacacccggataatttttttttttttttttttattggtatttttggtaaagatggggtttcaccatgttgtcaaggctggtctaaaactcctgacctcaactgatccgcctgcctcggtctcccaaagtgctgggattacaggcatgagccacagagcctgaccacagtcctttcttttaagggcctcctggcacccagccatgttgggaccctttcagttctttctccacggagaaccagaatctcctttgaaaatatgttagatcacctctttctcctgctccgaactttctgaaggcgtcccctgttactcggagtgcaagccatgctctcgagctggccatggcatcctgcgtcctctcccttcccccattggctctgttcttcctgccagtgctcttccccctgctcactgggttccagctgtgcgggcctccctgctgttcaatggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctgctttatttttctccatattatcattgccatcaatccaagcacaatttccagttacttacccattttgctttctccccgctctttgagaatgctggctccaacagggcaggtatttcacctgttttgtttatgcctgcatccccatcactaggaacctcataggtgcttagcaaatttttgatcttaatacagaaattgactctcacagaataagaagaaggagcttgaagccgaggtttgtgcccagaagatctcactagattctttatactctggggagaagaaaggatcagggtcgggtggggacatctgtgggcatattggggagggggccaggaagaagccaggaagggggcatgctgtcattcgtgggttttgcaactttctgtggcatagaaggcatagaaggatctcttcatttaaaaggtcaggttggattttttttttttaacttcaacaccagttaacttacttgcttccatcataccctgtaggtactcgttatggacaggaatacatgtagggtgaaggctgctctgggtcagtggattcacagagaagtcagaattctcttttataaagagcctgcttttctcaataattgcataatgacgtctttgattcccaggccctcatgcctagctgtttccttaggcatttattcaagatccgagatgccattcgcaatccagcaggatgcatatttgtatctggctccaaaactttttttttttttttttggcccacatcactgcagcccatggcagaagagtctagcaattagcaggaactgaaagtgataatttattgcaaccaacgctgtgatctaatagtcacacattacaaaagcaaaatccatattttgttcgcagtggcaccgcagcgctatcatatgctccacatgctttctaatgtcttttgtttgtattaggaaaaaacataaccctctcctactgagaaccagagagagcccctcaggttctgagaatgacgacattcaacatcgtactccaaagggggttaggtttgtgtgctaggggtgaacgctgtgcaatttaattctgtttccaaaagatctttggaggataaaggatactttctgtcttttatttagggaaggcgatcatgttggcacagggcataagagagtagcggggctgagagtgggaactgaggagattcaagccttttgcccgtcgatcgcagttcagatctgttgattttgaccattgcatcttgcctcacatctgaacttcaggtgaagtttcaaaccaccaggcaacatgcattacaggcaaaatgataagtcaggtcctgccgggtgactaaggcagtgtggcaatgcttcaagcctttaaaaccatatcccagtggccccaaagcattaatatgtctggaacattgcctgtccaatatctagagaggcgcctgcagaatttgattcctaggtacatcaagtttttgagctggaagaaacttgagacgctctttagtccagcaaatttcaaacctgtctgctcatcagaatcacctgggagcttgaaaacacacagatgcctgggcctcaccatccagagagacattcatttgattgcagattgaatccagaagctctaagcagaggcacagtcacatttggggactccttttatttagtagaggaggaaactgagtctcagtgtctgagacagacagtggggattgaacacagacacctgactcccagtgggtggtattttctcctagagtgcatttctgcttcttaaccagcagaagaaagcccattaactaacccctcaggggtcaccatgggcaaaggagtgcatattaagaactgtctggaaagaaaagaaggtcattggaatcttcttcaccccttccctggtactgatggttgcatttcaatggatttctccaaaagcaattatcacagtgttcctgtgtgttgagcaaacttcccttgtaatcaccttagcgttttcttttgttaaagagtaagaagaatggtttcatagtgaatttttcctaaaatgtgcagggtgtagaagaaggaattgcacacaatacatgtctactaggcaggtcaacataaatgagtagaggcaggtaataacccagatacactttgttggaaagtggaatgcatagaaatggtcttcatttctgcaaagaaaaatgtacattctcctttttttccttgcaatatgttgccttctctgtatatcttttaaaatttctacttctgatagagtaaagggtatagttttgtccgttttgtgttgctataacaaaatacctgagactgggtaattcataaagaaaagaagtttgtttgattcacagttctcatgcctggaaagttcaagattaagcatctggggagggcctcaggctgctttcactcctggcagaaggcaaagagaagccagtgtgtgcagagatcacatgggcagagaggaagcaagagagaagggaagtgccaggctcttttaaacaaccagctcccgtgggaaatcacagagggagaactcactcactaccatgaggatggcatgaagcccttcatgagggatccgtccccatgacccagacacctcccggtaggctccatctcctgacatcttcacacaagagatcaaatgtcaacatgagatttggtggggacaggcaaaccagatccaaaccatagtgactatgatatatctttcacatttctctttacaaaaagaaaaacaatgtaaggtcccgtgacaattagccttactgccggggagaccataaggagtggtggagactgtggtaaactgcagcgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtctgaaatccatacagtgggcagtcgagagaggcagacaggaactcttggcatatgctaaagctgctatccacaggcagaatttcttcttctccaggaaaagaaacagttcttctcttaaaatcttccaaatgattgactccgtcacactcagaccatctaagattatctcccttcctaaaaggcagctgaataagggcttcaatcacatctacaaaatactgtcccagcaacaccttgattcatgtttgactggataactggaaactatagcctagccagggtggcaaacaaaatggaccatcccagggtagatgttaaaaaaaagatacccaccaaagataaataagatcaagattagaatgtcttcttttgataggatgtctgatttttctgaatttttgttcctaaaacataagattatttttaaaagcctgagaaacgagacattagtgatccgattcagaaaagaagccctgggtttaagccaatacgagatgggtttgtatctttaagtggcctttattaccacagtaataaacagcaaacgggcccaaatcttacaggcttgtgttggctttgaccaatgaagtagaacaagacctctgaataccccgttagttccaggctgtgctttgatggctctgcacagacagctcttttcctatacaagtcaccagcctcacccgtgtctcttaacaaatgttgttgacaggccgcgttgcaatttttctgcatgttctgacagtttaattcagtacctcctagctaagcactcagcctaagggggtgcttcagcaccttggcgtcaccaggctgcaattaaaataattcagggactggggctgggcttgcagaaataggccttcttccctttggaacatacaatgcattttccagtctccccgtggagcacacgagatccttttagagcagagggcagtggaatgtattaacaagatgtccactggcaagaactagctccatttgtatgttgcacccaacggggttttctccataggggttaggcgtaacgtctttggtaaacttggcacctgtagaaaggtcttgtggtgggcaggggggtgtgaatgggggaatgagaactagggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcaggtaaggtggaatttggtaaattccccaaatttacaaatagatgaaagttgggtaaattccccaaaattacttgatgacaaagatcatttgggagagattctttcaaaaatgcctactccctattcccatatcccagcctaagggaatgagtttaagtgggtctacagtgggtcctgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagaggtaggaggtacataagagaaacgtgttttatggctgtggttttcaagaagtacagcgttttggagagagtggaaggctttcatgcatgaaacactcagggaggtaggagatccatgagatccaagctaaacaattctggaagagttacctgaagttgacacttaattcaagctgcatcatcttcctcctcccagcagatgaagaccaaaggtggagggtggtgggggtggggggcagggagtaggggggagggggggagggggtgtggggagggtggggcgggggtgggcaggttcagggactgaggccggaagcaaaacaatgtactggagtgcttatagtttttgaggaatcagtgagaaatgtcatctgaatgtctcttctcaatctttctgaaagataacttgcctataaacataaaattaaaagcctgctgtctgcttagttcaggtattgggtcagcgtcttgtgactatggacaagaggtgtttgactctaggactcagctacctcatctgttaaatgggcaaactgggagggtgtttatctgcatgcaacatctccttccatttgaaaacttttatgaatgtatggaatattattgagctggtgtgtgctaatacactgctaggagccattggagatttgaaatgtgagagaatgcctgctgtctgtcgcatttaccaaacatcatgcttttcaagattgttaaaagttgctgaaacccttctttgaaggaaatcatactttgaagctcaatatatagcaaacgggtagaagagttgctaagagtttgaaaatgatctcattaaacaagaaacatatatacagtgcctacctaggaaagagccaggcatataatagccactgcataaagatgtcaagtcttttggacacaatcctaatatctcggaggttctgaagctaaagggtacatgtttaaattttatttgtttcattaaacacctaaagactctttctagctcactcctgccaaaggcagaacttgagagtggcattcttttctggtctttgaagacgacaggtgaagggcagaatgtcctgtgtacttgggcacgcacatgcaaccctggctggtggctcctcctctctgtcctcttcctccctctcttccttctcttccttttcttcctcatcctccttttcctcctcctcttctcctttctcctcatcctcttcttccctcttctttgtgtccttgtttccatttgcttcttgctttgggcaagttctcaccataaccctctggcaaaggcaaatattcacctaagtggttaagtctctgggcatatttgttgatctctgctgagtctctcagcccgttttcatccctcctctgcctctccctagccattagccaaggccttgacctattgactgcagtgttgccgaagcagctggactccgtgtttgaaaggttttctgaagaggcatctattaatttatgtatttaatttctgtatgaagtgactgttctcctcccagcacaggtattaaagtacctttaggggaatccagcagctgaaatcctcagtaaggaaaaatgcttagagtgtcacaaagcaaacgcattagtgggaaatgtttaggggctcaagcacaaccacaaggattcactccttccttggattttgtgcctcttcccctgttcctgaggcccccactgggaacccttagctggagaacacccgtttcattatggaacatggagaaaagggtgattgtcagctccaatttattccatactatctgattcaatctgtagtttgactttgctaaaggaattaatttttaagatcttaacaaatccagtaacatttaaaatgacctatccagtccatgcatattagctattcataaagggttttaaacattattattaatcctagatatgttacttaaactattaagtccgttcaaggcattcagtttctgagtcctcaaggatggtaaggagagctgcaaatgggctcccttctcaagcaaaggcatcttatgccatcatgcacgtttctacacatctgcctgtagatacactctgtaggacaaaccaggtggctctgtccttcaggcaaagagctccttaattgaaaatgatgtgtgaaatttcaagagagaagtctaggaatggggagatttatgtactatagtcagtaaccaatcctgagcaaaggtaggcacagctatgtggtggtgcccttttttgggggggggggggcgggtggtgggggtacttactaaggaccttgcctaagataatcaacaatttttctttttcagccctgggaggctctaaagctggaatcaaaaagattcacaaccccacaaataggtgaactactctaaagcaatggttttcaaaccttgaaatatcctaacattgaaaaaaaatgtggtaacatagggttgcctgtgtcttattttggtctgtaaggacattaataatgttttggtaaaacctcagttatcatctgctattactgttatttcataagacacatcattttccttcaaaattacaatgaaaactcataagcatacatcaaagttgaaagaattttacagcgaaccaccattaacattttgctataatggctttatcatatatccattcatccgtctatcatatttgtaaaacaaataatattttaatgccaaacatatacaaaggatagatcagtaatttccgagaaatattagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgtgtacttgcaatccccacttgaccaaaggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttcacaaaagtggaaaatgtgatatgacagactggaaccagcacagggacgcagcccctcacctgctgggggtctttgggtgggtcctgtagccccagagcctctcgatgacctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccatattcgtacccatgtacgtattcatacccatatctatacaccttcccttatccctgtccctgtctacacccacacccatacctaaaccaatatccacatttatatctatacctatacccatatcaatatctatatttaaatctgtgtatttagatatttctagaaatgcatatatagctatttttgcttttataaaaaaagtcacagaaacaattatattgtacacagtcctatataatctgctttcttttgtttatagaatactgtgaatgtctttttgttttttttttttttgtttgcgagacagggtctcactctgtcactcaggctggagtgcagtagtgcaatcttggctcactgcaacctccatctcctggatgccagcaatcctcccacctcatcctcccaaatacctgagactacaggcagtcaccaccacacccagctaaatttcttttgtgttgctatttttattagaaacggggtttcacctttttacacaagctggccttgaactcctggactcaagcgatctgcccttcttggcctcccgaagtgttggaattataggcatgagccactgcactgggccaggaatatctttctatgacagtaaatattattttacatcattttcagtgataccatagtatcccattatatgcttttcagtaataagttcgaagccaagttcctggatcagcagcatcagaatcacctgggaatttgttagaaatggaaattcttaggccactccccagacctactgcgtctgggggcagggcccagccgtctatatttcagcaagccttccaagagacttcagtgcctgctaaagtttgatgcctactgccttaaataaacttcttcatcccttgtcaaacttcctaggggagcacattttgaatttttgacctgagacctcaaaacttttacctgtgctcactcagttcaggtgaaagaatctttggcattcagaagcttgtgttcacactcacctacttctcatggcatgattcctcttacctctaaattctactgacttaatcaagattgagggattctgggatgaatctggggacactttttggtccctgaaataaaatacgcaaactttggagtatgagtgcgtatttggggaaagtatacctatcagattttcaagaacttcatgaccctaaaatgactctttcttaaaataatttttttttttttttttttttttttttttttttggagaacggtctggttctgtcacccaggttggaatgcagtgtcaggatcatagctccactgtgtgacctcaaactcttgggctcaagcaactctcctgcctcaagcaactctccagcctcagcctccgagtaactgagactacaggttgtgtgccaccatacccagataatttttttttaactttttttcttttttttttttttttttttgagatggagtcttgttcttatgccgaggctggagtgaagtggcaccatctctgctcactacaacatctgccccccgggttcaagcgattctcctgcctcagcctctcgagtagctgggattctgggtgccccccgcaaccatgtcccacgaatttttgtattgttagtagagttggggtttcaccatggtggccaggctggtctcgatctcctgacctcaggtgatgcacccaccttggtctcccaaagtgctgggattacaggcatgggccaccgctcccagcctttaactttttgtagaggcagaatcttactatgttgcccaggttggtcttcaactcctgagctcaagtgatccgcccttctccgcctcccaaagtgctgggatgacaggcacgaatcaccgcgcccagcccaaaatgactttttatttgttatttttgatctcatccttgctgttctgttttgcccaggttggtcttcaactcctgagctcaagtgatccgcccttctcggcctcccaaagtgctgggatgacaggcacgagtcaccgcgcccagcccaaaatgactttttatttgttatttttgttctcatccttgctgttctgtttttcccagttatatcaataacaaagaaaagaaaagaaatctactcagggtctgttgggcatactgcccaagcacagtgtgaaatgactgccttttcactttttatcttttggatagcccaaagaccagcctgacttagcagcctgatttttctttgctggaggcagatcacactctgcagatctccactgaaaccccaccctcacccttcgtaataggcgacatgcacattttcatgtcacatttaaaaatgaaatttttcttgaaaatgttcacatccttcccccagaaattctagatttataaatttctcccaaggaaatcattaggtgctacctgaaagtttatgtatcaggtaatgatcacaaaattataatcacaaattaaaatagccataatgtctaataattcgacattagtgacagagatgatactacagttataggatgaagtgtcataactggggattttggaaaatgattagggacatggtgaagtcgtcatagaataaaattaagtgaaaagagtcaggttgagtgtagaatatatttattcctattcagcatatgtattacaaaatatctgggataaatgagaactgcatgctgacatttacattttctccttgattgtcttatctattatcaggattttctacaatgaacatttgttggtttataattggggggaaacctaaattcataaaataggcactctgttggtggcaaggaagcccactagtccactgtctaagtgttaaatggattttagcttcataattctggctttgactagaccctcttacaagcaagactatatcctctgcaaaagcatcagcggggtcctgcagtgccttcttgacacacacatcagtgtatacccagagctcttgtttctaaatagctgagctgcgtattaagtatggctaaccacacatccatgcatttttctggtgtctacctgaccacccctccaggggagagataaactcaaaggggagaaaaaggtatgggagcgaaagattgcaaggtgcaggtatgtttgcagatgaagggattgtccaggctgagctgtgcagtcctggatgaaccaccatctgggcacttcatatgccattcatacttaagggtgattggctattttcatcatcaagaaaaacattgctttaaaattttccatagttattcgggcatggtggctcaagcctgtaatcctagcactttgagaggctgaggcaggaggattgcttgagcccaggagtttgagaccagcccgggcaacacagtgagaccccacctctacaaaaaataaaaaattagttaggtgtagtggcgtgtgcctgtaatcctagctacttgggaggctgtggcctgaggactgcttgagtcctggaggtcgagactgcagtgagccatgatcatgccgctgcactccagcatacgtgacagagcaagaccttgtctcaaaaaatttaaaaaaaaaagttttttttttttaatcgccataatcttgtgtgaaatacttggtcatctgagcaacattatccttcttctccccatcagcctggcatgagcttggcagatgcaagctcagatcatcacctgtgtgagtgtgttgtctttgtgtccgtgagcatgtgtgtgtgccctgggttcctctcccaggtactccagagctcttgacaataaatgagaacaatatagaggcagggggcacttttcatctcaggccagttccaggactctgtgtaaactgtactaagccgaaacgtattcctttgtcccttttgccgctgtcctcctaatccacatctgggcagtgtgcactgtggctgggagttgacacagatccttgtctcccagacccccagtttctatcgagctactgtaactttaaaaagatttaacaaagactacctccactagctaagctgaaataagaatgtctccggagtttaatggatcaagtagcggtgataggttttatggctcttttttactttagggcatagggaagagagagccgggcaggttggttttaaattcaaggatttatgttgttaatcctccgggctaattataatttatgggatcttggcaaattaatatgcagttgctattcaaaagtggagagcaatgtaaggcaggcataaacaagccttgttcatttttaatttatttccaccaatggagaatattaaataaaatgaacactggggtatttcgctccaagtttggtgttcattatttatctctaaattatgatattcatagaacaactccttgctttttcaccaagaatctagaatctagaattatctgagcgttcgcatcagataactaggaagaaatcagagtcattttctctctaaggcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgctagcctggtagatattgagcagggtgtgatcctgttattgggctttcagactttagcttagcaacctcattgcacccaggacccccatttaatcagcgactcctatggctgtttgggggctctctttcaaataattcttctcacccatgaacatctgtcagaaaactttcactgattggcaaccaccaggcaggtaggtttgactcatgtgataattggttgcaccactagaaatgagaatgcccctcctacttccccgccacctcttctcctcttacctttttctccccgacatgcccctgccaacctccccccatcattccagctgggagaggccatcaaatgtagcttggagagctatagaaaccttgagctctgagcccaaggagcaagttggagtcctgcctccagctgtgtagctcagataacagctggagcagagaacatgctgttctctctgctagaatatctgacccaattctgactagtaaagagagttaatagtttgtacctcaagtcattcttgtccctgtgtgaaggaagagaagcagtcatttccctccacctccaacacacactccgtccccactctgtctctcttggctgtttttctcttcattgttgttaaactcacgttcatttctcttgtagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtcaagaaatggcagattttcccccttccattcccacccttgcacatagtaggttctcagcaagtatttgtagatgtaatcgaccagcagagatcatttgtacccttaacacccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcactcgagtatcctaattattttaaattcataatgaatagtcatcatggtttcactttttttatgtactcttttgaaagagtacgatgggggaataaaagccagaaagttaaaaaataaaaatagaaaagagctgcaattgtcaagagaccaaaaagtcttgtaaaaagggcagtaggtaattctggaggcaaatcagcatgggtaatgtctaggcaaacaggatagaaaaagatcaggaggtcacagtgacaaaagtatttaggctcatcatattagaatttcatccaaagaacaattgattatgatttatagaccacaccatcccatgagcccagatgtgtgtccactgggcctggcaggggacaaatttatgtaacagactccatcctgaattccagtcctcaagctttgagggtaataaactcaagctttgcaactgggtcaagatcaggcctgtctccttcttgatgatgagttgtctcataggaccctgttaagcaccatccccaaactccattctttttggtgaatatcccaacaaactccccagccatacctcaatgtccagacttgcctgatccccagggctggacacagaacaggctcattctgagaatcttctctctctccctccttcccattttgctcctcctaccaacatgagaagctagggggtctcatctttaaataattaattcttctttctttgtaagtattatacatgccaaacagactcttggtttgtgtctactgacccaacaaaagggctgtccacttgacggacaggcaacagatcatcttgataagtacatgaggcactcagatgtcaagtcaccaaaccttcattctgaatatttttgaggctcatgacagaccaaaagagccagagagttggggaacataatttcctttgctcataccctggaccaagaactgttgccaggaatatccatccatctgggggcttccagcttccccagatgcctgcgtgccttttgacccttctccttcccccaccctgcgagttcttcaacaaatactcttctaaaccaacatccccggcaaacgggagcaagacaccagcttttcactgatgcagatatttctgatcttttcatctcggttttatttctcactctcccactgcataaaagattaagaaagcactcgcatgaatgtttgcacatcatttaaatattcattttcattaatttattcatagtcgtaaagtttattgcctagaatatagagtcgtagaattttagagctggaagacaggagagaaatcatctagtttcgccgcctcgttttacagatgaggaaactgaggtgaagacagctcaggagaccgtccaaggtcagattctgaagtgagccaagtgagacccaaactcaagtcttggacagtctagcctctgtgcagcgcagctcagcacagctgaaaaccacttttgctctctgctggcatagatggctgtgctttggttcattttcttgctcatcttcatgatctagcaagttcttgttgagtgccagcccagtgctaggtgctgaagaacaatggtgaacggcacagtcatggtaccagaactcggtctggtggaacagagagattaagcaatcagaaaaacatatgtgtgtgtaattacacgttgtgataagggttttgtggggaatatacaagctcaatgtggagactagtggtgggagggcagaggcattttcccaggaagtggagaaagggaaggggaagcaaaagccatcccagggtgcgttagggagcaggtactgctgtggatgacgggtgaagaattcacctgggaaacttggggagaccatgtggaacatgccgtctctgagttatgccccatcagggggcaaagaaactggagtacttacccaccagatcctcatctgtcgttggttgaggactgctctcaggacattcacatccaggcacttctggtccacaccttggtacaatatttgcaatattagggacatgctaatacaattattcattgtatatgttaattcaaattaaatggaatgtcctatattttatagggcaaacttaggcttacgcctgggtggaatgagcaatccctgtcgccaaagaaggtccccagcatagcagttggctggagaaggaagggctgaccataagttgcactaaactgctctcagcagggtgacctggaagatcttggagtgtagatgtcaattaaggcaagtcctgagggctcggatggagccaacttttcacccgaggaggggaagagggagggttaaggagggcaaaggagagatttccaggcaaagtgcacattaaacaccagatgcgaagagctagacccccttaatgacaatttgctttctgtaatcttgaaccagggtctctcagtgtgtggaaggaatgtttgaatcggagtagcagggctgagtggcagtcctaaggcccagccacaacgtgttcttgacaagccatgtctatgtctggcgatgtgctcgcatggcacatgatcctgtttgacttcctgacagccccaggtgctggcctaaggccttccaaatgaggaaggaaggctggaagaagttaagtcatttgctagtaagggttagagccaggatttgaacccagatgactacagagttcatgcttttaattgctgcttgttaagtgcatctattatgggttgaattgcatccccccagaagatatgttgaagtcccatcctgttacctgtgaatgtaacctcatttggaagtagggtctttgcagatgtcatcaaattaatgtgagatctggctggattaagatggagcctcaatccagtgactggtgtctttattagagaaaagagagggagatttggagagacacacgtgtgtgcacacacatatctacgtatctacatgtatgcacatacctacatgcatgcacatacctacatgcacacacgtgtgcacacacacaagcagaaggccatgtgaagatggaggcagatactggagcgatgctgccataagccagggaacagcaagcattgccatccaccaccaggagctggaagtggcaaggatatgttctgccctagagccttcggagggagcgcagcgccagagacaccttgaattcagactctttgagttcctgaataaagagagaataaacttgtattgtttcaagccacctagtttgtggcactttgttatggcagccccaggaaaggaacacagcatcccctgtcaacaaaccaaggggagctaaagatataccctttagccaagtaaaccagctgccccgagcaggagcacagcttccagatcactcatcaaggggccgtgggtgacagggctggcctgctgctgcctttaatgggcgtagatgttgttgttcatgtttcccagcccattggtgatgacacagaggcaggagccggggctgcagactaaattatatacatctcaagggcagttagacaactagctcgcccacaggaacattgcaataagcacagtatctgctttcccagcaaagccaagtgcaagttcctgcctgctctgatgacctcttgtgcctccagtgtgggaagggaccaggtccctcaatgctgccgcctcccaccctgtgctgccacgtggatttaactccttcgtgttccccatgttcttagtcagtatggttgttgtgccatggattcaaatggggttgcttgatttgatttgccctttacttggctggaattctctctaacaatcaatggaaacacagctcatagggatgcatgtagcctgtctcatatgtgaaaaagaaactttcaatgtatacttcatctcattccaacaagaattggaaacagcaacatcaggacttatatggtgcagggtggtcagtaagtaggaaagaaactcggggcatggaagtgaacaggaagcccagagtgaagccaggacccaaaacccacaggtgctgctcttgttataagccagccacacatttgtctttgagccttttagcagctgccacaaactgggagaaaccatcagttatgcagtttacaatatctctaaactcaaaacaagccagtaattcagaaaaagcccagttcttctcacaaagaaagatctaagtgtgatatgagagtatatgcatggagaatattttctgagctggtgatgagctgcagggggcctctcccagcccccgcactggttgcacttttaaataagagaaaaaaacagtgataggactgacctgcgtgtagaagtttcaagttacaagaaaaacacttcacaggatccaaatccttaaagtcctgaaggaaacagagagcatatacaccagctttcgccacccaattcggatgtgttagaatgaagagtctcttattttttaatgaatttttctctatttaaaagtacagggatacctcagagatattgcagatcccgttccagaccaccacaataaagcaaatatctcaataaggcaagtcacatgaattttggagtttcccagtgcatacaaaagttgcttacacgatataatagactcttaagtgtacaatagcattgtaagaaaacaatgtacataccttaattttaaaatatttcattactaaaaaatgctaatgatcatctgagccttcagcaagttgtcatctttttgctggtggagggtcttgccttgatgttgatggctgctgatggatcaagttggcggttgctgaaggttggggtggctgtggcaatttcttaaaataagacaaggataaagcttgctgcatggattgactcttccttttacaaaaggattctctgtagcatgcactgccgtttgacatcattttactcacagcagaatttatctcaaaagtggaatcagttctctcaaactcgccactgctttatcagttaagtttatggaatattctaaatcctctgttgtcatttcaacaacattcatgacgttgttcatgacaatgttcagtgttcgccttcaggaagagcaagttccattgcaagaaatcactttctttgctcatctctaagaagcaagtgctcatccattcaagttttctcatgagattgcagcaatttagtcacatcatcaggctctacttctaactcgagttctcttgctatttctaccacatatgagtcttgaaggggctcaagacttacttcctccactaacttttgaacccctcagagtcacccaagaaggtggaataaacttcttccaaactcttgttattattaatttttgatcctttgccatgaatcacgaatgttcttaatggcatctagaatgctgaatcctttctagaagattttcaatttacttagcccagatccatcagaagaatacagtatctgtggcacctgtaggcttctaaaatgtatttctttaataataatacttgatagttgaaattactctttgatacataggctgcagactgggcattgtattagcaggcatggaaactacattaatcttgtacatctccatcagagctcttaggtacgaggtacattgtcaacaagtggaatatttttattttttttattgttattgttttgagacagcctggtctggaatgcactggcatgactgcagctcaaattatcctcctactccagccttcccagtagctgggactacaggcacatgccactaggctgggctatttttgtatttttagtagagacacaatttcaccgtgttgcccaggctggtcttgaacttgtggtgaatcaatctgcccaaatcagcctcccacagtgccacaattacaggtgtgagccaccacactggaccaagcagaatatttttaaaggaatacaaattttttcccaacagtaggtctcgacagtgggcataaattattcagtaaatcatgccataaatagacgtggtctcatccagggtttgttattccatttatagagcacagggagagtaggtttagcataattcttaaggaccctaggattttgggaatggtaaatgagcttggcttcaacttgaagtcaccagcagggaagagagtcagcctgtgcttcgcagctttgaagccaggcattgccttctcctccctagctctcaaagtcctagacagcatcttcttccaacagaaagctgttttgtctacattgaaaatctgttagtgtagccaccttagtggtcttatctagatcttctggaaaacttgctgcagcttctgcatcagcacttgctgcttcatgttgcacttttttgttatggagacggctttcttccttaaacctcatgaaccgacctctgctagcttccaagttttcttctgcagcttcctcacccctctcagccttcacacaattatagagagtgagggccttgctctggattagattttggcttcagggaatgttgtggctggtttgatcctgtatccaaaccactcaaacattcttcatatgggtgataacgctgttttggtttctatcatttgtgtgttcactagaatagcacttttaatttccttcaagaactttttctttgcattcacaacttgcctgtttggcacgagatctggctttcagcctatgtcagttttcgacatggctttctcgttaagcttaatcacttctagcttttgatttaaagtgagagacatgcaactctgactttctcttgggcactgaaaagccattgaagggttgtaagtttgcctaatttcaatactgttgtgtctcaggtaatagggaggcccaaggagggggaaagagaaggagaacagcaggttgctggagccagtgtggtattcataaatataacatttatcaattaagtttgccatctgatatgggtgcagtttgtggtgccccaaaaaatgacaatggggacatcaaagatcactgatcacagatcaccaaaactgatataataataatttaaaagcttgaaatattgtaagaattatcaaaatgtgatacagagacatgaagtgagcaggtaccattggaaaaatggtgccgatagtcttccttaatgcaaagttgccagaaaccttcgatttgtaaaaaacacagtatttgcaaagtgcaataaaaggaaatgcaataaaatgaggtatgccgataatacatacagctcagtgaagaatatcttaaaaatatttaaaaagaaggaagaaaatcactcataattctgctgcccatggcaaccacaattaacccatgcctgccttccagtctttttaccacgtgttgtgttgtgtggtgtttgtcccacatagagatcattgccatacgcccatttggcacattgcttatttttccctgtctttatacatttcatcatgttgttctaaatgcttcttaactgcaattcttagtggttgtgatagtccacagaggggaagcattgctgtttatttatccatttctatgttgttggtcatttatatggttttaaatacttttggtgtcataaggagtgttgtgataaacatctctgtgcataaagcagtttctatagttcccattatgtctttaggatagattcccagaaatggaattactaggtcaaaggttgggcacattttttaaaggtttgtgagacatattgccaaattgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatgggctacattaacccagcattttggattggagggtttctaaagaggtttcgttatattaatggatgacaagtggatacttaagaaaaagtgtattttggagaaagttgcaataatacctactagagattgtgtcctccctcaaaatcggagtgccatccgcgctccatgagtctgacactttgtaggtgctttataaatatggattgaagcaaatgagtgacgttcatatgatgttttgcagttttttcaaagtgggttttacattgagaatctcatttttccaacaaggcaactaaggcatggattcaataatgtgccagcggcacacacatagcaaatggtccagccacgaagagaacgggactgtccagccgggaggacagtatgcttttcacctccctctgtacccttctctgagaactgtttggtttgaatcatgatggcagtggctggcttctccacgatgctgttgtgctgaaccctattaacctcatagggaagacactaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacatcctgccgttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggccctttctgcacttccacagtacccgaagtttaggcgcccctcctgccaagagcccccattagcagcaaaatatatctcacatggtgcccagagcaaaggaccctgtgctagttttttgtggctgctgtaataacggcaaactgagtgacgtaaaacagcagagatacatttgctcacggtgttggagcccagacgtctgaaattgacactgcttctggggacactagaggagactttgttcttcgcccttcccggcttcaggtcgcggtaagcattccttaactggtggtcacattactctatctgtgcctccatggtcacttggacttcccttctgtctgtctgaaatttccctctgcgtttattttttgttgttgtttgtttctgagacacagtctcactctgttgccccggctggagtgcagtggcatgatcttggctcactgcatcctccatctcccaggcttaagtaattctcctgccgcagcctcctgagtagatgggattacaggcgtgcgccaccatgcccggtcaatttttgtatttttagtagagacgaggtttcaccatgttggccaggctggtttcgaactcgtgacctcaggtgatccacctgccttggcctcccaaagtgctgggattacaggcgtgagtcaccatgcctggctatctgcgtttcttctgtaaggatacttgtctttaaatgtaggacccacttggaatatccagaactatcgtatcaaaaaatgtttactcacacctgcgtataccctgtttccaaatagagtcacagttacaggttccggggagttgacatgggtatcctctggggcagggggcacttttctgcctaccacagatactgaggtgcattgctaattacatgagtacagcatttgtgaaaactcgctcatgatatcttctccatagtcgcagtcagtaccagctgctgtggaaaaaattttacgcattgtgtttacaacagaatatataacatggcttagagacaaagtgttttacttatggccagtagatggaattctaaggtccgatgtcggtttgccatgacttgggcattggtttctgttcggctctgtttacggggctgtgggatgggtacatagacactcgtctacttgaacttccagggactcgggaggcctgcagttgaataacaagagaccgtgctggtgagaggtggagtttgcagtaggatttcaaagactccatggagtccaaaaggtgggaggtgtgttttggggcatgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattcgttctcagcatcagaaaagaggtcgtgtgtgtgtttgtgtttttttaatatcccatccagcccccagccccagtaaccctaagattgaacaaaaccctacttacgtgctacggatttaatatagcgtcaggctcctctaggtacaataaaataccaagttaagagcattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcaggcggcattaacccccttaccctggctattggaacaatagcgcttctaaaagccgcacaaaatcctccaatattaagaacggagaaaaggagtgtggaaaaggtgtgggcaagcacggcatctcttctttctttttcttctttttctgtttctttccttctcttgctatttcctttctttctttttccttcccttccttccttccttctctctatccttcctttttgtcccttccttcccctcattctttctttccctctctctttctccgtctttctttcctccctcccatactctctacttttcttcttcccttccctttgttttcacgctaattccttaatttgtttttgggtctgctcgcaggaaataaccgtaagctaggataactgaggtaaaatttgtacagctaagctgaatggtgaaaggcccagatttagttctcattgtaggaaaaagggccagaataccttgcccatttttgccttgggaagtgagctcaatgaaatacatcttcatatgcccattttacagaagcagcaactgagggctgttgtactgaggcttgcaatggccacctcaacttttaggtctctgaggcagcaatgggacccttgccggggcctcgccatccacatggtcattgcctcaaaatttgggattccagttgcccttttccttcttctctcttgaacaatgtgaacgcaaggtgaggatgggccttctccgccttcaaaagttgctgccttccaaggggaaaaggtctggtcttgtaatttctggtctgtgcgtgctgtataaggaagaaggtttgggtagggaagcaacagagtacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcgtgatcaggcccataaaatactgcacatcttggcatcttacctataaaaataatgcagatacattcgtaactccccaggttttcgggagtggaaatgagggcagctggggagtgaatctgtcgtttgttgaggctctttttcctgcttgccagacactgatctaggctcattcatacaccagttcattcatcctcataacagttctgtgcctgagtagattcttgtccttatgtaaggattaaggacgttgagacccagaagggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaaaagcaggcacattataaagaattatgtcaacctgatttcttgaatcccaggacaattcatatccccgtgccatccgattagtgaatcaagagaaactgattgatatacagcaacaatagttaagaaacaggcagcatcgatggaggtttgattaaaccgataccctgggtctcctgctgtatcaaatcatgggcgaattggtaccattaggataaattactacaagaggcactgcaaagccaagctaaataaactctgccttctcgagcccctgattgtcttattaaataatttctttgcctcttaagtgtggactcggagcactcgtgctctgaaagccctcctgattaactatagccttggcctcaagttgattttataaacttcggatggtgccccagagggtgaagcttcctgttgtcaattctgcccgttgctatagataccaaactccacaatcagtaattagagcgtgccccctgccccagaactggtcaaacggtgcagagcgctcggcaaatggtcttaaaagcatccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaagacagggcaggagggtggtgtggcacaaaggcggctctgtctgacctgtcacgttaggactgagttcattcttgttcagattcagcatcttttgttacacccgaagtgcattccatggccctgtcccagccatagaaagaaatgcctttatttttaagcgagacttcttgtggaatgatgaatatgttcagggaggctgttggtggcaagaaaagaagggtgatgggttgggcttatattgtttagtggagcaaaagagatgtgaaacatttgtgtcttaaagtgttttggtcaagagaaactaaattggttagaaagtgtgcaattttgcaagctttataaaaatataaaccaatgagtctggactctgttccctaaaggggatgaggaatgaaaatgaaggtttgcaaagacatcttgccagacccttacatattttaatttaaggtggtattactgtcctcattttcaggctgaagaaccaagctctgagagagttaatgattttctccagatcattcacattcatttctgttacacagctgggattataatccatgcctgtctgactctgaaacctattttcccatttttttttttttttagggataaatttctcccaaactatatgcagatcctgctagagactgcccatccctctatccatttctcagtttgaaaagaaatcctggaattcagaatgatgaatattcattttaacatcatcttaaaatgtccttatagatgtatattacagctgtagtctgccaggccaagaattcgattggcatttccagagtactgttgattgtattttagaatcttccaaacctccgtaattgtcttgttgatttcaaacaccctgagaacatttcctaaatgctcatagcgtccaatagcatgggaaagtaaatggtttatgaggagaatttgggatgtgcaaaataagcctttgaagagagtgcattatctgaagcctgacattgtaacagcttcttaattacgctttctttcatgtggcatttttatgggatccagtacgcccaggctcaaatgatagacatttcaactcctacatccaagtgtagggagtcccaactttttgaatccatccgtgtggcaaatgtagctggacccttgggatgaagacccttcctgcatcctcccaaggagacaagttctgggccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatcccttgtgttaaatatggtagggaagcaacataatgtgccctggagtttcacagaagaaggggctttcttccagcttggggatggaggtgagctgtcattctggatgatgtgatggggaaagaggatgtgagctgaggcttggaaccaagcagagcttgggctttggggtgctgggaggacagaatgctggaaacagaggtaagaagggtaagcacctagtcaacatgagtgatttagctttgggagctgatcaagtgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacggtgagtcaattaaacctctttcctttataaactacccagtctcaggtatttctgtgtagcagtgtaagaacagactaatacagcaagggagcagtgatggagcacaggctggaaaactgagttgaggggtcagtggtggaccctgaaggttagactaagaaatttagactccagcctacataaatgtagactccatgcagaatgactggatgtcctataggacatgcaaagccacagggaattttggaacaggaaattgtgctcaaagctgaattttgaggaggtaaatacagcctctgtgtgtaagacagagaaaaggagagagtgggaagtaatttatgtatcacagttgcctagagaagacagaaaataggtgcctggcttatgtggccactgctttttttttaaacttatttctttaattttatttttttttaaattaggattaaaaaatgtacatatacacataaaatatttatttttgaataggtaatacttttatatggttcaaaaatcaaaagtagaagataaaaacaaggtgtatatgtatatatatttatatacctatgtgcatatataaaatccttgtatacatatacacacacacacctatgtttttctttatgtgtgttaaaatctccctctacccctttcctttagcacctaattcctcttctgaaccgatgttatttcctggtgcatccttctagacattattatgcatttacaaggcaatatgtttgtatattcttctgccctccccttcactttgctatacacaccttgctctttttgcttgacaatatatcttagagatggttctaaatcagcatataaattatttcttcattttttaacaactgctgagtattacactgtgtggatgtttcataattcattgaaccaattccctattgatagacatttgggttgttcccagccttttgctattgcaaattgtgccgcaacgtgtaaccttgcaccgacatcgcttcccacgtgcatgcatgtatttgcaggattgagtcttagaaatagcagcatcggctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacgtgacagttacgcaaaggcctggtctgatagaggaacaagagagagagaaagtgcatggcaaagacccatcattgatgagtgactggatgtgaggaatggagcaggggagatgctgatgatttggttacccccttctccatcccccaccacccactgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgatcccattggagaaatctttcctatcacttccaatccacgtgtgttcagacaaacactaattttgttagtacaacgtcccctaatagctaagagttaaaaaaaaaataggtcttagaagtgtgaaaaacaaaaaacaaaaaacaaaaaaaaaaacactaaaccccaaatttgtccttttaacactttcagcaaccctgtaaagtcattatcatccccctgttacaggtaagaaaattaaggctcagagaggttaaataacttggccaaggtcacacagctattaaggaatggtaccatgtcttggacccaggttaactttaaatcctgagctttataacggtttgatttcagtagcaaatgcagtggcacagaagggtctgggcatttatttccaaagaatgatttcactcaactgaggaattctaatgttttaacagcatcctacttatttctaaagtgttggggtgaatttgccaaggtttgaaaagtgcatttgtaagccagtaggattcaatctgaagtcagggataacagagccgggggcggaggctaggtctccttacatattttgttcacaatgggactagaacactctgcagagtatgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcagggcctaggattggaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatggcggtttattccgaaagactgctgtatttatgcttaaataattaggattacctctacctggtatatttgcagggacaagcaaagcatacactgaaaataaattctcaaatgaaattcatttcacattagttgcatcccaacattcctttatggactgcattccatgcctggcactgtgcctatgatttattaaaatctaaagccattaataaataaattattcaatccatgcattgaattatctagctcattcaaagacagtcacagtccatccctcaaagagctcatggaccagtcgaaggagggtgacagcctgggtcaaattggtgctgagcacacaggcaggggtcaggctccctggagtgaagtgtaagcgtcgctgttcactggctgagtcatctttggtaggtccctttaccactttgccactttaagtctccgtttcctcatctgtaaaatagaggtaataaaaacagctaatatttacagagagcttactccttgttagcagttttcattaattaatgggtgtatttattggaataaccgtgtaaggttgccatttttatttccatctgtgtgttacagatgagatgtgtaatagaaagggaatttgcccaagctcacagtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgattaatacaactaataaatagtgcattagtattataggcacaaaagacagtatgaagtacagcacagatcatgaggagggtagggtcagttctacgtaaaaacagggttagtaaaggcctcagagagaagatgtcctttgagctgagtcttgagactccagagatcaggactcaaggactgtggaacctgtacattcacatcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgccacaatgtattacagatgcagagtcttcatcttgttgggctgtgatcaagtacatatgctccccagcagttctttgagatttccatgttctccgcacagtgcggagctactgcgggtgtgtgagccaagggggccctgtgacccttgaaatagaaaagggggaaatggctgcatgccaaccgaagagaccactgcattgttggccataagtgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagggatgagctctcctctgcatgtaacaagcaaggtgattcagcaagaagactgctggtctctcccttcctccagggccatttgtgagagtgagacacaaaatattagaagcaaaagaagaagctgtactcccaagaggcatggatccttgagtgagttatgtgcttggaaaaaattagtttgcacatgaggacacaaagagagcctgaaaagcaggaggctttgaggtctttttttccctcctgattcggagggaaaaaaaatgttgtttgtgttcatttatggaaattagatctatcacatactcttatgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggacatgggtgatcaagcagcagtatatctctttactccttgtattagtccattttcacactgcttgataaaaacataccctagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacaccccttcctacgtcctacatccctgtacttggaaagcaatcatatttaaatcattgctgctggaactttagttgactttataagttacattttacataaaaaggcagcagtggtgaagctggaagagggcacctagactttgatttcaggcaagattttgttaggtcccagtattggaacttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattgggaggtagtcttttcaggaatattctgagtttgtttcttgatctcgatagcagcaacctttccatttgctctctgtctggtttctctgtgtctctctttttccctcaaacatcgcttttctttttttaaaacaagaataaatcccttaggaccttgctaagttattacttatattgtcgcttaaaaaaaactttggaaagaggctctggcatactttaaaaaagttaagcacactcaagcctctttaattctaaattcagttttgaatatgcttgtactgatgtcaatgacttttcaaaagagagtgtcccaattatttaggtggccaagagaaacagctttaattctttatcacataaatatgcttcaaaccacgatttaaaccagatggatggagcactggattagtggtggggcttcttggctgatctgagtttcgcctcctcgatcttgcctgggtctgttctgtcacttggatcttaccagtcctggcaggcacacagctctgtgagattttccttctggctttgcatgaagcttttgaaaagaaaacacatacatgcaagtgacctttctagggttgtttctagtttcttcgtcttacataaagcccctgctaatttagcatggtgtgtgcccgagtttattttctttttaacaactttatttatgtaattaagcgagtgaagtcatacattttattgatctaatgaaacgcatttcatggttcctcctgcccttcatcttctgaccttccccttcagatcacagccctttactttcgtcaatgagacgccacttaacaattttccaccttgccaaatttgaggtccccctcaacattaacggggaacccaatatcagttccttaaatgggagcaaagattgatgtcaatataaactaggacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctgctgtccttgccggtggcctgcactggggagttgtatattgtatcagtaattttaaaagccagcaagtgttctaccagctgaagaagttttcctaatggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaaaaatttaaggagcaaatatgtgagccaggatctcatgctggactatctaagcaagcatgtaggaagagtttgtttcttcctgctatggccatagaggtttggttgtcactatgaagaatgggcctgtgtttttttttaaaaatatgctgatctgggtgaggtcacattttgctattctcagtggagggaataattgggattatcttatgatttttttttctctttaattttcttacaaaggaaaaagaaagaatccaatttgttataaataactgctgagggcagtacatgttgcaggtagtcactatctgggactggtggcacaggcagtaaaggattcaccaagacagttgtaggtaaagaaaggtggatttattggagaagataagaaagtacactgtaaggttgcaacaggcagcccagcatggaaggggctgtctgcaaagaggcaggggctggagggactgaagttatacagggtcctgttggagggagctatgtgcagaatgaggtcgaggtcattgtgcctgcggattgtttgttgttcttccctacccggggcccactcctacctggggcctcttcctcattgctgcttacttattagaactccacagtagattttttataaatgcagacacatacagacacccacacccacacatacagacacacacagaaacatatacacatttaggtcgcgatttcttcacaaggacattcttatagacatgtcatgaagggacttggggctcagagaaatgaagtaactcagctaagtctgtacagtacttagccaggggatttagaaatccacccagggatggctccagttgcctgtttcttttcatttgacacgggatggcctaatgggtccccaccaggggtggcttggaaaggagaaagcaactgcattcccactggaaggtgttctgtagcaaagtggagtgaatgccaccaataatgagttccaaacagggtatgtgtttgcagacaggagctacatacatttgaaaattaggatgatttgaaattgaaatgagggcttatgctgttcattggattaatttttctctcttataaataaaaaatatatacaaataatacataaacattgtttttcactgtggcttgaattttctaacaatttttttcttcttctcaggaaatgttttcttcttatacctccaaaataaccactgttgacagtgtattgttaaccttgctagaaaaaaatatttatttttgatccatacacgtaaatatgcatactcataaatatgcattcatattttgtgtatgagtacacttgttaatttacatgtatgtcttgatttatatacattgttctatacctttccttttcccataattttatggattacatttattttcatttctgtatatttagttaattcttttaaaaggctgcctgttatcccattgtctgtcttcaccatcatttacttacgtaataaatctgttaaataattttaatataaatctattcatctatccatctattaaaagagatttaagttatttctaatctttgcatattataagttgcatttcagcttataccttgactttctttgacatatacatcaataggtagagtatattcctagaaattcaattgtggaccaatgagatgtacttcaaatttttaacagatatttcagtattgacctcccaaaatgtattcacacacccaccaaatctaagtgtctgtgtaacacacagatgctgatttggagtattaccattttaaaaaaataatatagctatcagtcgtgtaaaaaaaatcctcaccattatttcttaattttacattgtaattgtgagtgatgttgggtagatttttgtacttttattgaccattcacatttcttcttttctgaactgcctttccatattctcggtccagctttctataagattgctctcatttactggtgagagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgaatttggcagaataccatttaagtcttgtattttccaaagctagtcaacgtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccctggttcaagcgattctcctgcctccgcctcccaagtagctgggattacaggcatgcaccatcacacccagctaatttttgtatttttagtagagacgggattttaccatgttggccaggatggtcttgatctcctgacctcatgatccacccgcctcggcctcccaaagtgctgggattacaggcgtgagctaccatgcctggccctgatgtcacttcttaggctaatttctgtgaaattgtgattgggaggaaaaagtgaacaggaacttaaagccagcagaggaaagctacctgcccttcactggtggtcagtgcatggattccagagacagggtgggcaccagttcctcaccgggtcctttctagttgcatgacctggggcaggtgactttatgtggctaagcctcagcttcctgacatatggcaggagtaataatatcccttgaagccaacaaaattcaataggcacatgccatgtacatgcctgtgttatgccgggaacttcttaacatttccagaatatgtgtaatcatatttgttacatgcaatatgaaattatgtgtaaactgtccaacctgcaggaggcagtagatcaatcaattacatgtgattaatcctccccctatcttacagagaataggagagaaaatagagctccaaggtggaggaaaagacaactgagaggaggctattgtgatgttttattaccataaactgccaagggttagtcgtagccctccatctgccagctaattccggtttcattaatatgaatattctcacgcttccagaaggaaattcttggaatgttatggatctctgtagcaggcacatgcaacgtccagtgcttccctgctggtaatgtggcggttttattatgcatgccatacccatgctctctatttcctcgatagaccttatagaaatcaccatgcttccttttagaagaaaatgatggtatcacatggagaacgagctgaggagcttgacaatcttggcaaggcttatcaaaagaaaattcatgtgttagccttaagttaacactacttttattaaattcagtttttatcacagctgataacttggagatgtaagcatttagagacagaattcacttatgaatgttctaaaatgtcagaaagtttaggattctcttcaggtagtttcctttctctcacttggagtgacatgttggacccgtggcattgtcccgaggcaacgttgtggaatttttagagagtgtttgtctgttagctgtttgttttgaacatgttcacctttggctctgacctgccatcatggaaaaaaagtgtcaatgtgttgggaaagaaatgggctgcttctcttttctcctccctcctccgtctccttcccccgaccctcctccatccccttcctgcccccactcctcctgctctccagcctggcctctgtcccctctgtgttcctccccttcttccttgtatccttaatgacttccaggtgtgcctgctgggtcaggcttctggccccgtcctggggaggctgggtctgtgcctccacaaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatactgttcaaccttgtgattgaaagcccaagccctgtgatccacagcaggggccacagccagaaataattccccgagaatactgcgtgtgccttcaaatggtccttgatcatttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctctttcctgttggaacaactgcctcactcctgtggccccactgtgccatagacaggttagagaacatgggccctggcatcagacctggcaggcagtcttgattaggcccgttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagcctccagagggtgagactgacatctcatttctctttgcagtcacagcagagatgcaggcccacagtagggactcaccagatgtggcagggtgagggaattgtccatagatgccttaaagatatgctatccacaggagcagagagcacagcaggctggatgccaaggagaattcgaccagggtaaggcttacaggcaatccattcagtgcagagtcttcccccatccacacatataactccctttagtattgatgacctttctctcctgaaatattacagaaactgccctgaacgaagatagatggtcccccctcagcgttcacacatggttccgtctcatccaccagcttccccggccccattccctctgtctcaggaaagtaataatagtaactcataataatagttcaaaataataataatcatacctgggatttatatttcagcgtgcctcctaagagggcaaataaaccattttacacaatgcagagagaaggacagattttctttgtgctgctgctgatcacgttaagccaggagagatttacagtcaaattccagctacagaagcaaagtgttggtgccccgttggcatgtggggatccactttaatgttgttctcttggttttgcttaaactgccaagtgaattactgtaacacactttgcctgcagttaatttgacatctagtgccagagagctgctttatatttttcaaggcaagccagggtgaaatttttgcaaaaagatttgtccatcatttttactgatgtccaaacacgatgtctttagcttctttggaatcgagctgtggaagtcacgtgggctttttcttttttcttttctttttctttctttctttcttttctttttttaaggatcacagaagaaaagcaggccgatcttgttgaaatgtttttaaaatctccaaataataaaataggtttagggtgtttgcttatgaaagctgactttcaccagaatgatttatatgcatcatgggcagaggggcagtccaataaaagaggcagaaagggctcttgaaaaatgtccctgggcacttgcccgaatgactttagtgacagtatctactaaaactgatactaattctgttacgtgttatggcgcatacccaagaccctccccataaactatttgaaagaagcaaagttgtaattctccaaatacggacttgtacatttctgatcattttagcaccaacattggttcaaactctggcagccgaccacagttccagctgagctttgctgcgctgtcagcaccatggggcctgataaagcatttttggatttttcctactcacagtgcccccatggtctcaatgctgttgagaacattaagctccttacctgtgttttgtggttgttgttattgtttttctttctggtaaaggactttatctgcagtcctaacaaattgacttacgttaacattctaactcgtggctaaaccaaaaataaacttgcagaccctgccctgaaatgcacgctctgagcagtctattggatgcggtggtgtggccgatttcttggacttgctacattcttaggcaagtgacatctcccttcatttgtacagagggagttagaattgaatcgaacttccaccgcagcatccgccagctcttataatcacttgccctttgctgatggtgagtttttagctgctttctctcctaccatacagcactgacacctgagaagtccagtccttttggagttcagtagattccttgtctctggaaaatcagcagaaaacaatgcagcctcctcttgatctcccctgaactttgcaaacctctctcagcattgaccgcatgaagggtgggtgccctgaggcaggcaagccaccaggtggtaattaagaagcaagaagcgctgctcccaattctctagatctggatttagaggccagttggcttcagaaaacatctcattcacacaaaatgggacatggtcttttgtctgttaaacataagctttcaaggtgagttgtgcagaggcaagtctgcttgtttcatcaagctgacgtttatacttctgagtaagtagggggatccggagagtcttcttgtcactcaaacagtttccgtacgtcagtttcacacctctgttctgcatgtctctgttgggaaggatgctgatgtctgggatttgaaatagagatggttggacctctgactttcaacaggaggaaatcaaaattaaaggaagaatataggcgtacgcttagaaaggacctgtgaaaggaagataaatcttgggcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaaagaagtttggggtgaaaacacatgacagtttcttgttcatatttggccagaaggaagcagtgtccattaggttgactctccagtgcttcttggtgttgtgataagcccgtctagcacggagggccagaaggaagcagtgtccattaggatgactctccattgcttcttggtgttgtgataagcccgtctagcacggagggccagaaggaagcagtgtccattaggatgactcttcagtgcttcttggcgttgtgattagcccgtctaacagggcgggccagaaggaagcagtgtccgttagtatgactctccagtgcttcttggctattgtgataagcccgtctagcagggaggagatgtctacacggtgttctccaaactgctcagaaaagagcagtaaggacaggatggggcccagttaagaggtatatatcttaccttctctttttctccttcttctccatctcctgcccttacttcttcctgcctgtcatttatttattcttttcacagatatttagtgagtccttgctctgtgtcaggccacagtgtagatattccagggatggaggtgaccaagcagacatggccatagtgacaggctaaggaagcacaaatcacaaatacagaagataattcctggtagtgacgggtgcctccaagcatataaaacagggtagtgagatgggaagttagagtagaaatggctcaattttgtgctggaactggctgcaccagcaggagccaatgattacccatctcccatgtttagtgacatcatgttgatagcttgatttcagccatagtgagaatattttcaccacggaaattggcacatgctacacatcagggctccctcctccccaccaaagctgatcattaaacattttctagaacatacctggaaggcatctgggaagaggtaacattgatcttaattgttattagagagaattttcaatttcagttgtagcatgaaaaatcacagagtccatttatttctcctcttcgagtcagtatatctcaaaacattttttcaacgttaatagaaatataagaagtgcctggatcagtttttgtttttgttttgtttctttttgagatagggtctcattccgttccctaggcgggactgcagtggcaccattatggtttactgcagccttgacctcccaggcccaactgatcctcctgcctcagtctcccaagtagctgggactacagggacacaccatcatgctgagctaatttttatatatatttttttacagagacaagttctcgccttattgcccaggctgatcttgaactcctgggctcaagccaccagcctgcctcagcctcccaaagagcagagattacaggcgtgagctaccacacccagccatttatctgttttttaaatagcattttggagatgacagaaaaaaaaataaaggaaagagaacgctcatagaagtttaaggttcagaagtatttggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtatttcttgaattttaactgtgcctgaagatcaatcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgtttcacaccctatgtcttgtgtgtggtgactcatttgaaccttatagcagccctgagggataggtgccggtttgtctctatgcgcccatgggaaactggggcacagaggtgttaagtaagtgacccaagaacacacagctggtaggagttttagccaatattccagtctcgatctgctgatatgaagccgatgcagctagccaccatgttatacccacccatagtcatgaaaataagatgagcttaatttttttcttttgagactgggtcttgctatgttaccctgggtggagtgcagtggcacagtcatagctcactgcaatcttgaactcctgggctccagtgattttcagcttactgagtagctgtgactacaggcacaggcctccatacccagctaagtttattattttttggtagagatggagtattgctatgttgcccaggcttgtcttgaactcctggcctcaaagcgatcctcctgtctcagcctcccaaagtgtggagattacaggcatgagccactgcacacagccaaggtcagctttttcactccagcacaccaggattttcatcccagctctccaatcccccagctgtgtgggcctggtcaacctgtttagcctgtcaagacttcagtcccttcaactgatagatgggagaaattaatagcacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccctacttttgactttataatattaagttcgttcatatctctcttagattcttatataaattttattgacctaatgttctgtacagtagtccttatttacagttttggtttccaaggtttcagttatacattgtcaactgtggtacaaatatattacttacaatacgatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggtcttggagtatatcccctgtgcagaagcggaggctactgtacatacatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaaccaacgaaacagcaatacttgtaactaaaattgggagaaaggaaaacactttcagtagagtcaaggatttttttgttaattatttttatttttagagatggtctcactatgttgcccaggctggtctcgatctcctaggctcaagcagtcctcccatctcaacctcccaaagtgttgagattacagttatgagccaccgcatccagcccacaagtattattccaaactgtaaaatcgtgaaatgttttgcattagaatcagaaactagacaagaatattcatgatagctgtcaattgtcacattattttagaagttttaacaaatacagtaagacaaaaaaagtcttaagtaatgggatgaaaccaaaatgttctttgttttaaacttctgtaattataatcctagagaagctaaaatattcagtaaaaattactagcaatgaaataatttgaagagttggctagatgtaaggtaaatatacacaaattagctggtatatactagttataatttaagatggagatagaaaaaaaccccattcaaaatattaacacaactatcagatatttaagaataaatgtataagagtgatcaaatacctgtattaaaattatataatttattgaaaggaattttttgaaagtcacccataaaatgatataattttaccataaaatatcagctaaaaagggggcagtcagcaaaagctcagctgtgaattaagattattttctaacccttagttctttgataacataaataccggtagaacttggaatatttcaagtaaagtaacatgctgtgttttatctgtattcctggtaacttgcatttttcaaggaaggaagtgtatgatatgaagtaggcttataatttagtcagatgagctcttggattatgttaccttgaatataatgcagaggagaaaacaaaaagagtcttttgcatttttatttcttatcaataggtccctttttcttggaatgtcagcctgaccctgaaggtattctcctaccagcagagccttctttgatgccccgtcttcaacctgccatgttttcccatctgtgaggcttctattttagagacttttcctccagaactggcttatatcatcctgtgttgctgcatccgatcacaggtctgtggctgacctgggcagcgtagtagaagggtcttgagatttggagtcgtaacgagttttcaaaactcataactatattacagtttgcgcaagtcatttaacctatctgaaccttcatttcctctcccacacaggataaaataaggataataacagccattttagagttcgtattaatatttaagtgggagaatgcagccagtaccctgagaattaaggttcattcactcagcaagtgcttactaagcatctggtttatattatgggaagttttgagaattaggtggtcagaaaggtgtggtcctcgccttcaaggagcttacattctaggaagcgaagactactgaacaagagattttagtgctaggattggagaccccagcagaagtagcaaatactgtgtgaggtttaaggaggttggaggcaccttcgcttgtacttctacatgtgtcccttcatgtctagttcactgattttttaattgaaattttaattgaagactcacatgtagttgtaagaaataatatacaatgattcctcatattcttagctcagtttcccccagtgatagcttttgcaaaacaattgtgcaatatcacagtgttgacacttacagaatctatggatcttattcagatttctcattttacctgtactcaagtgtgtatatgtgtgtctgtgtctacatatgtagttttatacagtgtcatcaaatgtgtagcttcctttatacacaactacatcaagacagtgaacagtgcatcaccacaaaattcccttgcgttgccttgcaaaccacacccaccttccttctgcgcctgcctcatccctgacccctggcaaccactaaactgttctccacttttaaaatgttgttttttcaaaattattatataagcagaatagcatagtatgtaatcttttggggactgacttttttcactcggtacaattccgtggagattcttcccagttgttgcacgtgtcggtagcttgtttaatttcattgctcagtagtattccatggtattgtacatataagtgatcgtatgtttaatcactctcccgctgaaggaaatctagtcttggctattgaaagtaatgctattataaacatttgtacacaagtgtttgtgtaaatagaagttttcttttctctgggataaatgcccatgaatgcaattggtgggttgtagggtaatgacatgattagtttgtataagaaactgtcaagctgtttccatgctattttacatttccaccagcatttggtgatctagtttcactatatcttcaccagcatttggtggtgttgcagttttttattttagccattctggtaaacatgtagtgatatttcactgtggttttaattaaattgccctgatagctaataattttaaacatattttcatttgtttgtcatctatatatcctcttcggtgaaatgtctattaatgtttttttctcattttctatttgaattgttgtattattgttgcattttgaaaattctttatatattctagttattggttctttgttggatatgtggtttgcaaatatcttctctcaatctacagcttgtcttttcatcatctttacatggacatttgcaaaataaaagtatttagttttaatgaggtccaatttatcaatttttcctttcatcaactgagcttttgttgccaaatctaataattctttgggtaaccatatatcccaaataatttctaatatttttttcctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtgggtatctttctggcttctttattccactgatctatgtgtctgtctctctgacaattatacgctgtcttcattactatagctatgtagtaagcctcatgtcaggtagagtgattcttctcactgtattcttttttattaagattattttagcttcctaagacctgtgctttttcatataaattgtacaatatggttgtctatgtctaccagaagccttgctgcagttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttataatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatatgattttcctttagctttttgatatggtggactatattgattttaaatattgaaccagccttgaagacctggaataaatcccacttggtcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgcataagaaccaatgagcatttagtttcatgtctcataaataatctgcctgcttatattttcatctgtacttctctcagctggcattctgccacagactacatttaggaccgcagccagtgggttacagcaggagaccagactccaagttctggcctcacgttgcttggtatacatcactcagttctgttggcatggatgctcctcctataccccatcagccatcttgcagtatgggtttggtggatcacacagggattcagataagagggttcagatccttctatccatcaacccacccatccacatcactgaaaaagggactctcagatgccgatgaccagtaagaccacatctgtgggcacaaaagagcccatttatgttttttatgggaacctaagaaggaaatgcttttctggtcaaatacgttcttctctgattaggcctctcattttaaggcagttgagaagactcacagatgtgattcactggcaatggctctggttcaccaagcttagctctgctcagtctacctttagcagaagattaaaaatgaaaactcttcttgttagaggtagaagagatcctttcccaaaccatagattcatggaactgtcaaagagcagcactgaactttgtactcaatgccttaatttttccagttgaggataattcacactaaacaagggatttcacctctctgactcatgcatcaggaacttggagataaagccctgttaataattcataattatatagcatagcatagggcagtttcagatgcttcaactaccaggtaggtagaataaaggaatgaagttgctgtgtatacgatgataaatggtgctaaatctatgtccccaatatagggaagacaggagaaagtgccaaagatagtgtgcatgcctcatctctaaggggcagccattattgacgtccagctgaatgttgccacgtggaaattagctataaacttgccagaacctccagtttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccagttggagtgagccaaataaaatacatctgcagtccagattcaacctgcaggccatcattctgctgtcattggtgtagaagactttttcagcctagtttattctaggctcttttcatttctccctgatttgaggctttgtaggacgttgcacaggaattatttcccttttaaacgttagttttcattttaccagtgcaactctgctattggcacatctatgaaatacgtaaagctatcattttaatactaaagaggaaacacaaatttgactcatttccccagaaaattcccctcctgctttccatatgttatatagttaactgtaaaagtggcaccacctcttaaacagccagctattctgatcatttgaaatctggaacattctttcctacggtggttgacttttcactgcctttgaggttctttccaagtaaaggcgttattctttgtggtgtgctcctggaggtcactaacaaaacgtctccagcaggtgttgtgtggattcccccaaatccgtaggctcttatttcctagacatgaagagtatgtgcgccttctttttggttaccctggaccagacattcctcagcactggcttgcattggcaggaggtggcagagggagaggacagtaaccaataccgctccttctacatgatcagtgttcaggttgaagacaaacagggctccaattatgttgtgatttagaaggcgacagagctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctccgaacggcctgccagggtgcctgacagccagagccacctaatgggcctatttgatcctggagttgctgtaatggcaagaaaaaccatggcctccagccccagtgttgaagttttgacgctaatgtgatgataattctcttttctttgactggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaagcagaagttgggaatcatagaagaccttgatgttaccatatcccttgttaaatttcctctaatactattgagaagtttatcctctactttttcctgtagagtaaaagatatcgattttgtttctgtcggcactgccttggaacttgcttgcatccctcccccacgcgaggcgaggccctgaggagcgggattcgctgacccatgctggcagaacgggtgatggatgaggcagagaagggtacaggctggctggaccatgcgatggggaatgcaggcggaacaggcttcctcctgaatcaggagtggaagaggagtctggggtgaagccaaggggaagacagttaagctttaaaaaaccaactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccgggaggcagaggttgcagtgagccgagatcacgccactgcactccagcttggcgacagagtgagtctccatctcaaagaaaaaaaaaaaaaaacaaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgggggaaatacaaggaaggaagagaatgcaggcagctcaaaagagccgggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtagtggcttgcgaaaagattccagcactaaagtttgaccccagtcctacctgacttcctttctccagctgtgagactcccctgtacaatttttctggagggtctagagtcacatgagtcacgccaagccgccctttcagtgcgaaggaatccaagcagagccctcctctgctgtgggtacttacttagggaactgtggaggtgtcctcaggtagccactggtgtgtggggtcataccaagtcatttggtttacatcgggaatgccttttgtcgttatgtctagacccctggagaacagcccacggcaatgcacttgtggaaattcggactgtggattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttggggggggttttttgttgttgttgtttagctgtttatgggtaggagaatgcgtgctcttttagggacatctcttcaaataagaacaggttgtaacctacactcaaaagagatgctcttggcaaggtatggcccctaaggtttgaaagcgttttccaggcctgctgtcaggccaggctggactgtccacaatttcttgtcctgcctcccgtgatgctagccatggatgcaccccagaagcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagtatttgtgtaagtgtcctctgccctggacaccggtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccactcttttctgaagtgatggggatattcgatggcaattttgtgttttcttcacttggaaaaactaaaaagtttgcaacatttaaaaaaaatacaacccttatgctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttgatccaaggtttaggctctcagtgcctgtttcctgtttaatacatatcatggttttggaaaaaatgaaagaaagaaagaagaggaagagctgtcattcctctgacaagtattttcagtggaattagggtcatgatgtcatgcttatttcaaaagatagcttcatctgtgccttcacccagacttagggttctagattcttctagattctacagcaggcactggcaagcttttgcttaagaaggcaagccgggaatggtggctcacgcctgtaatcccagcactttgggaggccgaggcaggcagatcatgaagtcaagagatggaaaccattctggccaacatggtgaaaccccatctctcctaaaaatacaaaaattagctgggcatggtggcgtgtgcctgtagttccagctactcgggaggccgaggcaggagaatcacttgaaccagggaggaagaggttgcagtgagctgagatcacgccattgcactccagcctggcgacagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgtcttataccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcacagtctcactactcataggcccatctgttactactaacagtgctaatgtgattgtctgtaggtctagcaattggaggttgttcgtttctttgagacaaggtctcactctgttgcccaggctggagtgcagtggtacaatttcagctcactgcaacctttgcatcctgggctcaagcaatcctcccacgtcaacctccagaatagctaagacccaggtgcgcaccaacacacttggctaatttttgtgcattttgtagagatggggttttgccatgctgctcaagctattctcgaactcctgacctcaagtgattcacccgcctcagcctcccaaagtgctgggataacaggcgtgagccaccgctcccagcaacaattgcagtttttaaaggcagaaaatattacacaggtgggttcaaatttgccacaccaagtagaaggtgttggaaggaaaattaggaattcttaagcttcagaagattagtagtcagagttaaaaaccagacaattaacaagttaaaaaaaaattgtgaagcacacacagctgttatcttccagaaacactgcttacagaggtaattgctcacagattttagggtttacagcaggtatcacaggatttcaaatttaagaggggggtgggggcctgtgttcaaagtcttaagaatatccaagggatgtatgatgtatgcataattacctgaaattgaaactactgtagtttaaacacttgctgaaagaagaccttttatttcatcttctctacaggctgaaggaaagaaaaaacaaaactaacaactaacagaaaaacttttcatgtcgaatatgtagatttacaatatgtgaattatcatcagaagaatgaggttctttgatgattgttgcagataccctgaagaactggcccttgttgtagaagaatggcacagggcacatggtaaaatggccctggccattcctttagacattttgtttgtacttatattaacttgagagaaagtattaggaaaaacagagtaattctgtagaaatattcctgatgatacactaggcaaagcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgctatgtcagagtggagggacatggggaggcaccaggactggtcaagaggcagagggagagggtcaaaccgtgggttctgtggggaggactgaacgaggcagggtaagtagactagggtttgagtaagttcagcaggctctggggaagaggggctgtccctatttttctggtacctggccctgggtgattagaaagggtggatggtggcctggggcatgagaaataaaggaggtggtggggtgtaagttctggattggttgggttgcattcaaaaggggtgcccccaagtgagttgtttgctgcctctaggaatttattgaccctgggaggggagatcccagatgtcaaagcatgggaggacagaaaagaaacagcatggttcccacaagagagaagtagacagagacctctggaagtttaaaaatatatatgttgggatttcatagatgaggtgagcaaaaaattggccgggaagaactattaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacaactccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgtttattttgttgtttattcatttgcttgtcatctgtattttcccactagaactcaagtttgtgacaacaaggacctaggtcattttcactgctgtagtcccagttcctacaacagtgcccaggacacaccaggaacgtgacatttattgaatagatgaaagaacagtgtaaaaaccacattgctcttcactctgcctgcagccaactcaagaacaatttcctaaagcagctctgaaaattacgaaagaaatagtgcatggattccagccccagtaggcttctgggcttggtgtttctttaatttcatgtaaatttctctaagtaaatatgccttaaaagtgaataaaattttatttcgctttaacaagagaatataaaagttaaaaaggtcactgtagtaatagactaatctcaattaccagggcagcctctgaaaccctcactcccacctaatctcattcggtgcatacgcagctcaccgtgtgatttccaacacagctaaatgaaattataaagcagtgttaaatttattaatcatttaattagctaaatgttcctgcaagtactggctagatgaatggcatgtcattttctaatgcaatttgcctctcaggcagccagggtcagaaagggaagctcctggcatctcgaatgagctctttatatcacaccttctactgggagacggttgttataccactgattatatttgagacttgtacacaagaccagggcactcagatgctggaattggaaaatgctctctttcttacctgggttacaaagaggaggctcagggtagctgatgagtcccccagagattgtctctccccgtgtccccttgcaggacaaatcttttcatatttaacaagccactgagcagaacagggggaaagatagcaggcagtattaaacgcatgctcaatctagttttatttcttcaaatttactcagtcgagaaaaatttgtggagtgcgaattctcctcatgctaggtgactttctaatccttctagttgagtcaggatttatttctccattctcgccttctagcctgggcttgtcagcttggggtgtatgccgcacctcctctttgaagaggatcttcatttggaggggtgatctgactcccaaccctccccaggtgaaagcaccgggattcatacctagggggctttgggatttggggctgactttgacccgtcattatttctgactgcaaaattcctgacaaatgtctgctgctgggtgctctgtgaatctgttcccatttgcagtgagagtgctggcatcaagcacattgtctaaattcactcggcaagaagccgttggagtgggtgccacgtgaggccgagaacatccaaatgaacactggtctgtttgttcaagatgggagctgtcagttgtgagagctcctatgggaagagtgttttgatgtatagacatccctggtccacagagccaccaagcaaggcagactatttcgtgagaaagaaggaagatagactccatgcaacacagtgggtgtggcaccaagcgggaggtggagggttgctacctagtcccggctccacctactgtcacctgcattcccctagacaaatcacagcacctcaggatccttgatctcatcatctgtaaaacagagatcagatgaaccctcgatattaatatcaataagagccgatcataggactgctctaaggattaaatacaatgatgtaacctacttgaaagtgtcatataaattctgaggtgaagtggaggcattatggatgcattttattttgttttattttatttcatttattctttttttgaagaggtatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatatgtctgtgtgtacatatatgtatatgttctgtgtatatgtagacatgtatagatgcatgtgtgtacgtatacacgcacacatacataaattgtgtacatacacatatacatatacacatacaatacatatattctgatacacatatgtacatatatgtgtatacatgctatatataatgtagcacgtttcctggcaccttgtttggttcaataatgttgctgggattatactacaatttccattactctgactatggcaacactgctgatataggagatcacttttccgcacaaacacctctaggtattgtttaacacagacctcatgaaataggtttgccatggattagataaggcaattctggactcacttccaggatagaaggcaaagacaagtaccaatatatttggtaaaaatatgacatgacatttgagtgcacacaggcaagtgaaggtggtttcaaatcctccctctgtcttttcccagctaaatgaccttgtgctggctcctcacctcctaagcctcagcttatctctaggatggacgtcattgtactcccttcatcccacctaaggttgttgttaaggatgaaatgaaaagtccacagcataagcttgacacataaaataagcacccgatgaatactgactaaagagagaggaggagtaggggagagaaggagagaagagaggaaatgaaaatgtttctgaataagttatgtctaagttttttcactttttattttttattgttttcaggacagggtcttgttccattgcccaggctggagtgcagtggcgtgatcttggctcactgtagctgctgtctcccggattcaagcgattcccctgcctcagcttcccgagtagctgggattacacccaccaccatgcccggctagtttttgtatttttagtagagatggggtttcaccatgttggccaggctggtctcaaactcgtgacctcaagcagtccacccgccttggcctgccaaagtgctgggattacagacatgagccacctcacgtggttgagattttttcactttaagaaatgctttttctgtcacctccctggactgtcttggatttgtttctttgaggggaaatatgaggctttaattttccctcccaggccttggaaaggccaagagaagcctggagataggaatccacctacacagagtgtctcagtaaattggcagtggccaggaccagaaccaggacacctgtctcccagatctgtccttttcttggatagcttgaagttacgggtagttattgaattggtcactggctaccccctgaatcattacctgattttttactgagtgttcctacctgtgagtaaagggtgcctggttttgcacaagtgttttcttggcccaagagatatttttatatttgcctttgggttgatgagatgctggtatgtatcattcgttcagccattctttcagtaagtcatcacggaagtctgcctctgtgacagattctggggctctaaggcggaatttacttcttcaaagtacagtttcctgccttgcaagtttggagttaaggccacgcagaccagagttacgtgcacaggttgtaatactctctcttgtccctggttgcctgattcaagttaggggcttcttctggattccgtaggtaggatgctgactctcagctgtcctgatgccactggtgttcctctagtaggcaacattgatggtaaacatagaaagtcatggaaggcctcagttacctctagccctgaagacacagggatacccttggggcggagaccttagggacaggacaataaagatcaggccttgggagatgcaaacagtttgcccttggaccatgtcttctgctttcatccttatgctctcaacagatcatgccaaggtcctgtgttcaccgccttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcctgttgctctgtaattcatctcagcaaccatctttcccatctctgggaagagaatgttgtcccccagaaaaagtccttatggatagatttagttattgcttatggtttagagaaagcgcctttcaacagtcacatgcaagtattctttcaggcatttatccaaacacacaggatgaggcctctttgtcaaaccagtgtttgttgacaagcgacatttgtgtgcaggagatggctcattgtgtgtgtttacttggagctgttatatatgctgggggagacactgtgtatacaaacctaggagggagagattgggaggagggaagaaagtgaggaataggcttagtgagaaagagaccagagaaagagaaaagaaataaacattagcagggtggttaaacatccaagcattgaaaactgcgtggtggagctatgtactaactggggggtcttgaggaagcccattagtctccctgagcctcagtttagtagaagtaggaatcgtcattaaggcgcctcatttatgaagttactctgagctctataagagataagcatacagaaaactttggacagtgccttgcacacagtcagtaatcaatgcatattcatcatgatgttagagaaaggccgggcatggtggctcacacctgtaatcccagcactttgggaggccgaagggggtggatcacctgaagccaggagttcaagactagcctgcccaaaatggagaaacgccatctctactaaacatacaaaattagcctggcatagtggtgcatgcctgtaatcccagccacttttgaggctgaggcaggagaatcactggaactgggaggcggaggttgcagtgagctgagatcgtgccattgcactctggcctggacaacgagcaaaactccacctcaaaaaaaaaaaaagagagagagagaataaggtcagagggggaaaagagagaaagtgaaagcaacagtaaggaagagaattggaaaaaaaaaaaaaaaaaaggaactgatctggctgtatctgtcgagttgcttctgccgtttctagcccagcccacggttttccctctgcagggtgtctgtgggcatggtttgcaaataaacagtgagaagtataagctaaacatagactttaggcatatacataataggcaggcgtgatcgcgttcacccattcagtttgccatataaaagcttttcctcggtgccactttatggcccagaaacaaggctacaaaaactttaatactgctttttattttatagaaaaatataaatcaatactttcatgtctgtttgacgtgtttgggagctacagcaattgaggcttgccagtgtctggatgccccaccactaccacgccacttagctcagagtttgtttttttccttccaccatgtgaaatgttgctggttaaccagttaaaacggggagatggccatgattgcttttagattgccacttccacattgagtgaattttataataagaagccattttttccccgacaggctgcccttgtgcccgcctctctgactttgaggtcctcattattgtgggtttaaatgaaggatgttcattcaggcagggatggggggatggggggaggccaccaggcatcagcgctgttatcaggaccttctatcaggccaagtgacaggcgtccagagcaagaatgcagagctcatggtggagacctccggctgacaccaaaggtgactcccctcactctaaccttgaaagggaaagttcccactttattaaaatgaatttcgaaagggccgctctgacagctgcataattaaatactggagtgtcagcgataatttattccactcgcatgtggtggtcagatccttttcactagagggtcagcaaactcagtgacagaggcaaggagacaagggattcagggccctttgtcatttatgtagcaccagccctgaaatcggagactcataaaacctacaaatacacacacaaacacaaaccaggcaaacccacacaccacagagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaatgctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaatagaatcagagcaaattcagcatagacctccttgggatgtttattctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaagtagcacacaaacccagtccatgatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaaattaatgtcatttttataactatctgcatttcaggtacagtgatctcctttaaaaaggctgcgtcccagcagcatagaccagctttacctcccagcgtagtcttcagacaagttggggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagtttgcagcttttcttcccttttgcctcctctttagttcattccaatgataaatcctccctcctttgtcacagagccactgtgtactttcatagaccatcctatttttcaacgagagttcagaaccacaccatacgggcagtagtccgcattttcaacatttcctaacagcacaattgttaggtagctaacaattgaattgactatgtcaggtagacttatttttcgagttgtgctggttaactgcaatccaagtttaggaagcaaactaccaatttcatttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataaagaccagttgaacaaataaactatttttccatgtattaattctttagtgaacttgcttatttgttcagaagagacattaagctaagtatacaacactcggtaaatttcaacttcatcatatatataataattatttttttttgagacagagccttgctgtgtcatccaggctggagtgcatggcctgatctctactctctgcaacctccacctcccaggttcaaacaattctcatgcgtcagcctcctgagtagctgtgattacaggtgtgtgctaccacggccggctaatttttttgtattttattagagacggggttttgccatgttggccaagctgatctggaactcatgtgctcgagcaatccacccacctcggcctcccaaaatgctgggataacaggcatgaaccaccatgcccggccatcagaaatattttatttcactattttaaaaaattagcaaagaagcaaatatgacaaaatgctaacaattccaaaatgctaataacttctgagtggtgagtataagtgtgattattatattattcttagtatttggtttttttctgtagtgtgtagtttccctccatgacactgagggctcagatggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccatcagcttaaggcagcgaagcgaatgcccacagtgcccaagtcacttgcccaaggttatccaagtcaaataagacagagatgagattcaaattcaggccacaatgacttcaaaaacccttgtatccttgttttgtttcgtttccctgcaaacattgttttagttgagatgaaattcacgtaatatacagttaaccattttaaagtgtacacttcagtggcatttagtgaactcagtgttatgccaccgtcacctctttttagtttcaaaactttgtcatcaccccagaaaagcatacacataaagtcatcactgccccattcccttcttccaacttctctgcttttggtctctgtggatttgcctattctgggtataccacataaaaggaatcaaagaatatgtgaccttttgtgtctagctccgttcacttagcatgctgtttccaaggcttgtctaagttgtggcatgtgtcagtactttattcttttttatggctgcatagtattccactgcatggatataccacatcttgtttatctgttcatccattgatggacatttgggttgtttccgccttctaggtataatgacttgtgttgccataaacatttgtatacaagtttctgtgtggacatgttctcacttttcttgggtatatacttaggggtggaattgctgggtcatatgatcagtctaggtttaactttttgatgaactgacaaactgctatccacagtggctgcctgtaccattttacagaaaatctctgcttttaatacttctggatgtgttctaaggcactaggcttttcattaagttcatttctgcagaaagagttaaggagtgttctcaggtaactataatcaacccccagggacttactcaagttgtgcatgtgcaactgaaatatctggcaggcatccagtccctgttatttcagtctctccccgcctccctgcccacacctctgaagctccatattacccaggaagggacaatggggggcctagaaatgtggagggaggcaagagagtgataattatgccatctacacttgtcgactagaatttccaggtactttcacctctaggctcttacctggcttttgtgaagcccctcagggaagaggaggaaagctgggcaagggggaggggtaaaccaagtcccaggaaagtcattccagtttcccaagatcccggagcttgtttgtatccagctgagatccagttgagaccagaattcactctctccacacctccatcagctgtggcctcgagttccttaacattttttaaaacaaaaaacttttgcatgggaaaaatccctttagaaagttaaaggttttccttatacaaactatctcactttgaaaactggcccactgtaaaaatcttgattccggagcttccttaaaaatcttttcacccctttaaagtgaaagttatggagaatctattagatacaaattaatacgggcaaggcgtgtgctagctgttttataaacatgatcccacttaatcctccacttcacaattctgaaaagtcaacaaatttggcccatggtagagaggaggaaaccaagacttgaaacattaaataacatgtccaaagtctcccatttcagagacaggggcatttggctccaggtttttctgactctagacagtagtttgtttttagcacatcaaatgtctgagacttgtgatgtgttagaaagcacaaaggactttgatcacaagatcaagccccagagggccatgactgcataaaccacaacaactgcgtggctgcctgtcacgtcttcatctgcaagttggaggaacttggagaaatgcagtgcttccctgcagctgcagagggtctcactgagcactattcttggaattcttaaaagctgggcctgtaagccttttttgcatttcctttcagccacctcctggctgtccttttaaagccagggtaaagtccccagcacccagaatcaaggatggggaagaggaattttgagaatgtgcttcctgcttcacacaaatagctaaagacagaaatgatggcacaagccctaaccaacaactaggaaggtaggttgtccaagacaaattgcagtttagaatggacctgccaaatgggtgggtgggcaggatggctgggatcgccagtgcccaaccttgccacagcctccttttgtcactctagggactacccttttcctccccagacgtttttcctgactctaaatagtgggaaaagtctggtttgagattgctgtattgcagggaagttcttacagcgggcttgatgggcccagaaatcaagatggaaaaaaacaaccctctatgttgatggccatgcacagtggctcagcagaactggctctgttgaccaggcttgggtgctctcctgcagggcattgcaatctttaggacaccttcattacccctcctaaaaggagattttataatgagcgccaaccagctcaaacaagttaggatctcctaacatgtctggtgaaaatacaggagtatttttcatcatctctggaaaagttgctatcatgtccttcaataacccagtctaaccatgtttttccagtggaaatgattcccggtagaatgtcctatgttccttttgcacatttctccttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttggattaaaaatggtaccactctcataaatcaatgagtttcataccctaaattatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcctacaaatttttaatacattgacttatctaaatattcctgcatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagataattacaacatagggacacccggggaaaatgtagacgaggtttaggggttgctcagaggaggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgaaaacagtggttggtggtttataagaagttttttgtcggtgtgatctttcacatcagtttgctacccagaatttaaacattccttttttgctgctgttttaatttgaaataagaatggtagcccccaggtcccctaacagtgggtgctgatttcacagtgggcttacaaatgctcttcaagagtatctcagtgttgagtccagccacccaagggagactggttcttcactgtgcatcatggccttttaatgccattttgcttttttatcatccaatcagcagatgttctttcttcattcacgttgaaagcacttcgctatggaaacgagtaaagttcattgtcttattttttgtttgttttgttttctgatgtcctgacagcagaatcaatcttcggaatccttttcaataaaaaaaaaaattaccaaaacaaatatgatcacagaagcttttaaaatctgaaatcccaggaagctaattagtgcatccttttaagatggcttcctgcatttcgatatacgcataagcttgggtttcagatgcagttggcagtttgccatgagtcagacaggtcatcctgactctcaggaacacggagctcctgcagaagcctgtggagcgagggcaagttgggatcctcccctgtgttagcacgtgactgtcctctgtcaccatgtagcaggtggaggccaggaactacattttcttgggttcctggtggttagttgtacgccccatgaacttctctcatttccttaattatatccaaaataatgcccttgttttatttccccacttggcactgagccttagggagcaggaactgtgtatatcccacagctttgcatggcacttggcacgtaggaatgtattaaatgcagctgctttcgtgcaggaagcgcggacttcagatttggtcaaagatccatgatttcagagcaggcagcccttttaaacctgtatctgagtcacttcaatgccttgtgtttctgctctgggctgcaaactcaagagcagcaaccacttatcttggtacctgtagtcccgagccctgtgtctggctcagagtaggccctacataaatgtttgctcctcctcactgagtggctgcatgaattgcatccagcatgtctactctgggaaagaacctgtggagcctctttaggagtgtgtttttgccctccctcggaatctggtgatctcactaccaatggcaaagacaaactgtgaggtgtttttttgtttgtgtgcacgcgcacgtatgtgtgtgtgtaaaaaggccatggaaatataaaattgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccaggtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaaataagtaaataaatgcctctgtgaatccatttcattgcattggaaagacctccaggattctctgcagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttggggtacaactcagtaacccattggtgcagatatgtgattcttaggatggcccacatgggtctctttcacacacccacgtgcatgacccaagtgagcaaacaggcagagactgggaccagaagctcactgtggttctaagcaagcagttgaactggtggcttctgatggcctgagaagcagtttcccttgataagtcttcagccacacaaaaagagactgtagctcacaacactcacagtcaaagccactggaaataactatttcctatcaaataaagcctttctcttgaaaaatttgaagaaaaaaaaaaaacccacctagtgaaaccttagaatcaacctgaaggttcaacagcaggtgaatgattccataaatcatagtatattcacttaatggaatactaggtagccactaaaataaaatgacagttggaaaaaatacttatgataaaaggtttaatgacaaagtggggttcaaaatgagagatactctctgactagaactatattaaaagaaagatggatgggggagaggacggtgggtgatatattatctacatagatactttttttcacttttcaaagtgtttaatgtgttgcacagcctttagaatttgaaaatgtctaacttaaaatgcctccctagtgaaatctgtggcagcttataaactggcaggatactgtattttcaagatacgcaattgtaagtggtgctcacatacagtcagaatgtttatttgaccttgatcttgtgagggcttggttcccatggctttgtagagtgaaaggtcctgagaggcaggttagtgacgataccgggacacgtattgtagacaggttgataaagcaagcttccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagtttgagattagcttgaccaacatagtgaaaccccgtctctactaaaaatacaaaaattagccaggcgtggtggcgcatgcctataatcccagctactctgggcctgaggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatgagtgagcagtactcatggttaattttagaagctaataagtatatatttgataactttaacagaaatattaatactaattaagagtaaaaagatgatgaataaagtagcttcacttattgagcctttactagatgccatcttgcataaatggttgtcattttgcaaaatgtattccatctaatattagcagtaaccctgaggacttggtattcttacctggatgtgtcttatatcaacatgcacgcgttctctccctcagcataccgtgtcttattaacttctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttctcagtgatgaaatgttacagatcagtttgaaatccaactttattcaacataagaaagcctatatactctggagcttaaagactgaccttttcacttactgtaaggtatctaagacttctgggtgtgggttttaaatatattttggatgagctttgttcatgtttacacatggccaccaggtcggccacaaagctgtggctctggtcagtctgactctctttagcaggaatcacgtgacaatctgtgtctgtgattagctccgtggatattactaggtagatttctcacttgtccttgttttgatcttcattcctgggtgaaagaatcccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacacatcctgctccccactcccctaattactcatgattgcactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcagctgttacagtttgaagtgacccctatatggattgtttgcacacctgtgttgcaaatgtattagttaggataggctgagctacagtaagaaatagcccccaaaatgcattatagctgaaacccccaaagggggatttctaacacagaaagcaacataagtgggtagtcctggccaatggcagctacgttccacaaagtgactcagggatccaggctgcagccacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgaggatacacacagttttctccccattagcatctccagtctctggtataaacttgagtcttctctttggtccctgataaatatacatagaatgtatggatgtgagaaagttaaactgatgtctgtgtgtcttcatgtcattaaactttgaatctacggacatgtctttttctttctggcatagtttggaggtcttcattttgtgattgaatacaaaacaccgagggctttaaggaggcatagtggtatgttcagctgtattttctcataatatagagtcataggaaacctgagccttggcatttgtaaggcgaaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactcagtgcacaagtccttctgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttgttcttttacaaaaagggtcagcagactttctgaaaagggacagatagtaaatattttaggctttgtggaccatagggcctgtgtcaaaagtactaaatgttaccattttccttactttgttcaggctgctataacagataccataaactaggtagcttataaataacagaaatgtaattcttaaagttctggagcctgggaagtccaagagcaaagcaacggcagattcagcttctgttgagggctcgttccctggctcatagatgatgacttcttgctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagctcactacagcttcaacctcctgggatcaagcagtcttcttgccttagccacccgagtagctggatgacaggtgagcaccaccatgcctggctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgggatgtgcctacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaatcagtctactgtgctaaacctggccctgcctcagcaatattctgtgagcctggaggtcaagagttaggggaccaaggtcctgctaaggacacatgggggaactaccagaaactcatcatctcatttaaactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacataaaaaccgattacaacatttttccatttttatgtttcctctgaaaccagccatgagaggtactgttagcaaatcacgccttattcctaggcagacttcttgggtacactttccaccctccccagcagtaatgcctgaccaactaatggaatcctaactaatgcagtatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttccattgtatttgagccactggaaatctattacctgatctttctttaccagatccttctttagttgggtatggccaggctcagtgaatccagtagatgtttgaatgggaaaggactgaaagatctcaaccttgaatcccttaactccttgggatgtgtaatggagatgtataagctgtttttaaacatttcagcagctgtcatggaacttaaccaaatgagtctaagtaccctatgaacacatttgatttaggttggaattacagcatagatgtgaagtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgacgctggtgcctaacttctagttccagacaaagaaggagagagagagagatcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctatccgttaacaggtttatttcttcatcagatattaattccagagggtttcacccattataaaatggacataaagcctggggtggtgatggtgctgcctctgtaaccaggctcagctgtgtgtcttcgtgagcctccttgtggaccctcaaatgtgggaaggagataggggcaggaggaattggggaaataggaaccttagaaaccctgaagaagtggaaagagaaaaggaaggtcagtcattcattcaattgcttaatttgcttctttctttttctcttcttctttctctctcttctctctctctttctccctccctccctccatttcttcattcctttcttgtctccctgtctatctgtctgtgtatatctattcatctatccatccatccatccattcatcaatccatttatccactctgaatagaaacctaatatagatatacaaaatgaaaaactaggaaaatgcaagaaaccttgacaaaattgctactgtttctaattccaatacttaataataaccactgctacatacaaggacatttgtgtctggtctttttccctattccaggcacatgcattttaatacagttgagatcatattgtatgtctgattttttagcgtattagattttttacattattaagttaatacatgctcatttaaataagtcaaacaatatgaatatataagaagaaaacgctcgtaatttatgctctacctcttccctttgctaagtggcaattttggaccttctgtgaccgtgcaaacatgcagattatacatgcactataggagtggaatgtatgtgacttaatagcgtaatattttgtccattattttaaaacttgctttatttggtcaagacatacggaacacgtatagatcaaacaaaaatttttaaaaatgcttgcatactgctctgtgctgtggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattttgtatcctgtggttttacttaacactatgcagaacgatttcctcgtattgttgaaaactcttggtaggggttttttttttaattggctggaagcacttcatcatatagttgtaccaaagtttgcttaacatcccccttattactcagcctttgggtggtatccagttctttgctttgataaataatgctgagatgaacatctttctgcatggctctttttccttcttttgacatacttggagttctagaagtggaattactgggtcggaggtcacaaatggagaggtcttttaaatctcagcctgcaaacaatcccactgcaggtttaggctgcatgtttcatccatttgcagctgtagcattttacaaaccacagcataaaccctaggaataattctgttccccactgggatagagcattgttattaatataattttacaaacatcattcgtttgaaagctttatccagcctcaccacagctcattagtgaaccttctgacaatcccggggcagtttgtggattctgcagcagacaggttatcgtgtgctgaagggtaccgcaaggggaaccttccaacatccccaccctacccaaaggatgattcctgctcacaccagccagctggagacattagagcattacttctcggtggcaagggagggactcttgttctttctggtggttcgttttcatcttcaggtcatgccctgtgtcacctgactcaggcaccattagcatctggggctgtacacgtctttgtactgcacactgtagggtatccaggattcctggccctgccccatgatataccagcgccatgttgtcatcaaaacgaccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatatcagggtgtttaaaagccaagattctggagtcagaaggcctgggttcaaatcctgacccctcctcttgcaagcttgtgacaccgggcaagttattaacctctttatgcctttattttactataaatatgggataattatagtttttactgcatagttttgttatgaggagtaaatgagtcactatttctgagacacttcgtgcctggcacagaacgagcactgtgtgtgtgttacagaaatatatgtgggtgggtgtgtttctgttttccgtaattccagctaggcaaagacatatttaacaaaagccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctgccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagccttgcccactgtctgtggctgaccagctagactcttttccttttcttgcaaacctaatgtaggtacaaggtcaaggctccctgtgaggcttgcatagcaccttcaaccttctagtctttgtcctcccagaaggaaaaaaatgagaggagggagggacacaagaaaagaagatgcattttgtcagccaccgtgctatgaaatgctagcgcagatgacgttcagaactgccctgtgagcagacataaaagcttaggctcaaagagattaaatgtcttatttctgcttttggaagatacacattttatttttttctgtgtctctgaattggcatccaaccataatcattgtgctaatttactgtattcttactctccctctccagtgctgtgagtaaatcagtgtgttccttatacttaataacatactaagtggcaataataattattataacaaatgtatcaaataactatgtgtgaactctgcatgtttcagcccatttaatacccattacctacggaggtggtttctactattgcacccactctacagatgagaaaatggaggcacaaaaagttaaatcatctgccctaggtcccagagctggaatttgaaccaaaggttctgtgcctcccaaatttgtattcttatctctgcatcacactaacactgtcactcagtccttttctcactgctctggtctctatacttagagcttcgagacctgccactcagatgactccagaagaaaacacgctttggtgtcgtgcttgcctttgcccttgtcactttctcaactctcctcacctctgtgactgcatctttataactctcctttattagtgcttttgctggaggaggcaagcatgaacattgtcaaaaggactcaaaatggggaaaagtggcagcaattgccagcacaatcactgaaaaatcttctgaatggattgtaaattaaaccctcccccaaatgctcagaactgttgaattgactaattcaaattcattgagtcagatgcagttagtgtaacagtctatagtaacagtgtagactattagtttgtagagtccacacagaagagtccaattttctttgcacaaagagcctaccattcatttattcaacaaatgcttttgaacacccatcactgtgacagacagtggcaatgcatgtaggaacaaagtgtgtccatgggggcagagacctggaataatcagtcaccatgtaaggaaattcaccagaccaccaatttccacgccttgtatgtttctgttgtctttgctgcagactgaccaaaagcacaagacaaactcttgtccacttggattttagcatctttccctgaccctgcctctgactctggtgttgtgcacccactctgcaactctccaagctccagccctgtagtgccagcctgtacctgcctctcctgagggtcaatatggcatccagccttggtgaagtctcccaccccgtggtgattcatatctgaccctgagaattttccacctttcccagaagagtgggagtctaggaagacaaatagccaagataggagtttgaagaggaggcaccaatggcaatttgggttgttaattcctccagctaatttagttctgatttccccatgctcttggcagtgagacagttggctccagaggaaggtgataaaaaggaatcagtcaaggaacaatcaagaacgtgttacttttttggataatcattggctgtagggattctcctttacattttaaagagggatgaggttgagtctgtccctagcactgacaatgaaacatttatgctgtttataaaaatcaggaaacacacaaataatttgattaacgctcaccttctggtccttttgtgatttgagaggtcttgagataagaaaaactgtggatgaattttactgaactattgaattgagaatggctgagggggagaggccccttccctctgtgaaatatagggaaaagttgtttttcttttctcctagtttcagaatacttggacttacagtcccaaatagcatcatttcctggtgaagccccctgaaccagacaggaaactgcctctcttcaataagagcagaggcagtctcaataaaaaacaaaatttcaacccatcctccgctttggtggcaggcagttcatcttctcacctctacttatttacagtttgaggggaaaaaagaggtaatacttgaaagtgtatttgaccatattttctaactgggagacaatttttttctttaacaattacttttggacatattacttgttagttaaaggagatgtgacacctcctgcccccctggccagccaagatccatttgtcatccaggtagcctcagaacggattgagagctcgccgcacagatctcatgtcaaagacaggcgcgtctgtctttcacggcttgggttgtcaggatgcagggagggccttttgtcaaacacctgccgatgagcgtttggcagagcctgtgctaagacatcatagatttccttctgtgttgtcttgagagcagagaaggtggcaggttaaagggaatcaggaaagaaatgagagtgaggataaacgagagggtgtggttctcagggtagaatgcatcggacactgcctagtgtgagaagggactcatctgttttctaggaagtactataaaaaagataaatttagtgctcagatatctgaggcctgatattaggaaaaatacggtaaggcatacatttagaacagatgccatgtctgtgtgtgtgtgtgtgtgcatgcgtgtgtgtgtgtgtgtattattaatatgtctgctggccttgagaaggtacattcagagaattttctgaagtctttttcacatggcctgtattgtcaaaaaatgatgttgggtgttttctgcctgtggctgtgggcctctgtgttcacacagatggtcatatgttcctaaaggatacatccaggactgtgctgacttatttggggtggctgagaagagacatgagccagatgataacaggaataattcagtgtgtgcttcccatggctgctgtaacaaactgcacagcctagagggcttcaaacaacaggaatattatctcacagtcctagaagccagacgtctgagaccacagtgtggacagggccatgctccttctctagagaactctccttgctcctctcgcttccggtggttcagtggcaacgcttggtgtttcctggcttgcagctgcaactatctgacctctgcgtctgtcctcccacggccttctccctgtgtgtttctggatctcttctcctttgttatcaggacactggtcacattggattaagggcctaccctattccagtctgactgcatcttaactgtttaactctgtattccaatctaattacatgtctatttccaagtaacgtcacattctgaggcaatggcggttgggacttgaacatatattcttcgggacatgattcaacctataacaagtaatactagtaatcatctcactcctgtaaacagtacagttgccatacctcaagtatctagtatacttgggacattagtctgggaatttttctccaatcctcacgctagcatttctagtaatgaggaaactgggggtcagggaagcttagtccacatttctcaccttttctccttttctcccatcccccagccagtttttcaacatattggtttttcaccacatgctcactgcagtgaatgttcactcccaagcccaaaagtagacatgtggagtgacaggtgtcactatatcataatatgaagaatttcaaaagccagaagtgcttgagaaaatataaattgtgcagtaaaagaaaacaccctaaatgtgcagagcaggaagtagaatgactctttgggtattgtgtttgttaggggggtcattagaaaatcatagacactgagccgaaccccctgggttcaaatcccagctccaccacttacgaattgaatgactttgagaaagttacttaaatgctgcgtacttcattttcctcccctgtaaaacgggttaatatcagcacttatcacatagtttttgagaaagctaaacgtgcttatctatagtggttattattactagaaagaatatcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacaccgcacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcctggctaatttttgtatttttagtagagatggggtttcactatgttggccaggctggtctcgaactcctgggctcaagcaatgcactggccttggcctcccacattgctgggattacaggcgtgagccaccatgcctggccccctttcacttgtattttttgagaagagaaagaaagaattatgaatgaattcttctgagctgtgagtccttcctgtgcaccaggcatggatggcaaggcacgattgataatgttccctcttatctcgaaatgtccactctctctcccatgcacggggagtcaagctgtgctcttcaaacacaaattccttctcccacttcctgggtagttatgctcttttcttccctgaggttgctaattgtgggcagtacagtgtagagtcactttgatttttctcatctccttcctggaatgtgccacagaagaaaacccacgaagtcttgagctaaacgaagcagagatgggagaagggacaaggtgggaggcggtagtggtgctgcatgggataaaaatggaaacacacacttttgccctctgtacccaaaaggaaatgtcggtggaggcaggcgttcaagctggcctcgtgtttgtggttttagacacagctttgagtcgtgaccggtgtggccaagacctatttcccttgcaaatgctctctctcttttttcggtaactgtgttactaaagttctcttagatactttacatttcctttcacggatttccaaaatttctttctttgagaatgtcaggaccagtaggaggttcagcacgcattgccagagaaatcacagatgactaattggaatgcctcagaatcattctccttttgtttcacctaatttccacacttacgaagtcaaactctcagttaaatgtttatctagcaattcatttcttctgagccatctgttgctaggcaggatctgcagacctcttggttgcatgtgctgggttgggtcctccaagtctcttagcacaaagtcctgatgtttaaatcctgcaagcgaattgccacctttatttccaagttctcctcgaaatccacattcttccctacagacaacggtggggttcagtgtttgcttttcctggggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaacttgtctgctagaaacctagggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacgcagttgttacctgctcccggtgggaggggggggatatttatttggcatcttgcaattgataggagctgagtgattttagtaggtagtttaactccttaaaaacttccagtggtttcatattctacctagttttaggtgacagctggtatggggtggggaaggggggggggataaagatattaatttggaagcatttgattgctccattattttatcatcttcccatggaaatgttttcataacgccttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcgtaggtctctgaaaattcagacccacagaggccttaccccgctacagagaggccccaagagagaggcctcacaccctctggctccactgaaattcacttcacgtttccaacttggattaaactggcacgacagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagttttattggaacacagccaggtgcatttgtttacctattgtctatggctgcttttgcactacagtagcaaagttgagtacttataaatgtagagcctgcaaagtctaaaatatttactatctgcccttttgcaggtaaatttgaggactcttgagttagacagctaattagttggtgttacctaaattttgtgaattgtggctaaatctctcatttgtctacacattcaaataaaatcatgtatcaaaggtgatgtgtgtataataagatgctgggaagatgagcaaagcatgacttcttttttttgttgtttgtttgtttttaagagacggggtctcgctctgttgcagtgtcgcccaggctggagtgcagtggcacaaccttggctcagtgcagcctccgcctctcgggttcaagcgattcttctgcctcagcttcccgagtagctgggactacaggcacctgccaccacacctggctaattttttttgtattttagcagagacagggtttcaccgtgttgcccaggctggtctcgaactcctgagctcaggcagtctgcccgcctctgcctcccaaagtgctgggatcacaggcgtgagccaccgcgcccagcccatgacttctcttcatgggagagaaaggccaccgagatagtaagtggacatcaggacatggattctattaaatctaacacctttatctttgcatttccatacattttgcttatttcaaagtagctacaactgcacaaagaatgggctgtcctctcctgctactttataaaagccaagtttttgcttctagctggtcgaaggtcctgtgggagctcacgtttttctcaatcactgatgaccatttgagacataatttggagaaggtttctatcaaatcctagttggactgcagtgaaatgttttcaaactagagaagcaccaaataggccatgataaagaataaataccacctaccccaacctggcaaatgtgtgctcacccaaaagtagtggagcctcaagctcagggagatgtgactggaaaatccactgaataaatgtctatttaaaaaaatcatagcgtctaggggatatacacttctaagcccattcttcaatggagaattacttatgcgcataagtagtttaaacaaaattagtggaaaaacagggagtttaagggagcaagagatcaggtcttctgggctcaccacacatcaggtgatttaagctaaaaatggcttaaaataccgcaatcacttgaaacgccttacataaactgaccaggaatctggggcattcgcgttagagacaattttcttctcctcaagataagggatggggaattagtcatagggtatttccagataatgtagttaacacctcgtgtaatattaggtgggcagggagctctgctctcaggaccaaaattgctcctgccagctctaatagggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattggtcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacgcatcccttttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcgttttactccttgtctcacattcctttctgctacttctctttggctcaccaaaaggagacagaagtttgtgtccatggctgtgaactgccaaagagttgccaattctctacgatctttgacctctgtgatcccaggggcaaggccagcactttccattccattagacttcattctcttgtgggtgctttctgctggaatctcccaatacagaacagaaagcacaggttatggaatcagatagaccaaagttcatctccaaatttgattccctctgcatacaagttgcttacccttgggggccctgtaaaatgaccataatagtaagcacctctgaggctcactggaagaactctttgttgtctgcacagaagatctcagcactaagcctggaacagaggagacttcagtcgatgtagggcatctccccaaactgcttttattctttatgcctcactgaaacttgaatcaaaaagcggctggaggaaaaagagctttgccaccgggcagtactgctgggtcttgcgtcacagagatgccttctgctcccttcttcagggagacctcagggtatgaaagtgctgcttacccagcagatgagatttagtccagtcatccatctgcgtggtctctgtggataaagtaagcgtttcattcaacttttaaaaatattgcaaattgaccctcgcacatcttttcttactgccggtcacctagccagcaaagaccccaggtgagatcccactggtttggaggaaggagaggaaagtccccacttgggcaaaaacaatttaggatacctgaagattgcaaagcccagctcctcacaaagggggtggcagctggggagaagctgaatcagtagacagacaagattgtggtttaacgagttcagggacaagagaaggccccagtaacctacagaagcaactagctccttgccttctgtacaacatggcctttggagtcacaggacgtgagtttggatcccagctctgccacttagtaattgtgtagatttgcacatgttgctggacctctctttgtctcagttttctgtaaactggggaaaatcttagtaaatctagctaacgtggttgttatgaagattctgtgtgtgtgtgtctgtgtgtgtgtatgtgtacaaagaaagtttagagcagcgtgtggcacgtaatgcatattatgtaagtgtagctccaatgtgagttgttacttgtagagaacagctatgtcaaaaccacaccaaaaacgatttggaaaggaaataatttgactggtcattttgtttatccatcaactgagttggattgatatatttttcctttggccttcaaaggaaatttgagcattcattcattcatccttttagagaaatattctctaagcacctaccgtgcgccaagctttgggttggatacctggaacccctctcagtgagatcacagtctaacagcacacacccaactatgaaatatagatggactgtgaagatgaagaaaggttctggttatgaactcacagaggaagtgacggctgaactttgtaaggacacaagtggtttaacaagtttcctggcccatatgagatctcggctccgacgttacaggcagcagtgtggggcctcaccttaccttttcccacttccatccttctccacccccgttcagttcccaggctccccttgtgtgaactggctcatttctcactgcctttctgttctacagcccccgctctgctgagtcaggaggtgctactttctccatctgctttccatcgtccaaaatttttgttgatgtttcttgatcactgagttaaataatttttccccgtattatacattcagtagagtttctggagagagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagaggagaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctcctggagtgcgtgttgctttggtagggagctcgctttggctgtgggcagttcctgaggagggactcataggacagcctagcatctgaggaaatgagtgcctcctggcccagaatgggggatctcagcagcacactacaatatccactacagtttcttgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtgaggaattatagttgaaaggggaaagaacatttcagtttttcatttcctgcgtcactgtttttcttatttggagatgctgttcctctcaagtgggaaaaatttggttatctcaggtggtaaagatgcctttgtttaaaatattcttctgttagtggggacaataatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagatttcacaatgagagaccaagttgaaaaatgcttaaaattcacaagtctatatcattctgtcctccaggtaccccaagctggtttgggtttataccagtttgaaccgagggaccttcagctgaggaacatgtgctctgtgtgctggaagctcctggaggccccagggttatctctgctcacttaggtttgtgatgttgggcaaaaggagaaaatgctgagtctattcggacccaacttccattaatgcctgagaaataatttaaatcgcaagatttccaatcccataagcagccctagcctctcttctcctgatactccacatacccagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcggtgtcaccctgagcatctttcaattccttgaacttcagtctcctcatctctgaaatggggttattatctacctgcagaggtgctgcagtattaactgaggcaacgttgcaccgtttctagaatgatatttagggctcatattgacccagtaggaagtatagttaccttgggccaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttgtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcaattggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagagagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctaactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttggcctcccaaagtgttgagatcacaggtgtgagccatggtgccaggcctctcctgtctttaactggggataatgtgtgcagaattccccctaaaggatctatcatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctctcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactggcaagtgcctctgtgctgatattgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaaccacatgaaggttatattattatgtcgactttccagatgaggagactgaggctcagtggcttgtcataggtgtcaaagacaggagtccagtgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttcttttctttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaaccttgacaatgtaatttgtcagaggaaggcagcctgttttataagctcaggtgatttcatttttgttcacctgtttatttcatgacacttgcaggaaaaagaggaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgccttttttttaataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttgctgggagaaggtcagagctggagtggggcactcgattccggcaagagaaggcaaacaaaagaagccacaacagtctaggaagaaatctttaatttctattcagctttaaagagtttgagagcgttttttcccctctgttaacaaacgagttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttgaaaaagacatacctttgtaactttctatgctaaggtgttgcataatcaaggttaatttttgtttgtttctagtctatgggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaacagcttgtttgtggttcgtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagctggaaaatttcagtgacatgccatcagatttgttccatgtagaaggacgacactatcagttagatgcttattttgttggcaaatttctatggcacttctgcttggccacttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataacagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgacagcgtaccaaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgcaaacaggaaaggccacaggacagctcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtccccagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcatgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacatgcgtgggaactgataagatgggggttgtgtccacttcacttgtatgggatgtcggtgctttgaaaaaattctatcatcaaagagtaggtttcttagttctgcaaatctggcacctggagatggcattttgaatcggacgacctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagagctctgtgagggttaggcaacaatgcttacaaagctctccatgcagagcctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttggttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtagacggccatctattccacctgtgacatgagggctcaccccctcatctccaccgcagcagctctctgataaatgtagctctctgataaatgattctgttcctagtggtgtattcacagagtcagtggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgcttttttttttctttaccatatattgtttatcagaaacctctgtaccctttcctttaaaggagtcaatattcatttgtattctgtgctgacaactataaattgatggctagcagttatcaaatgaatgttgatgaaaagcagctacttaacattttcatcccaacaccgagttttggaaggatggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattctactgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtattgcttcagatattttataacggagttgttaacattatttcctttagatggctccttcatcttttctgcattatgaactgatgccccaaaaggtggtatgaatgaaagtcatctgatggtgattaaagtgctctttaaatttttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtgtgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcatagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattagacttgagccacacaaatcaatgggaaaagaaacagctgaatccaggataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacaacaatgacaacaacaaacccaagtctgccttatggcacattcttcacgtcgtaacaccttccttgggaccctatttctcagtatggacctgactctcccagggatcctagaatgcaagcatagtgattgcaaaccagaccatttgagggaaactcctctagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttaattatggcttgcaaagcaaagtgatttcttgccctctttatagcatccctgacagtattctgtcagtttggatgatatgatgcctcatcactgcacacgtccctagccacagccccaactgttactcaaaaggtgaatgaaagtgatcagctgcactctttgcaacttacattttgaagtgggctgggaggaaatgtacccccttacctgtggtcccattgtaaatctgggtcaaatatgacatttagaaaaaggttttcatgggatctggatgaattaatgtgttatgtgtttgtgctaagtatgaatgtatggtgaggagtgtgtgtgtgtgtgtgtgtgtgcattaaatgttttaacacaacattgccaacccttcccctagcagcaccgtgggcaaagcataaagggatgatctggcagcagccccacttgggttttctacctgatggaccacaattaagagtggttggtttgtcagacagaaggttctacaaacgatttggtatcgaattacattatacatggagaagtcgaggggttggatgaatttgttcttgcacgttcagaaggataccatctttttctctgtgtggaagaggcgcctgccacgacgtattgatatgtgtatttattttccaagcctgtccctgtatgaggtgtcaaaagttacaccagctttacaagcggagtttatgaactcgtttttccaggatagtcacattatactttttacagtcatgtgctttcagcccagtaccctttgctatgccaagatccagctgaaactgaaccaggtgggggaggcctgctaatgcccaggcagtcgaaatgacgccatctcatcactccttctcttaaaatttttttttgtctttcttcttggatttccagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcattcacaacagagtgaaaaatcttaagtaccaatgggaagcagggaattcctggggtaaagtatcacttttctggggctgggctaggcataggtctctttgctttctggtggtggcctgtttgaaagtaaaaacctggttggcgtgtaggttccgtatctccctggagaagcaccagcaattctctttcttttactgttatagaatagcctgaggtcccctcgtcccatccagctaccaccacggccaccactgcagccaggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatacaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctacgcttaataaaagaacatgcttgaatatcatcacctgaagtttgtattgtttctttaaatgtttgtttcagtttgtttttgtttttcattttttagaaaagaaatctagaggaaaaataaagcgcttctaataaagcgcttctcgtagatgccaggaaaacacgattcttgtttcttctctgagtgagtttgtgttttgtttttgtgctttgtggctgtccgtgggccaagttgtctcacgcgattagcatgccagcatattttctgttaaagaaagaaagaaaaaagaaaaatgactattgtttcatttcaccttaagatgttttgttattacttacttacagtgagttattttagtcctcaatggtctgctcccctgcaattagcaagtacttagtgattgattagcgggtatctctatgtttgagaatgggagctgtgcagaagctcttatctgcgcatcccatctcatggacaccatgctttccagcccgttccagcaagcacatgagaaagtccactctggcaagacggagaaaatgcttctgctgaaataccaggaaggtgtggaggctgggtgtcattgttccccctcctgatcatggcagcttcaggccagacaatgtcttgaacttctgtgcctctgcatctgtggtgcagagcagtcgaacaaacaaacaccattgccctccagtggcccatagccttgccacatcctcccatctggctatagtcttccttacgtaatccttattatcacaggacctttgaaactatgaatcagataatgtcacttttcagacattattgtcatttgcaaaagcagccgtcagaactccactctcagaatctacacctggaggggatcacccctcccatatgacctctgactttggccatgtgactggccttggccaatttggaaagtgctttgcactggggcttgcctttccttgttgatctttggaaccctgcaacttccatcatagggaacggctcctgggctagcctgctggatgatgagagacacgtagtcactcccagaaccggcatccagcagttacttagttagacatgtaagtgaggccatcccagactatccagccccagctgtgccaattcagaggagaagaaactgcacatttcactcacagcactgcaaaaagatagtaaaagtttattttaagccactaagtttcaggattacatgttactcagcaaaagctaactgatacagcttctcagctcactaaggttaatttttttctaccctacttctcttataatttggtctccagctacctctctaatctcaacttccagcactttatccactagaagccactctagtcttcctctgttcctcgaacatgccaagcacactcccaactcaaggggtgcatatttgctgtttcctctgctgaaatgctttccttccagaaaccagcatgcctttcttcctcactgatttttagtctctgctcacgttatccctgtcttcatggtgtcaccccattcttattccccttcccctctattttttctccacaacacttaatattattgtacacattatgtgtctattttttctgtctacccactataagaaactccatgaaatttgtctgttttcttcacaacttggccacagtaccttgaactgctcctgtcacacagcaaacttactgacttaataaataaccactgaaagaatgattctgggtgactaggctttatgttcaggaaaataatttccatcattgtgacaatgatcccgagccacacactgtgctaagcaggctacattaccactgtcgcccgggctgcagtgcaatggcatgatctcagctcactgcaacctccacctcccaggttcacgcgattctcctgcctcagcctaccaaatagctgggattacaggtacacaccaccacacctggctaatttttcatattttaagtagagacggggtttcactatgttggccaggctggtcttgaactcctgaccttgtgatctgccctcctcagcctcccaaagtgctgggattacaggtgtgagccactgtgcctggctttttttttttttttttttttttttttgagacagaatctcactctgttgcccagtctagagtgcagtggcgtgattttggctcactgcaacctccctccccggttcaagcgattctcctgccccatccttcagagtagctgggattacaggtgcccacaaccacacctggctaatctttgtattttcagtcgagatgggtttgaccatgttggccaggctggtctcgaactcctgacctcaggtgatccacccacctcagccccccaaagtgctgggattacaggtgtgagctaccatgcttggctattacatctgatttctaatatgactacagtcttgccagttcaccccttctccccattttactgatgaaaaagctgaggccaagaagtgtcaatctgctgttgtccatacagctcataaattgatagagctgcagttcacacccaggagtgtttgatttcaaggtcatgcagattgcctgcaccagtgccactgctccttccataagttgactatatccattctggtaggatgcaccatcttttttccttttaaacagagatggggtcttgctatgttgaccaggctagtctggaactcctggccttaagcaatcctcccattacaggcatgaaccactgtgcctggccatggatgcaccatcttaaaatcttaggctgatcagagaggtgactttatgggtctgactctagttatgcttcaagcatttggtggaaatgaaagtaaagccaggagaaagaagatattggcgtatcatcagccaaggtgctgtgcaaaatgtcaaagagaaccaagagaggacatgctggcctcctgcctcctggccgtgtctagggcctctatgctgacttcctcctctgtggatcctgcagggttcacatctgcaggctgacaagatgaggcctgggggagctttctaagggtagctgaggattctcccaaatcaagatttccaagtcatatagaccaaggcttcatacattcattcatttaacaaacataccaagtgctacatcctggaaattcaaggtttaaagtaaacccctccacagcctctgctataaaggaatttacatcttgggtctgtaggagtcctcacaaagcacaacgtcctactccactttatcagaagttatctaggttacttgaagatgaactgaggccccgtaacagtagcgattgccccctcatgcccatttctccctgaacccactcagtcagacactgtcagtccccatgggccattttctcttgccagacacatcaatcttatttccttggctatttctgtgataaattcttgacaggtgagcaagtgcatggcataattcctattattcctattttagcttattctatggccaaccctatttctccccatttgtcatatgtgcacatctgtatatgtatatgtcatgcacatctgtatatgtatgtcgtgcacgtgtatatgtatatatgtcgtgcacatctgtatatgtatacgtgtcatgtgcacatctatatgtgtatatgtacatgtatgcatgcacaaatatgtgtgccatacatgtaaaacacaggcattatagatgtataacacatatatgtggcacatgtgcatatgcacatatatgtattgcatatatatgtgtatattcacatatatgtatacagatgatccctaactcatgatggtttgacttatgatttttgaactttacgatgatgtaaaagtgatattcagtagaaactgtgcttagagtacccatatgactattgtttcttcctttcagtatagcattcaataaattacatgagacattcaaccctctaataaatcaggctaagtgttaaatggttgtgttaaatgcctttgtccaactctaggtaaacttaagttttctgaacacattaaaggtaggctgggctatgctatgatgttcaatacattaggtgtattaaatgcatttttgacttatattttcaacttactatgggtttagacggtaaccccatagtaagttgaggagcctctgtgtacatatatgtgtgtatttgtagtatatgatttatgtaataatgatcctactctatctgctacttttttttttttttttgagatggagtctcgctctgtcacccaggctggagtgcagcggcacgatctttgctcactgccacagccacctccggggttcaagagattctcctgcctcagcctcctgaatagctggaattacaggcacccgccaccatgcctggctaatttttgtgtttttagtagagatagggttttgccatgttggccaggctggtctcgaactcctgccctaaagtgatccaactgcctcagcctcccagagtgctgggattacaggcatgagccatcgcacccggtgtcatctgctacttctaatttcagatgctatttactgagcatactctgtgccagttgatgggttaggcaaatcactttatgctcataggatgaaagtgagttttagagagaaagtaacctctccacagtctcatagctggtagacagcagagtcaggatgtgaagccagctccatctgccttgaagcccatgggccttccactacacactacttttatgtgtggcctatagactagaagcatatatacattacattcatacaatgggtgaattatctgcaagggaagaccagttgatttcctatttaagaatgagctctggctcttctcctgataccgaaatgtccagtataaaccttacaaatcatttttgtacatgccatttatccagcaatattggcttcagccttgcctacatttctcaataggccctctctcctgttctgactgtaagttggtctgcaccttctcatggactcaacatcccgagttcttcgcgctcatctgatgctacagaatccacccaaacaggaagagtaggccagtttctctgcagtcgttttcttccaagtccctctctctccctaagtttctttcaactccaaaggtggccagtttccactttcacacctgattaagggagaccttgctgcaacttatcaataggaaacaagaaattgaagcattccccagcaatgactgaaggctgtggcttgtggttttgctttttaaaatggggttatgagtggttttgttttgaactccagtgaaggaggcctgatgacgttcatcaaggtcaacactaggccagaaagacttggcttgcaatatcactgcccattctgttcaccagcaggcaccatttttagaagcttatgtaaaaaaaaaaaaaaaaaaaaaaaaaaaaatctaaaatagcaataccctgtctattaactctttgtgtctttcaatatatccaagctagtttagctgaggtcactttagaatactaagtaatatcacaaattattattcatataatcactgaacaaacagctctgagttgtatctatagatgttatgttattgcctttcaaggattcatggtatttggcttcatgccccccctttttttcccttcccccctcaaagtcatcttatttctcaaagttttccattattttaatggctacctcatatatcacataggtgatgggccattatttggaaacccattcccctactgtgggacatttaggttatttctagtttctgttagaactaatggttcaattagcatctttatgcatacagctttttccttctattaattgatctcctcagcatacctttgtagagcgtagaactggagttccttgatccaacagctcctactggcctttgccacagagagccacaatgctatctggaagggttacacaggcagaaccagcatattactgtttgtttacaaccttatcaacacagggtgttcccactgataacattttaaactgattttcacattgtcacaacctgtaactatttatatatggtattcccaagcagccagcctccttatttaaagtataagcattctgtctttcattttcccacaggacagagttcacatgtttaattagagtggaaattcagagtgagtctacattcagtttgggcagaaaaataccagtccatccaagctactgcactgttactagattattgcaccagtgaagagcctaccttttttccttttcaatctccagttgtagcactacacagattccatctgaatgcagtgcaaagcccaaaactcacaccccaagcctctgtggttcatactggcttaggtatttaccccactagccaggattccttagctggttacttcttcccagctgatgcaccgtctgcttttataaacatgtgccacagcacttagaaagaactgtcttgcctctaagctgatctgtttacaaggccatgccctgctgaatcttaggcgtgagagaataaaagctccttttaattttcaaaacagagttacgcaaatagaggctctccatggctcattcagatgagggaggctctgtgtcttcttccggctttcctgattttatctgatgttcaccaagagcttgtcctgttactttggaattgtgacaatgtctcatctgatgctgggcattccctgagggacagtccacttttataaagcaccatttcccgagtgcttaccaaaacgcctatctgaaattctgtctttgttcatttaagactcacagcttttgtacaaaaaattagccaggcaaggtggcgggcgcctgtagtcccagctactccggaggctgaggcaggagaatggcgtgaacccggggggcggagcctaaagtgagcggacatcgcgccactgcactccagcctgggcgacagcgagactctgcctcaaaaaaaaaaaaaaaaaaaaaaaagactcacagcttttgaagtgaatgttactgtccccttttcaccaatgagcaaaccatttgaatcgtggggtcaccacttcctgtgtgacgctgtgccaccattgtacgtctccactccaaggccatttgtctctgaccccgttccctactgtcactctgcgtctgtgatctcctgtacctcagacttcattcctaccgtgctttattttcaatgtaggacttgtttaggcttctctaagctgaacaagtgggaattccattggtaatttacctgaatgtggctttatgtttatatcctttcaatatgatttgtgatattggttatataaaaagttgtatcatcgtatttaaatagagttaatcttggaaataactggtaactaatgttctgttaaacaaaatgtactgctgtttttattaaaaaattaaaattctttgggaggccaaggtgggcagatcacctgaggtcaggagttcaagaccagcctagccaacatggtggaaccctgtctctactaaaaatacaaaaattagccgggtgtggtggtgggcacctgtagtcccagttactcgggaggctgaggcaggagaattgcttgagcccaggaggtggaagctgctgtgagctcagatggtgccaatgcactccagcctgggcaacagagtgagactccatctcaaaaaaaaaaaaaaaaaaaaaaaattaaagttaaaatgcatgcccagcatttaagtttggggggcaggatcagaaaaacacatgtgcccatagtcccaccactcaaaagaaccaactagtgtaaatactgtggtacattttttatgcattagaaaatttgcatgtatcttgtagttttcattttatatagttgtgattatattccatatacaccttgatatatttcaaactaagtaaattattttaaaataatttaatgcctttatgatcctgtatctagcgaacagatagatatatggtagttacttaatcatttttttattcttggagagttaaaatttctaccctttaccaccaccatgtttcattaatataaatcgtggtttagtaaatatatttgtgtaagatttgggggaactctttattttcttaacatcagttccaaggagaatgctggggtcaaacaacatgaaaatatttaaggctctgggtagttactggcaagatactttttctgtgctgcctacacagatggcttttatctctgctgctggttttctttgagaagagtaggtatgtttcacccaggtggatatgctgctgatcagtttattttccccagatgacctgcctgtctggcatgcagcactgttaaccttaccgggagatgccattaaagttcctgggtatgcaactctctttcccgtctggaaccaagacagaagaggacaggagcattgtgtcagcgaaataaaaaaaggctgaatgcggaaagcagaaagaaacaagctaaactttgggtcagctcgttttgccagccttttgatagtgttcattgttctgctgcttcagaacctactgagaaagttcgaagactttcttgactgcgttgggaaatgttcagaattctttgcctggtttgctaagacagagcttgcccttaaacttggttccggggaattttacctggtgtggcctagatttgaaggactttatgatgaagtacttggctttgtgctcttcttattattggctgccttcaaacccactttagggagagaggctgagcagatcctccctgggaaaaaattcagtcatgttaccgttttctgaacaagaatccagaaccttccagaagcctgtgtaaatcactctatgtgttcccaaagcattcacagctcagcactttcaaaatataggagcagaagacatgaaaaaaatgaacactcatacatctatatctcatgttcaatctgaatagcaaatattaatagtaaaaaccactgtttaaagtattaaaatcactatgatccttattaataatacaaaacagagcttcttaatccagaaattcaaattctagcagttaatcctaaaacaaggcaatcttcatcatctggacagctgataagagtgtatgtgattatgtgtgtgtacatgtgcatgagtgtatgtgattgtgtatgtgtgtgtgtgcacgtgtgtacgtatacgtgattgtgtgtgtatgtgtgtgtgtgcatgtatgtgtagatatcaggagtttcagaattcaaaaaccgcatgaacagactaatagatctgtgaagttctgttattaaaaacaatttaattatgtttaaccctaatcctttgaacacaggccactgctttgtttttgtctttgattttttttcattagctatttgttaatacacttccctgggacacagacagagaaacgtttttcttaaagcagtaaaaataatatcatgagaaaccggagatcaatttaaatgtctaacagttggggcgaagctctctgactaccatgaaataacgttgtgggagaaatttaatagaaatgatgtttaagactaacagcagatctctgggcagaaaccctaaaagccagaagacctacaagccagaagagaaagggggccaattttcaacattattaaagaaaagaattttcaacccaggatttcatatccagccaaactgagtttcataagcgaaggagaaataaaattctttacagacaagcaaattctgagcgattttatcaccaccaggcctgtcttacaagagctcctgaagaaagcactaaacatggaaaggaacaactgataccagccactgcaaaaagataccaaattgtaaagaccatcaacactatgaagaaactgcatcaactaatgggcaaagtaactagctagcatcataatgacaggatcaaattcacacataacaaccctaaaacttaaagtataataataaaaaaaagaaaacaatattaaccttcaatacaaatggactaaatgctccaattaaaagacacagactggcaaattagataaagagtcaagacccatcctgtgctgtattcaggaaacccatctcacgtgcagagacacaaataggctcaaaataaagagatacaggaagatttaccaagcaagtgggaagaaaaaaaagcagggttgcaatcctagtctctgataaaacagtttaaaccaacaagatcaaaagagacaaagaagggcattacataatggtaaagggatcaatgcaacaagaactaactatcctaaatatatatgcacccaataccggagcacccaaactcataaagcaagttcttaaagacctacaaagaaacttagactaccacacagtaatagtgggagacttcaacactccactgtcaatattagacatatcgacgagacagaaaattaacaaggatatccaggacttgaactcagctctggaccaagcagatctaatagacatttacagaactctccaccgcaaatcaacaaaatatacattcttctcagcaccacattgcacttattgtaaaattgaccacataattggaagtaaaacactactcagcaaatgcaaaagaacggacaacataacagtctctcagaccacagtgcaatcatattagaactcaggattaagaaactcactcaaaactgcacaactacatggaacctgaacaacctgctcctgaatgactactgggtaagtaacaaaatgaagacagaaataaagttctttcaaaccaatgagaacaaagacacaatgtagcagaatctctgggacacatttaaaccagtgtgtagagggaaatttatagcactaaatgcccacaagagaaagcaggaaagatctaaaatcgacactctaacatcacaattaaaagaactagagaagcaagagcaaataaattccaaagttagcaaaagacaagaaataactaagatcagagcagaactgaaggagatagagacacaaaaaacccttcaaaaaatcaatgaatccagaaactggtttttttgcaaagatcaacaaaatacaccactagccagattaataaagaagaaaagagggaagaattaaatagactcaataaaaaatgataaaggggatatcaccactgatctcacagaaatacaaactaccatcagagaatactataaacacctctgtgcaaataaactagaaaatctagaagaaatggataaattcctggacatatacaccctcccaagactcaaccaggaagaagtcaaatccctgaatagaccaataacaagttctgaaattgagggagtaattaatagcctaccacccaaaataagtccaggaccagagggattcaaagccaaattctaccaggagtacaaagaggagctggtaccataccttctgaaactattgcaaacaataggaaaagaaggaatcctccttaactcattttatgaggccagcatcatcctgataccaaaacctggcagagacacaacaaaaaaagaaaatttgaggccgatatccctgatgaacattgctgcgaaaatcctcaataaaatactggcaaaccgaatccagcagcacatcaaaaagcttatgcaccacgatcgagtcagttttatccctgggatgcaaggctggtttaacatatgcaaatcagtaaacgtaatccatcacataaacagaacggatgataaaaaccacatgattctcgcaatagatgcagaaaaggccttcaacaaaattcaacaacccttcatgctaaaactctcaataaactaggtattgatggaacgtatctcaaaataataagagctatttttgacacacccatagccaatatcatactgaatgggcaaaaactggaagcatgccttttgaaaacctgcacaagacaaggatgccctctctcactgctcctattccacatagtattggaagttctggccaggacaatcagacaagagaaagaaataaagggtattcaattaggaaaaaaggaagtcaaattgtctctgtttacagatgacatgattgcatatttagaaaaccctatcgtctcagcccaaaacctccttaagcagataagcaacttcagcaaagtctcaggatacaaaatccatgtgcaaaaatcacaagcatttctatacaccaataatagacaaacaagagagcaaaatcatgagtgaactcctattcacaattgctacaaagagaataaaatacctaggaacacaacttacaagggattatgaaagacctcttcaaggagaactacaaaccactgctcaaggaaataagagaggacacaaacaaatggataaacattgcatgctcatgggtaggaagaatcaatattgtgaaaatggccatactgcccaaagcaatttatagattcagtgctatccccatcaagctaccactgactttcttcacagaattagaaaaaactaccttaaatttcatatggaaccaaaaaagagcccacatagccaagacaatccaaagcaaaaagagcaaagctggaggcatcatgctgcctgacttcaaaggatactacaaggctacaataactaaaaagcatggtactggtgccaaaacagatatatagattaatggaacagaacaaaggcctcagaaatagcaccacaaaactacaaccatctgatccttgacaaacttgagaaaaacaagcaatggggaaagaattccctatttgataaatggtgttgagaaaactggctagccatatgcagaaaacagaaactggaacccttccttatgccttatacaaaaattaactcaagctggattaaagacctaaacataagacctaaaaccataaaaaccctagaagaaaacctaggcaacaccatccaggtcataggtatgggcaaagacatatgggcaaagacttcatgactaaaacagccaaagcaatggcaacaaaagccaaaattgagaaatgggatccaattaaactaaatagcttcttcacagcaaaagaaactatcatcagagtgaacaggaaacctacagaatgggagaaaatttttgcaatctatccatctgacaaagggctaatatccagaatctacaaagaacttaaacaaatttacaagaaaaaaaaccacacaaccccatcaaaaagtgggcaaaggatataaacagacacttctcaaaagaagacatttatacagtcagcaaacatatgaaaaaatgctcatcatcactggtcattagagaaatgcaaatcacaaacacaatgagataccatctcacaccagttagaatggtgatcattaaaaagtcaggaaagaacagatgctggagaggatgtggagatataggaacacttttacactgttggtgagagtgtaaattagttcaaccattgtggaagacagtgtggcaattcctcaaggatctagaactagaaataccatttgacccagcaatcccattactgggtatatacccaaaggattataaatcattctactataaagacaaatgcacacgtatgtttattgcagtactgtgcacagtagtaaagacttggaaccaacccaaatgcccatcaatgatagactggataaagaaaatgtggcacatatataccatggaatactatgcagccataaaaaaggatgagttcatgtcctttgcagggacatggatgaagctgaaaaccaacattctcagcaaaccaacacaagaacagaaaaccaaacactgtacgttctgactcataagtgggagttgaacattgagaacacacggacaagggagggtaacatcacataccagggcctgtcagggggtggggtgttaggggagggatagcattaggagacatacctaatgtagatgacgggttgatgggtgcaacaaaccaccatggcatgtgtatacctatgtaaaaacctgcatgttctgcacatgtaccccagaacttaaagtatataaaaaaatttaaaaacaaaatgtttataacctattagatgaaaaatgtacgttataaaagttggtagggtatgatcccatttttgttaaacctacattcatgactttgtacctacaaatacgtattgagagaaaaaatgaatgaaaaagtgctaataatgtttatctctgggtagaggacatgtggatgacatttttttcttaggctcatctatattccccacattttctatgataaaggtatgctctaatagtttttaaaaagtaaaatttagaaaaatgatgacaaaatatgccagtgcttgtaaaacatgcccagctgccttattgagtattatagcacggctgtgagctgactcaggtccagtcatggagcctccagaaagtactcttgagttgacatactgacagaaatggaatggcttgtaagtttcccaggaacaggatggggaaccttagggctacatggcaccaagaaacatatatttgaaaaaaataaaagcaggtggattattttgggtcacttaattgtttcaaaataactggctgggccagttaatcccagccctttggcaggctaaggcagcaggatcctttcagtccaggagtttgagatgagcctggtctcaaccccatctctacaaaagtctggtctcaaatcccgtctctacaaaaaattatccaggcatggcggcacacacctgtggtcccagctactcaggaggctgaggtagggggatcgcctgggcctgggaggtcaagactgcagtgagccttgattgtgccactgcactctagcctgggggacagaaggataccctgtctcacacaaacaaacaaacaaaacaaaacaactggctggttgtctgaattacctttcattgctgtgtgtgtatgaacaccatctccctgtgactttggccaggtcagtattcaacaagagactttttttccacttgagtttgacattctgccatggtcgagtaacggtactgtaattgtttagctcctcatgtctccacctcagtgcactcctattaaccttgaacattcatgcccagattttgccacacccagagtatggatatatgacaaaccccattctacgttttgttttattactacttgctaaaaatttgaactaaatgataagctgaagtattgattttttttttgcccatctcatctctgctactataaagtttttaaacattggaaaacaaaataatacattttacgctactctaaacaaatatcctcatcaaaaaaacctgaaatatttagacttaaaaaatatcagcaatgtcaatataactgttgagtggagagaaatcctgggtgtagaccacaacttctttcttggaatctgagaataataccttttcagaaaaatctttgagacagggtctttctctgtcacacaggcaagactgctatggcacaattatagcttactgttaccttgaactcctgcgctcaagcgatcctctcacctgagcctcccaagtagctaggactataggcacgcaccaccacactcagctaagtacttagtttttgtagagataaggtcttgctatgttgcccaggctggtctccaactcctagcctcaagtgatcctcctgcttctgcctcccaaagggaggttgggattataggtataagccaccttgcccagccacattatttttgaactttaaagttatttcatgacttgtgtaacaactatttgaagggaaagaatgaaaaatatgccatctacaaggaaagcgtgaatacctaagaaacatccaaataattcacccattaactatcagtctaaatgagggcaaggtgggtctgatctcctaataatatcacatgtgcttcattcataaaatcaagaaagaatggcttcactagatcctgctctgactttaatcccaggacaggaaatgcactgataattctcaaagctttggataggaaagcttcacaaattggcctggatccatttctgtggctgtgagtcttcacacattgatcttcctgatccctgagcccctgccggtgtttcctcactggctcatgcccttttcaatggttggcacctttgatcataaatgtttccacaggtacacaaagacaggcatgaaagatagaggaaaagagctctctgcctatatttgttatggttgaaaattcagatgtttctcctctgtttccacttaggctgagttacaaggtaatttgctcaggaagacgaatataatggtggtggggggttagggcagggggaggtccgctcagggtttccaccaagggtgcaggtttaacagaagccagaatgggaggatcatgtacatagactacagtgagaatggtaccccagttcctccctccagcaacatcagcctgcaccagtctgagacagggcacggtggggaatgaggggccaggatgggctttcatcgttaacacacatccatcagagcacaattcttcttggagcaaaagatacagcacagtagaaaaagcccaatcagccacattctaatccccttctcacccacggagctgtgtgatcctggcaaatcatgtgtcctctcagagcttcttccttcaaacatagacccccccaacacccaggtcacacgaactttctccttctgaggataaaggccacagccggaatttagtaacattaattttaaaaccctcatctccaggccagaaaagcctctcccaaccccttggaaacgggttttgatggcaccaccaagacagcagggtcagtgactcacggatttgggggatggccttgtgggcgcgaggctcctccggaaagcaggcattgtgcagggtgtctctttgatggtcttttaaagagctttccctgttagctagagcagtttcaccttcagatagagctgcctttccgttgtccgtggaattcactgcacatttcgagggaccgcctgtcctggcagagagcaagggactcataaaagtgtcagaacattatgaacagcccgaagatgggctgtgagcggggataagtgaagcgcggcgtggaggccgttcggtaactccatccatctgtggacaggggcgtgaggacaaggcgaacagactcgtggcgagcagcacctgggcaagccagcaggtgcttgagccacggggctggctcctcgttgagctatctagaggagtgcaccgagcaaagcgcctgctgaaaatactttgtacctccgggattccttctcttcacttcgaagtgaaagatgcggagtttaatcctaacctagtggtgagagggtcctaaattcccttcctcgtagaatgacctgatttctgcggctctgagcttgcttgcggcagcctgtgtattaatttaacttcgtttttataggccttttgcatgcaatgttaaacacacagccccgccatctaatcaaaagggactcttatcaatttgcaggatagttgcttacagaaaaaaaaagaataaaaacactacactgaatccttcattcttaagaggtaaatatcgatcactgagaatgtatttaatcactgatcttgtaaacaggttgtaaacacatacatgctgagtgactctgtaggcaagccctatctttgagaaacatttctggttcttacacagttaactttctggagttgaattgcacagaacctgaggactgaatgctagacgtggttatggcaagggaagctctctttggcattctgggttctgacctttcacccggctaaggcaggctgcttctgtgggtgcctccagcagtgacagaaagaatgtacaggaggtgtgaccaatagagggaactgagcaagaagtactgaggctcggagagtcaccatccgccttgaaggcactggaccagacctcagataaacgaagcccagcctagaccctgcccttgcccgggtgggcggtcttgagcaaattaggtaagaccattgatttcgaagaatgtttccaacctggaaaaccatgtagtacaaaggaataaacgtgggtcgaatcctggttctacagctgagcaaccttcagcacaacactgtgcctctccatgtctgcaaagttgacctgaaaatgcatactacacatggttcctttaaacttgaagaaattaaccaagtatacgaaaagagttgatgcataggcttgctaccaattccattttcgcatgatggagtgtgctttctgaagctaacattctaagattatattccaaatttcctgaacaaaatgtacttattgcatagcaagacttgcccctgagatccttaattatccatttattttgggatgaagataggcgaatacattttactgactctgcttcccgctcagtaattctttttctgatcctacggggtagggctgcatacgctaatatttctctgcccaaaatatacggatatcacttgcctaaaactggctgcagcttgtcgggttggtcaggttcaaatatctattttaaaaatcacccaaaaagcaaattaaaataagaaatgtcatgtttttctgtatagtcttattagttttgccccaggaaaaatggagtaaaaatagctctcaggtgggatagcagggacagccacgatactgtctccacctggatgtgaaatctggggaccaggaagctcaaagtcactctttgccaatgggctcttatgggacaggatatctcaagtgctcaaaggccagacttgactgtttaagaacccgggctagcatgcacacagggagatgccacaattttggtattctgacctggtttctggggtaaaactggaaatgagctcttgctgcgttttaatttttaaattaacatcagatataaacctgaaagaaggcctatcaaggatgtagtctaaatcacgaaagctgacagaagcggaaataaaaccatctattgaatggaacagaaaacagtggtctcggcaccaagaatagaagattcctggctcattggattcaaatgtgaattttcttatctctgttatcacctgtctagttatcaggtatctacctgcctatctatctattgttccatcccatcccttaaaaggggttcttatgttgcaaaaagaagaaagcaggaaagaattacaaaggtgttaagataactatatggaacatgctgttctcaacctttttggcaccagggactggtttcacggaagacagtttttctgtggaccggagttaggtggcagatggtttcgggatgatttaagcacgttacatttacggtgaactgtatttctattattattacattgtaatatataatgaaataattatacaactcactataatgtagaatctgtggaagccctgagcttattttcctgcaactagacggtcccatctgtgggtgatgggaagcagtgacagatcatcatgcattagactctcataaggagcacacaacctagatcccttgcatgcacagtttacaatagggtttgccctcttatgacaatctaatgccaccgctgataggacaggaggtggagctcaagtggtaatgtgagcaatggggaacggctgcaattacagatgaagttttgttccctcacctgctactcacctcttactgcgcattccagttcctaacaggccatggattggtaccaatctgtggcccaggggttggggaatccctgatatagacaatatacaagttaaaaagacttaaattacatatactgtggtctattaaaatggctgggttggtgaaatgtgaatttggggagatatgaatataggcatggtttcttcttaccttcacatgtaaacacttttgtactttacaaaatttgcataagaacattttcatgttattgatacgacttttggtaacacctgcagcagattccagaatttggaggtacggtagttgactcgacaatttctcttttatatggagaaagaaacttggagtcttgatacaacataatatcccagcctagatcatgaagaagttaactgagaaggctcttaccaacatacttaacctaatattagaaggacatttcaggcttaagcccttcctgcctgacactcatggcacatggacagtgtgtgaagtttggttagaagttaaatcaaaataaaaatagtcaattcgcatctggggttctttgttctccatgatgccctatgatctgtgcagctgagccttccctcccatttgatctatggatttgataggattagataatgcagaagtccctgaaataatggcccagtttaataacagctggaaaagtgttattgtaaagataagccattctttttttttttttttttttttgagacagagtctcactctgtcgcccaggctggagtgcagtggcaccatcttggctcactgcaagctctgcctcccgggttcacgccattctcctgcctcagcctccccagcagctgggactacgggcgcccgcctccatgcacggctaatgttttgtatttttagtagagactgggtgtcaccgtgttagccaggatggtctcgatctcctgacctcatgatctgcccacctcggcctcccaaagtgctgggattataggcgtgaaccaccgcgcccggccttgataggccattcttaatgactacccgtgcaggtttttcatgcaatgaagaaggatcttgactaactcatgggaatatcaatgcacagaatgggtcatttactcactcaacaaacaatcaccaagtggaccctaatacaggttgtgttcaacaactggaaatgcagagatgaaaatgtgctatgttagccctagagttctggaagtagacctatgaaatgatcatccagggccccttgtgcaactgcaggtggtaacattacactggacgctaagtgatagccctagaggttccattgtggagattcaaggtggatgtcatctcccagagctatgcaactgggggcactgtgaataatcaagacacaagatgcatcagtagctaagcatcaatggctaatcatcaatggcaaatacatcaatgggctaagcacaagtactgtgggaacagagatcacaggaaccagctctgtcccactgggaggtgatgggataccattaaaacttcccatgggatgtaatattgacatttgaaaaatggtagacaagcagattcaagaataagtatatatagctgggcacagtggctcatgcctgtaatcccagtattttgggaggccgaggcaagcggatcacaaggtcaggagtttgagaccagcctgaccaacatggtgaaaccctgtttctactgaaaatacaaaaattagccgggtgtggtggtgggcacctgtaatcccagctactcaggaggctgaggcagaagaatcccttgaatatgggaggcggaggttgcggtgagccgagatcactcaactgcactccagtctgggcgaaagagtgagactccatcgcaaaaaaaaaaaaaagagagtaagtgtatagaatgggtaagatcaaacaccaatttttgctttcattaaatattttcagaaagtgatcctgaacccgcccaccctccaaccttcctggagtaagcaccctcttcattctcaaggtgccagtggcccttttcacactgtccttcacacttgtgtggcacacacagtggttttttttggcagagactgccaattgtgacacttacttgtaagccaccaagccctgaacattccacacagaccatactattaattttatttttgccctcagccagatttcaaagaccccagagatgtctggaaaattaatttattaaaaagcaatagcttgataatacacacgatgatagaagaaatatgttcaatatcgtataaaacagttggcaatcacttaatagagtgttcattgtcaatttagtagcttgtctcattatgctcagcaaatagttgtaaaatagtgtattattcatgaaccaacatgctttaataacttttagtgcacatttatttctcaaatgcaatctgagttagattcatctataaaagcaaccaattttgcaaaagtcggcttcaggacctcccaaagaaagagcaacatgttgtgtgtctcagcctggaaatgcaaactggccaagcccacacctttgtcctagcagaaagcaggtagtggtagcccctgactttagatcatccaggaaagggttagctgataccacccccagctgtggacccaacacagtggggagtggctcccctaagccagtcctgcctgaggtgggtaggatctgattcagccacctgagtctcttgatgaggctgatcatgtaacttactttgcagtgggataggagcagacccagaagcaggggcttgacctgccctcgcgttgctggatgcacccttctttacactcctgccattcaccatgagagaaacatcccccaggggaccactggtccaaggaagacagaaacacatccagtagccacggacttaattcatagcctggagccaacccagctgggatcagctgaccctcagcttacagacagatgcaaaagcaataaagacaatgatagctgctttaagccagtaccatttttggggtagtttgttatgcagccaaagctcaccgggaaagtggcatatccagaatttactttgagatgctctggggacatcctcaaagcagctggcagtcaatttacctcatttcacttgctgtagaggatgtttggcacacgggactataagctcaaaagagaagtcacacatagtgaataaagaaaacaaaatttgcagaggagggaagatcacttgaagccaggagtttgaggcaagcctggggaacatatcaagataccatccctagaaaaaataaaaaataaaaaaatattagctgggcatggtggcacacgcctgtagtcccagctacactggagggaggctgaggtggggagatcgcttgagcccaggagtttgaggggcaaccgcactactgcattccacactgtctctaaaaaaaaccagaagaaattttaaaaatatgattgaaagccgcagaagcagccattctcactatgggtcttgattttcatccaggtgcttctcatatgggcaactctatgcacacgctctacggtaatagaaggagaaattaatttagttagcaatggttgacaattcttcacctcaatgttgggaggtgggctaaattcaaaaaatacctgaccagtaagtattaaaaataatggtgaaaaatgcctcacaccacaggcacaccactagcattagtagcagtaatggttgtgatggttgttattgtcttaactattcactgatagtggaattcagaagcaagaggaagagcaagaagcatcctctcccatccctcactgcaagccaagccgcccagaatccagggtgtccttcccatttctctcccaaaattgttctctgccaccgtaccagcaatcctattccacagtcatatcctgtggagcccacgggaatctcagccagaggctgaaaccctgacactcccatagtccatgctagctgaaccttggctggtgggcctctggagtgggcttccacagctagaagaatattttacaatgcaagcatttgacttccaaacagaattgcttcctggtgtctctcctcgccatagcttgtgcgctcaacttgtcctcttgatacagaggaatacttgaacatcatggagctctgatgaccatcctggttaatgttggtgtttgggcaacagcgggacacagtctgtgtcctctacctggggtctcctttccctccctctccctcctccaggctcaatgaggggagctcctgtacgtcctccaagagccacatcctgggggaagttttccagttgattccttggggaaagtcaagcattcccacctttggatccacagaatcctgcacctgcttctccagtattaagtggctgtgctgtttggctttgtgtgtttagtcttgtttctctcattcatccatgagatctttcaaaacataaagtacatctcacacactatgcacagtattaagacacagaaggggctcaggaaatattgtgaagaaattagggaatactcttgttgaggccaggctacaaggctagactggaggccctggtccctttccttgtcctctgagtaggccttctccaggctccgctcctttccaaatttccaggtcctcagcattccccattgaagaaacaggagctgatcatagttcgttcttattaggagttaaagaaaagtgcacgccatctccgatgactccaggccctccagggacaacctatacaaggtttacagccatagggagcatgcgaggacatttctaattaaattctttagtgcttctacttgacctcatttcaactgtgccataaatctcggaaaaaaaaaaaaaaaaactcaaatccaaaattttaaataatgcttatgagttggtttagaatcaggactcgccttattaacccaatagctgcatatacttggattgccagagtgtgccttgagacagggtcagttaaaggccagtggccatttcaattaaaatgttttcaaagatttccaaataataaactggtctggcctataattacagatgaaataataatttttaaaaaaccctcataatcctatgtgtaatgttatggcacgcagttggtgtccatgcaccaagacaaatatctccccaagacagggagccacggaaacaactgaagtataaatcccgggcaccattaacacgcaggctctattagttgactttgtcattggtcacattaaagcctcatggcgtttgctggtggcttgggagggaagggttttggaacaacttaaatgaacatataattccactcggtaaatctctgctgtaattggctaataagcacacactttgcaaataaccactggaaatggttggttggaggatttctcccccaacttctttctcacttcccatggttcttctggcatagagggtgattcactttcacacacctcctggccttttcagagtatggagacgtggaaattctgagtaggtgagttccatctcagaggacactcaggggaaagcgtgctgtgcttcttaaactatgatctatcctatagttttctcagctcctgcactgttggcgtttggggctggatcactctttgctgtaggcagctgtcctgtgtatttgcagggtgcttactgtcatttctgcccttgatccaccagtggctagcagcgacactgcaccctgttgtgataatccaaaatatttctagacactgacaaatgtcccatggggggcacagtcaccccctgtgagggacccctggtctagccagatgcaccctccaggtcctgtggctcagcatcccatcatggtgcatcgtgacagtccagcaactcgtcttagacgggaatcttcctcctgacttgcttctctactgacctggcctgtgtcaccttttgaccttctggattttgctcccattcaatttctcctctcacccaggcatgcggttctttttttgtcaggctttgacctgcagtcatcagcaaaggatcttgactctgaccctttctgaggctcttccttcttgaagacaactacagagctcaacccttgcctctagtatcctgggacagagcccagcatccccacaactgcagaagatgatggcttcataactgaatgccagcttttcccaggacccaagctgtccctggttggaaaagaggccacaatgaaagctttctgcttctttcctggctcttggaagcaggtacccactgtccttcatttacagattccctttgtatctaagagcgggggcactgtagagcatacgtcttttttacttatttgggtacatagttcatttcttttaggagtctatgaccacacagtaaagaaagtggaatctgggctattatgtgaccttgtgccaaaacataacactcacttagtgctgttgttgccagactgttttcactgtcacatctgaagcctaaagtctccctgggaatgccaggtgcaagacagaaagagtctctggaaatgggaatgaggttgccagattaaaacacaggacattcaatttaattcgaattttagataaaacaaatttttaaagtataaatatatcccatgcatacagtatgggatatacttctgctgaaaaaaatcagtcatttatttgaaacttaaatttaaatgggtaggctgtatttttatttgctaaatctggtcacctaggcaggcaggatctctttttcttgggggatataggatttgaacttgaccccactctacttcctgaacttgaccccagcacactccatcttgacctggacttgtttgctctgatctcatggtggggtaaccaccaggggaagtgaggactccagggagacgcagtctcatcctgtcacatcttgttgtcctcaccgtgctggctacaagctggggaggtctaaacacctctctagatcaggttctcatagccactcccactgttgtagtttgcagctctggccaaggatttgtccatagtcactgtcctaaaggaaagtgaaaagtcagtcaaactaattgtgtttgcagctcctgattttgtaactctcggttttgtcaaattctctctctgttgcttcccaaattctgccgagctggaacatttgcatgggtgccctaggctcctagtttgtgcgcagtgattgacacatgtctgtcactcttaagtagtgtcactgaccatcctggtttgctcagaagtgaggagtttcctgggccgtgggacagtccacgctgaaactggtaaagtcccgggcaagttggaatgagttggttatccaacttgaggctgttggtggagttatctgggggatggtttgtagggaacaaacctccaaaattcaaattccaacccactgaatgatagggttctcactcacactgggttggatggataaaagtgaattccagactttccacagatggccagattaaccatcacctccacagggaggcatttctggaccattttgcctacctagtccgaacccctagatgctaatggtttctttcctagcatgtctcacagctgggaatcacagatttattctttgtccctctcaatacctggaaagctctgtgagggccaaagccttctctgttttgtttattgctgaaatccccagaagttaggatagtccaggcacattgtagctgctctcaaaatatctattgactgagcaaatggatgattcaatgcccagccatggcaggggtaaggcgctgggaatgggctgaagaagcacagccctcaactttagaagccttgaagaaagatgattatttaagatggatagtggcagcacaacacgaatgttttacggatagatgcagaggatgtgtgtagccatgcccaggaaggcttcacaaagtatttacccaaattattattttaaatgggttatcaaggtgggcacatggcttcccttctctttgcttgcaaagaacatcaaagggctgggcaatgcaaaggtgatagagcccagaatggcattgggggtttagggtcccatggcggggggtgtaagtggagaaaaactatatgtgaaaattaacttggggatactggattgacattcaggactaaacatgtttggatccagcagtcttatgtttttgaatgaaaaaaaattggaagacatggttttcttggttacacatgttctgttttgtcaaaatgtgcccgattgccctttcttctgtctgtatgcctggtgacattttaactaaactcctcatcccactcccaagccctacaacacttcaactaccccttcaggacctctctagccaacatcatcttccccctctcctaccagaataaaaaacccttttgcctccatttgccaacaagcatctctggaaaaaaaaaaaaaaaaaaaaaaaaaaaaaaaaaaaaaaggggcagcagccccagttaggggcttattgataaaaaacccccatctccctgggacagagcacctgcgggaaggggtggctgtgggcgcagcttcagcagacttaaacgacctggcctgatggctctaaagagagcagcagaactcccagcacagcatttgagctctgctaagggtcagactgcctcctcaagtgggtccctgacccccttgtctcctgtttgggagacacctcccagtaggggccaatggacacctcatacaagagagcttcggctggcatctggcaggtgcccctctggtacaaagcttccagaggaagaaacaggcagccatctttgctgttctgcagcctccattggtgatacccaggcaaacagggtctggagtggacctccagcaaactccagcagacctggaggggccttaccgatagaagaaaaactaacaaacagaaaggaattgcatcaacatcaacaaaaagacatccactcacagacctcatccaaatgtcaccaacatcaaagaccaaaggtaggtaaatccacgaagatggggagaaatcagcgcaaaaaggctggaaattccaaaaaccagaatgcctcttctcctccaaaggatcacaactcttccccagcaagggaacaaaactggatggagaatgagtttgacaaactgacagaagtagacttcccaaggtgggtaataacaaacttcaccgagctaaaggagcatgttctaacccaacgcaaggaagctaagaatcttgaaaaagggttagacaaattgctaactggaataaccagtttaaagaagaacataaatgacatgattgagctgaaaaacacagcatgagaacttcatgaagcatacacaagtatcaatagctgaattgatcagacagaagaaaggatatcagatactgaagattaacttactgaaataaagtgagaagacaagattagagaaaaaacaatgaaaaggaatgaacaaagcctccaagaaatatgggactatgtgaaaagaccaaatctacatttgattggtgtacctgaaagtgacggggagaatggaaccaagttggaaaacactcttcaggatatcatccagcagaacttccccaacctggcaaggcaggccaacattcaaattcaggaaatacggacaacgccacagagatactcctcgagaagagcaaccccaagacacatgcttatcagattcaccaaggttgaaataaaggagaaaatattaagggcagccagagagaaaggttgggttacccacaaagggaagcccatcagactaacagcaaatctctctgcaaaaacactacaagccagaagagagtgggggccaatattcaacactcttaaagaaaagaattttcaacccagaatttcatatccagccaaactaagcttcataagcagaggagaaataaaatttttacagacaagcaaatgctgagagattttgtcaccaccaggcctgccttacaagagctcctgaaggaagcactaaacatggaaaggaacaactggtaccagtcaatgcaaaaacataccaaattgtaaagaccattaacactatgaagaaactgcagcaactaacaaatataaccacctagcatcataatggcaggatcaaattcacacataacagtattaaccttaaatgtaaacaggctaaatgccccaattaaaagacacaggctggcaaattggataaagagtcaagacccataggtgtgtggtattcaggagacccatctcatgtgcaaagacacacatacgctcaaaataaaggcatggaggaacatttaccaagcaaatgggaagcaaaaaaaaaagaaaaaaaaaagcaggggttgcaatcctagtctctgataaaaaaagactttaaagcaacaaagatcaaaagagacaaagaaggacattacataatactaaagggatcaatgcaacaagaagagataactatcctaaatatatatgcacccaataccggagcacccagactcataaagcaagttcttagagacctacaaggagacttagactcccacacactaatagtgggagactttaacaccccactgtcaatatgagacagatcaatgagacagaaaattaacaaggatattcaggagttgaactcagctctggaccaagcagatctaatagacatctacagaactctccaccccaaatcaacaaaatatacattcttttcagcaccacattgcacttattctaaaattgaccacataattggaagtaaaacactcctcagcaaatgcaaaataatggaaatcttaacagtctctcagactacagtgcaatcaaattagaactcaagatttaaaaactcactcaaaaccacacaactacatggaaactgaataacctgctcctgaatgactgctgggtaaataacaaaatgaaggcagaaataaagaagttttttgaaaccaatgagaacgaagacacaaagtaccagagtctctgggacacatgtaaagcagtatgcagagggaaatttataaccagctagtccacaagagaaagcaagaaaggatctaaaatcgacaccctaacatcacaatcaaaagaactagagaagcaagagcaaacaaattaaaaagctagcagaaaacaagaaataactaagatgggagcagaagtgaaggtgatagagacacaaaaaacccttaaaaaaaatccgtgaatccagaagctgtttttttcttttttatttttttatttttgttttttaaaacaaattagaccactagccagattaatttaaaaaagagagaagattcaaataattgcaataaaaaatgaaaaaggggatatcgccactgatcccacagaaatacaaactattgtcagggaatactataaacacctctatgcaaataaactagaaaatccacaagaaatggatagattcctggacacatacaccctcccaagtctaaacctggaagaagtagaatccctgaatagaccaataacaagttctgaaaatgatgcagtaattaatagcctaccaaccaaaaaaagtctaggaccagagggattcaaagccgaattctaccagaggtacaaagaggagctggtaccattccctctaaaactatttcaaacaacagaaaaacagggaatcctccctaactcattttatgaggccagcatcatcctgataccaaaacctggcagagacacaacaaaaaaagaaaatttgaggccaatatccctgatgaacattgctgcgaaaatcctcaataaaatactggcaaaccgaatccagcagcacatcaaaaaggttgccaaccacgatcaagtcagctttatccctgggatgcaaggttagttcaacatatgcaaatcaataaacataatccgttacataaacaaaaccaatgaaaaaaaccacgtgtttatctcagtagatgcagaaaaggccttcaacaaaattcaacaacccttcatgctaaaactctcaataaactaggtattgatggaacgtatctcaaaataataagagctatttatgacaaatccacagccagtatcatactgaacgggcaaaaactggaagcatgtcttttgaaaaccggcacaagacaaggatgacctctctcattgctcctattcaacacagtatcggaagttctggccaggacaatcagacaagagaaagaaataaagggtattcaaataggaacagagggagtcaaattgtctctgtttgcagatgacatgattgcatatttagaaaaccccatcatctcagcccaaaatctccttaagcagataagcaacttcagcaaagtctcagcatacaaaatcaatgtgcaaaaatcacaagcagttctgtacaccaataatagacaaacagagagccaaatcattagtgaactcccattcacaattattacaaagagaataaaatacctaggaatacaacttacaagagattatgaaggacttcttcaaggagaactacaaaccactgctcaaggaaataagagaggacacaaacaaatggaaaaatattccaggctcatgagtaggaagaatcaatatcgtgaaaatggccatagtgccaaaagtaatttatagattcagtgctatccccatcaagctaccattgactttcttcacagaattagaaaaaactaccttaaatttcatatggaaccaaaaaagagcccgcatagccaagacaatcctaagcaaaaagatcaaagctggaggcatcatgctacctgacttcaaagtatactacatggctacagtaacaaaacagcctggtactggtaccaaaacagacatatagattaatggaatggaacagaggcctcagaaataataccacacctctacaaccatctgatcttttacaaacctggcaaaaacaatcaatggggaaaggtttccctatttgataaacggtgttgggaaaactggctagccatgagcagaaaactgaaactggaccccttccttacactctatacaaaaattaattcaagttgaattaaagacttaaatgtaagacctaaaaccctaagaaccctagaagaaaacccaggcaataccattcaggatataggcacgggcgaagacttcatgattaaaacacaaaaagccatggcaacaaaagccaaaattgacaaatgggatctaattaaactaaagagcttcttcacaacaaaagaaactatcgttggagtgaacaggaaacctacagaatgggagaaaatttttgcaatctatccatctgacaaagggctaatacctggaatctacagataacttaaatttacaagaaaaagcaaccccatcaaaaagtgggcaaaggatataaacagacacttatcaaaagaagacatttatgcagccaacaatcatgaaaaaaagctcatcatcactggtcattagagaaatgcaaattgaaaccacaatgagataccatctcacaccagttagaatggcgatcattaaaaagtcaggaaacaacagatgctggagaggatgtggagaaataggaacacttttacactgttggtgggagtgtacagtagttcaaccattgtggaagacagtgtggcaattcctcaaggacctagaactagaaataccatttgacccagcagtctcactactgggtatatacccaaaggattataaataattctactataaagacacatgcacacatatgtttactgcagctctattcacaatagcaaagacttggaaccaacccaaatgcccatcagtgatagactggataaagaaaatgtggcacatacacaccatggaatactatgcagccataaaaaaggatgagttcatgttttctgcagggacatggatgaagctgaaaaccatcattctcagcaaactaacacaagaacagaaaaccagacaccgcatgttctgactcaaaagtgggagttgaacaatgagaacacatggacacaaggaggggaacatcatataccagggcctgtcagggggtgaggggttagcggagggatagcattaggagaaatacctaatgtagatgacgggttgatgggtgcagcaaaccaccatggcacgtgtatacctgtggaacaaacctgcacattctgcgcatgtgccccagaacttaaagtataataaaagaaaattaaaaaaaaatcaaagtgcacacccacataagcattttacactaaatcgttaatgactactttggactgtctaaatttagaaaaagagtccatctgtttgaaaagagtttacctctcatttacctgtttgactctctcattgcttgaacatatctcaacccacaaatgttaccaaagtcaccatctggctatctttcttatttcatgggccttgattctgaaaacacaaggaccccctcacatagacacccattaaaataaccctgtaaaacaaaatttgagttccctttgatatgtttggtttggtttaggcaggttttttttgggggggggggtgggggtgtatttaaatatacttttcagtttactgttaatgagaaaagagaaaaaaggagtagaaaacatggaaatgggatagagaatcaaatttccaacatgaaatgtgttaatttttaagtggctttcagtaggtgtcttggaacatcagtcaatatgtggtaaataatctgtggtgggtggaattgagtctaagaattcaacattggaactttacccaagaaaaaagtccaagagtgaggtcactccagttggaaattgtttgtgtccatctgtccatccatccatccatccatccatcttttcaataattttccatctacctttcaataattttaactgttgactctgtgccaggtactgttttaggttcctgttctaatggaactcccattctgtagacaggagacagagtaaacaaccaaacaaacaaaaaataaatcaatcaataaacgagaacatcagctagtggtaagtgctatgaggaaaataaatcacagtgctgtgatagagtataatgggcaagtgccgggcaagggcattaaagcaggtggtcagggaaggcctccccgaggtggtgatatttcaagcaagcagcgaatgaaaagaataaagtcaagtcctgcctggtgagcaaatagccagtgtgagagcccagaggcaagaatgagcctggcctggttcaagattcagcaagtgagtcaaaggagaatagtttaagaagaaaaggcatcttgaaattactggcatgtcaatggagaacagaaatgaatatggatttgatatcttttgatactggaagccagtcccatattatcaatggcaaagtcatacgtaacttctccttgccgatgatctcaatggctttgtgtgtgcttcactgcaaacttgcttccccctcaccagctcacccagttgaatccagcctgattcagtaactgactcctgtttgctgagctttgtgaaattaggcacttggtaaactggcattagggtttttgccaaaacagcccaaaacactctgcgcaaacatttcctgaggcacctcttccccgctggaagtaatgggtggctatttgcaaactgcttagccggtcttaccactgtcaacccatcctcattagctgcagccggaacaaaggcatcttcctggaagcctttgttggttaaaaaaataaaagtggttttttttggacatgcttgaactaactcccatttgtgtgtgcatcagaaatatgtaatgaataaaatgaaatatggaagatactgtcatagcacatccaaatcaaacatttatttgctaaaataattatattagaaaatagccattgcctgtaaaattctggaatgagtgaaaactctttttattttgtttccttctaaatgtgcttataatttcggttaaggacatcttttcccaatacttcttactttacccacccagttttggacagaattttactaaactgagtgactcctaacacataacagtctttttatttgtccttaataaacctcagagaaggttcaccctcatgtcgggattaattttgctattgattcattttctttggatcataaaacaagtgtaccacatgttagatacactggaattacttttttttttttttaaattaactactcatggttaagccaagcagagttatacataaagagttaagagagccacttagaattaaatgatcctacctgataataaattttgctttttggaataaagcaattttctcttcgttgctgtcttactaatacaataccgtgtctgcaataataattctatttcagatatccgaagctctcccacttctttagctctctaatttcttacatgatgcccctggttttacaagtatttttaatagactgatgttccagattcttctatacagtcaaatcctttcatagtcagagacttgtttttccacaggaatttaattccctctgcagaattgtaacatgggttggactgatctggtttacattttctgacatgttttccctcccctgaagattaacttaactatcacttggctccttctcaattcttttcatctcattttcacttaaaaaatattctgattttattcagtagggtatcttgcactgttttctgaagatagggattttagctctgggaacatggtttcatgctgccaagtgtttctcccttgaattccagatgatgcctagattgtttgaaattaacacaatgtgtccaaaatttacaaaaaaaaaaaaattcagcttagtgagctgaatatctctattaagttacttggttagtcaatttcataaaattttgtccaaaagaatccactctgtcagccatttatcattaagtacataatgcattgcattgggtaagaacatttaaaaatatattttaaaaatctactcagaatgcacttaacccctgctgtgatttaagtttgtgtacccccaaaattcatatgctgaagcctaacccccagtgcaatagtattgagagacagggcctttgggaagtggtaaggttatgagggctctgtctacatggatggattagtgcctttataaaagaagttgaggccgggtgcggtggctcacgcctgtaatcccagcactttggaaagctgaggcaggcagatcacctgaggtcgggagttcaagaccagcctgaccaacatgaagaaaccccatctctactaaaaatacaaaagtagccgggtgtggtggtgcatgcctgttatcccagctacttgggaggctgaggcaagagaaccacctgaatctgggaggtggaggttgcggtgagccaagatcatgccgctgcactccagcctgggtgacagagtgaaactccgtttcaaaaaaaaaaaaaaaaaaggaggttgaaggatgccgccatgccccttccaccatgtgaggccagagaaagatcgatctttggggaacaggccctcaccagacaccaaatctgctgcaacctgattcccagcagaggcatcccagcctccagaactataagaaataaatctctattgtttataaattacatggtttaaggtaatttgttctagcagtctgaacagactaagacaactcccctctttagataattaaatctccctaatttcttagaagttagcttaaaaatctcttcagagataccctccctggctgttccccgctccctccctcccttcctcccttcctctcttctttcctccttcatggagctaatttacaacttgcaattgctttttttgttgttgtttggtctgtctttgccactattttatattccttgagtctgtaacataatggtcataatgctcactgcacgcagcccagtgcctgatgcaaagcaggtgcttaataaatgtatggtaaattaattttaaaatacaggtcccagaggggttaatttttctcctcaattctctggcctggcctcctacattaactgaattagcccgttaccagcatgatctcattattttattttgaatctgagttgaattatgactgctatgttgttgccattttagaagacattgttctcacctctttagccagatttgtccacaaatattccctttcaggagaaggactccaccaatccagggattctgggtccctcctgccttgtgttctggctcttgtgcatggcactttgaacaaatatttctcaggactgtgttatccttgcaaaggaggccatccaaacaaaagaggacttctggtgaaattccctattgtgattttcatgcctacgcttttaaggcaatctgcagagagcaagaaggtcaaactgacctctccgcaactcagctgtctccaattcccaaagagactgcggagaggtcatctcacctttttggcacttggctctttaattgccagaatgagaggatttgatgaaataaactctatggttgctcttgctctagcattttgcaatgacttccattatatggagggactacatttctttcccaggtaagaatcagtccttgttctggtgcttggggaaggctctacttctgagcagggggagcagtgaaagcgcataattcaatggtgatgagcaccaggtctgaggctcctgaacacttcctgtctatttatagagaatctgggattctatccagcaggcctgccaattgcatccaccaaataataaattcgtttgagaaatccgttacgcattgattccatgagcttcggtttccagcttgctagcgtggcctggctttactagggggatcaaccatcccagtttgcctgggaccaaggggatgtcccagaacttgggactttcagtgctaaaactgggacagtcccaagcagactggacaagtggtgactgtatttgtctgtaataattccgattacaaaagcaacagccatcaccatcagcatcattgtaacagtgagttgttaagtgcttagcacctgctacattttattaggacttcactaataccacctgaccttcagagcaaccctgatgatattagattccccccgtttcacaggtggaaactgactctcagaaaggttaagtgcttatttcaaagtttcttggctaataaggagcatacttaggattccaaaactgaccaacctgaacttaaaccctgtgtcaaaattggaaatttggccactgattgcgcatttgatgacatcaaggactcattgttaactgttttctaggtgtgcaaatgctgttatggttattatttctttttaagtctttatctttttttttttttttttgagacggagttttgctcttgtcacccaggctggagtgtaatggcatgatcttggctcactgcaacctctgcctcttgggttcaagcaattctcctgcgtcagcctccagagtagctgggattacaggcacctgccaccacatctggccaattttttgtatttttagtagagacgggatttcaccatgttggtcaggttggtctcgaactcctgacctcaggtgatccattcgcctcggcctcccaaagtgctggcatgagccactgcgccaggcctaagtcttcatcttttagggacatatttaggaacatttactgatgggaaaagaaatcaaaccaatgtcaataagtcatatcaggctcaaagccgtccctcagtgcaatccctggggtcacaatagtgtagaaagagccaacgctgggggcctgggctgggtcttcccctgaccagccaagcgatcaggtatctattctccgatttgcctgggtttagacgtaatcttcatcatgataatttaaaaaaaatttttttgtaagaaaagccttgatatttaaacttctgtgtatgtgtgtgtgtgtttggttatcagtggaaccctttcttcaaatgaaatattccacaaatgcctaattgataaaacctttaaaatgagttattctggtgtaagggagaactaagaatcctgcaaatagcatcctttggaaacccactggtctatgccgtcccggcctgcagaaacctaacaatattagaaagaaacatttggtcaatgtgataactctggttctgtcaggcaggactggcaaacttctcctgtcaagagccgagttataaatgttgtaggctttgtgggtcgtacgacccatgtcgcaactacttaattctgccctcccaacacgaaagcagccacagacaaatgtaaaataatgggtgtggccatgttccaataaaactttatttatttataaataaactttatttatttatagacacaaattggaatttcatatactttttgtgtgtcacaaaatattctctttcccctcaaaatgtaaaacgattctcagctgacaagtatataacaacaggctcaatgtggcccatgggctgtcatttgctgatccctgctataaagattgtcaggagcctggtttcgattttttttcttttttttcgagatagagtctcactctgtcacccaagctggagtgcagtagcgccatctcagctcactgcaaccgcaacctcctgggttcaagcgattctcctgcctgagccaccaaggtagctgggattataggctctcggtaccacgcttggctaatttttgtatttttagtagagacagggtttcaccatgttggccaggctggccttgaactcctgacctcaggtgatccgcccgcctcaggctcccaaagtgctgggattacaggtgtgagtcaccgtgcccggccgtggttttgatttttgcccctgtgagttactatctgcacatttgagggaaagttatttaagtcctcaagcctcagttccctaattgtgaaaggggtgtaaaagtaaaatctacaagcagcagggatagatgggaactccgtactttcctctccatttttctgtgaacgtaaaactgctctaaaacaaagtctgtttaaaaagaaattcacgcttaaataaaatccacttcatgagtttattgtgcagattaaatgagataagacagtaaaacacctcagcacatggtggtcaccctcacctataattacccggtcctcctggaaaccagtgtactgcccttcttgaccttcaaatagctgtgacctttgcaaggcacagccctgacgcaaggatgcttagaacttggatcctgggcctgttttggcagaatgaactgacctagaatcagcatggatcagactcacaaaagtatgcctgttccctcagcccccagcctccaccccaccatcattgcctgttattggctgagctcccgggccttttccctggactaaagtgttgtttgcttttcttctgcagctttttccagagatatgagcaaggttcacttaaataaccttatcagtcttaccttcaactcctcccctaggttccccatttgagcagtgtaatttctatgtaatcccttaggcagttcctgtggcctcccttctccaattttagtatgtgctgccgaagctagcacgtggcctctcttttctaagggcctccggggcaggtgtgtgtatgtgcatgcgggagggtggggagtggtcacatacacatctgataacgtttttctactcctttcttcatcttgggctccactgagctccctcctttccttgcatctctttgtccttgactttgaaacatggaacacctgctatttcttggggggacatttcgagcctgatcgtctctagctccttcccgtctgcgaggcctgggatttgggctatcacacctcctgttctgaggctcgttttagttattttggatttctttgtattgcaatcacctaaagaatcctaggggttcttttccttccttattttctcctccagcccctacctaaattagttgctaaagggctggctttctgggttctgaattcttgccatgcagttgtccccaaccacagtcccttcctgatgttgctggggcatctgtgaaatgcctcagcaaatctttttttgtttttttttttataaaaaactctttatatgttatttttcttattgtttaaaaataaaatgcgtcatgcacatttacattgtaaaagtaattcatatgcctcattaaaagtgtgtagaagctgaataaagagaaaaataatcaagcatattattattcaacattttcgaataattttctactaaaaatttttgacatactcctgtggttagatcattctctccctgcctctttctctctctacatttatatatatgtagtagtgtatgctgatagagttatttaacacggtagcatcaatatttttctttgttattactctcctagtgggcatctctctatgacttcatattattccatccaaggatcctcttacattttatttaatcatttccattttattaagcatttgtttgcaatttttaccattatcaataatactccaagtagcatctttgtgaatacatgatttttattatatcttaaattacttatttatggttgattgcctacaggtggaatgacttgagaaacatcttagagatagttatatattctttaaggaaaaggtattgtcagagcctgtgttacatgatatgactgctactattgactttctgcttcttctaactggtctgggatctcggttcctggattattctcccagagagaataatcctcaagaaactctccactcagtttgtcacctttacaccaaaccatgcccttccctttgctttagtgaacttggctgcaaactacaccagatgaactctacgcaccaaccttttgtttcagaacataaataccagctcaaccattgatcattttgcctgacctttctgagttcgtcaacttgtctctgatacatagcaaagcctaacttctttgttttaagaaaaattccaagagtcgaatccccaggtcaacgtattcatgagtgtgttgcaaagtaaagctgtaatatttcactgctaaagccttcaggagagcaagcaatcactctggatccttgcctaccactgttcaccggtgcagttttatgtctcctgaaaacgtcttctctctaaacacaccaagggctaaattgtctcctggcttcttgtatccaatccaataactgatgcatatacaccctcctcaaatgcaccctagctgacacacacgtttgactgacttctgaaaaagctttggttaacttcagtccaggaatggttagctttgccttttctgtgaaatcacatccaatggctggctcgacctgtcatggtccctctgtgaggccagtctatagtctaaggtttaggtgcagatgaaaatcagaagtgactaagaagagctctctgctcgttttgggagacagctacctcctgtgtcaagtgacaggagtgaaatttgctacctgccttcttttcagaatgaataaaaactggatccatctagaaaatccattcgaaactgatctccatgcttttatatttaggcagcattcacctcacaacaataacacatttgctttactgccagaaggggccttggagctcatcttgagggcttgttggagcccttagctgagggggtcacagacaaccccttctaaactcttggtctgtggaaagcattgtcttcaactgtctgtacagatttggaagagaagcagacagtgagggaagacacacctgcttggccatcagaggtggacgctcagctcatcaagactgtcactgatgacctgggagatggtggcaattcccttgattaacttaaggcccaggttcctcatctgtgagtggggatattaacagcttccctacaaacttgcctggaagaggagcaatgtttgtcaagtccttttcatggtacctggtgtgagaaatgatcaacactgaaagctattattgttagctagagagatgtctttatcttttcttttcttttcttttttcttttcttttcttttttttttttttttgtgagatggaatcttgctgtattgccaggctggagtgctgtggtgcgatctcagctcactgcaacctctgccttctgggttcaagcaattctcctgcctcagtctcccgagtagctgggactacaggcacatgccacgacgcccagctaaattttttttttttgtatttttagtagagacgggatttcaccatgttagacaggatggtctcaatctcctgacctcgtgatccgcctgcctcggcctcccagagtgctgggattacaggtgtgagtcattgcacccggccagctagagagatgtctgaatgaattgcagtggccatgagagggataaatcgagcaggtagatcactctccccactgcaacagcatccattttaccccctatattttacaggtaaggagaatgaatttcaggtgagttagcgggttcgtacctaatggcacattcaggactcatactcaacctccttgatccatgattcagtgttctctctgctatcttgcactgcctgccaaaaaattcaggtgaccacagacaaggacacaccaggagcgtacctgagttgacagtgagatgactgataagacgtccccagcatgaggttttaaccatggacatagatctttggactagcaaagccaggtctcccgttataagtggaccatcctttctgagttccagacactgccttccatgtctgttcaccggcactcaattggtacaactgtgagatgcatgatgctaggcaacctgtcttgcagaaattttgacagtacacattttaagccttaaaaatctccccattggtgctcacgtgagtctaggcatgggatcaaatgtcatagaactacacgcacacaaacacacacacaaaccataaacagaagggaggggctgggcccggtggctcacgcctgtaatcccagcactttgggaggccgaggcgggcagatcacaaagtcaggagtttgagaccagcctggccaacatgatgaaaccccgtctctactaaaaatacaaaaattagccaggtatggtggtgggcgcctgtagtcttggttactcgggaggctgaggcaagagaattgcttgaactcaggagatggaggttgcagtgagccaagatcatgccactgcactccagcctgggtgacacagcgaaattccacttcaaaaaaataaataaaaattaaaaaaaagaagagtgtatgtaaaaactggtgaaatctgaatgaggtgtgttgtttagttaatatagtattgtacctatgtcagtttcctggtcttgtgtgattaaataacgtgttatcattgcagggagctaaggtctttctctactagctttgctactccttataaccctaaaattgtttcaaaatgcaaaaatattaaaaatgcaagtcccctactttgctctgttcttccagaaaattatcctaaggaaataaagatgcatacagaaaaggccataatgtctaccataagaggttttaaagtaaattctcacccagctgcttggtgggtgagggcagtgggtcatggtgagtgagggtcagcttggctgggtgaccttgtactgcttatcttgctcagcctcagccgagctacttaatgtctctgtgccttgggcatctcatctagaaaatgaatgtaatataataacatctatgtcatcccatatttgtgtccagtctgtacatgtaatttgtgtgcaggatagaatctggcaccatgtatgcgtctcagtaagtgtgagctagaatcatgttcaagaagaacactcatgacatgagaaaatgttgctgttagtgaaaactggagacgagaaagccatacttatactattgatgctatttttgaaaggcatagagatgtgtataacagtggctagaaaattttgcccaaatgttatcagtaggtggtgcatttttgttttcctttctaaactctgccatgatttctaaaaactaactcaatgagcactagtatgttgaattttaaaatgagaataaaatgtgactctgttaagtacaaatggccagataacatcgcgtctcagctgctttgcgtgtttaacctcagcccttatcattatttctgtgctgcctgtaagccgcagaatctgtctctgagatgctgcatttccctaagaaaggaggaggagtgagacgcctctggggtgtgtggttatttgctgttgttaatatcagggatggtcacgatcaccacagtccggaagtgcatgcagtctgctcgtaaaacatgtgcaacactctagagcatgcagggtccgggagccagcccagcagagtggtcagtcacctgctccatggggaccagggtctgctccaacttccacactctgaatccagccccagacaggagtctctaagcggacatgggctgacaaatggagctgcatcagcactgttccagggagagccttgtggggtccaagcccattttctttgcttccaaattttcctctctcctgtaatggagctagcctgcagtggctaggcttctcttctccagcctgtttgttctcctgaaggtctctgatgggcatttgtgggcactcaagccatttatcccactctcctccaggttgctggccctcaacaggctttggggaaggaacaaggggccacctgcccctgaaatttagggatcaggctcagcagagctgtggtagtcagttaggcacccagcaaacttgaacttctgtgatctaaatagacatcccctctcccttcaagagcctgctccaaccctgttggcaagtatagtgctagtgaagcccccagcccacccccaaggtctctctgcacttctggttctcatccaggaagaaacctagatgtcagactgcccactgctgtgcgactaggggagggagggtagagagaagatgggacccagtctcaggctgcctctgcctccatttattggagggtcccagagcccaccacatccaggctgaaagaagggagatcccccccatcccagattacattttgggaggttaaaaattctcctccttctacatcctgacaaccatcccctaaaccccagaatgagtgtctgcttgtagcacttcgtgtaaaactcaccgatggctttccatagaattagaaacgaaagccaattcctcaccaggccggctggctcgaatcctccgtgacttaccttctcccttcctggctctgctcagtccccttggccttctgtctgctcctgggatgcccacgcttgcccactccgggcctttgcagatgctgttccccatgcttggaaaactggcctcctccccactcaccagccaccagccaccactctgcaggatgggtcagtgtttatcaattcagagcttcgctgagttcctgtgaagtcacccccagttgctttcttcatagcactggtcacaacaggtaattcctttatgtctttgtttgattactgtctactcccccaccactaggaggtggctccatgacactaagtgcttgtccttcatggccacacacatctccccagtgctaagaatatgcagggcacgtagtaggtgctccgtaaatcattgctgggtgaaaaaaggatggaagaatgaggtcttcacttgatagaacacaggctcttggttgcatataaaaatttgcttccccagagaagaaagtgattctgctcatgtcttagggtacagggggcaggactgctggtcatcctagcctaagagagtccagtggtggggacagacatgacacaaaaaaggacaatagaggctgagaagggcaacagcaggaatggcccaatgtacccagaggagggtggatttgatttaattctaatggggtgggaagggggagttagggatgataatgctcagaaggacttggaaaaccaaaggtgatgtggcaagaggcatatgtgggaagggcaggctgtgaggccaggtcaaggcagggaagtgtgacacagcacagtgcatagtgggactacctgcagtgagccccagctaagagagtgggcagctggctggaaaataaggcagaagctgactgggatattttttcttgcttccttttctctttaacacttgccatcaactaacaactccatacacttgactcatttatcttattttgtttggtgtttgtttattttgagacagggtctcactctgttgcccaggctggagtgcaatggtgcagtcatggcttactgaagcctcaaactcctgggctcaagtgatcctcttgcctcagcctcctgagcagctgggatgaaaggtgtgcaccaccacacctggctaatatttgaatttttttgtagagatggggtcccactgtgttgcacaggctggtcttgaaatcctgggatccagtgattctcctgccttggcctcccagagtcctggaatcacagatgtgagccaccatgcctggctcatgtatctatctatctatatctatatctatatctatatctatatctatatctatatatttgtctgttttaccactaggatggaaacactatgagagcagggatttcaccattttaaaattgtattcccaatacagaaattgtgcttgacacatagtaattactcaacaaagagctcttgagtgaataagtgctgccgatcttcggcattgaccagtgagtgttcaacaggcgaagcatcggtgcctgatagtcttaggtgttatgtgaataaatgttcttcattttcacagagatttttaaaaactcactttggtatgatataggagctggcatccaatctgtgacttcatagatgttattgcttagagtgaggccaaattaaaaaaaaaaaagttgagttcttttaaagaaaactatttgtatagcaaagtacaaaatccaggtggaaaatagcacacccaagacagatacaaccaaactaacattctagaaagatggctcaggcaataccctggggtgtaggtcagggtacaggagaggaggctgttccattggtccaaggcagaggaaatgaggcttgagatgagggctggggctgcaggcgagaagcagtggggtgaaaggagctggctggaccgggagcaggtgaggaagctggcaggatggcccagaaggtgtcgtggctcccatgggtatttatttatttatttatttatgagacagagtcttgctcttgtcacccaggctggagtacaatggcatgatctcagttcactgcaacctctgcctcccaggttcaagagattctcccgcttcagcctcctgagtagctgggattacaggcacctgccaccacgcccaactaatttttgtagttttactagagaccgggtttcaccatgttgccaggctggtcttgaactcacaacctcaagtgatccacccgcctcggcctcccaaagtgctgggattactggcatgagccaccacgcctggctggtcttcttttaagacttagcacaggagcttctacatggtagctactcagtaaatatttaacaaatttgtggatgaatgagtaactgtgagtctcttcatccaaataatccgggggacttctcatgcccttctctgggggaaagatgcctctatagaggagacaattagaaggaggccagggacactgcagagggacggcctgccccgcctgtcaggctggctgcagtggagccctcttctggccagcctttgccgcttgcagagtgacaggttcaaagaatgagaagttcctgcagcagatgggaaaatgatgagggcagggcctggcctcaaagacaatttcattgacactcccattaatcacctttggccctgagtccttgggggcgttgggggtggaggttagtggaagggaggggccagaatgctcaactaactcagtcctcctcctgacagtggagagggctgggagaaggactccatctcttaagttgctcatatggacttttcacgagttattccagactggctgcagaaaacatcatgcacaatcctaggtgacattccaggagggaccaggacagtctgcctgcccccaggcagtcacattgagggcagaatggccagggagggggctaatatttggagagtcccttccgtgtaccactcaccacagcaggagctttacatatgttgtctgaggtcattgccacgacaactgtgcaggatgggtagtttttgcagatgaggcctcagaggtttgggggactgagctccttagtgagggccagacagccagtaggtatcgtcactggaagtcgaactgggctctttcgaattctaaaactcatgttctctctaatactcacagccttactctctatccaaaatagacctctgggctctgtgcctaaagcaatagaaaatgtagacaaaggacatgatacttgggacagaactattttgggatgtttttgtggctagatgctctggacctggggagaaagccttaagacaaaatctgttaggtcaagggcctcgggtggataccttatctgtttatgcaacccatagggaagggagctccagcagaggatacagcacacgcaaaggcatggaggtgtgagaatggcaatttgttcacagcatggaaatgagagaggggtggacgtgcccagagggacgagctgggctgctgggcccttacagtc

SEQ ID NO: 12778 - DNA, 35064 bp, Human
  misc_feature (1)...(35064): n = A,T,C or G
ggcacacaccaccacacccggctaatttttgtatttttagtagagatgaggtttcaccgtgttggccaggctgatatcgaacccctgacctcaagtgatccacctgccttggcctcccaaagtgctgggattataggcatgagccactgcgatcagcctacaaatagcagatattgtgtgatagagtttgtcagggaccacaagacagacacacactcagtggtacagctgctccgagttctgtttccaggggatgataggtcatccacatgcctggtgggaaggatggagctggtgttggggtcaggattggagaggctgattcctaattcacattcattagtgggttccaacagctggatcttgttttccacctgtcgtgtgaggaagtttacccttctttgttatatcatgtcttgtgcaccacttctcaaggttaaggacatggccagatcaactctgaagaaattccccagggttgagggctgccccttgggagcagacaaaggagagaagagatgataaccattagacccgctggaaaaagctattcagagcttaaaaaaatgaaaacaaaaccacaaaaacctcatctatgtccagtgttttttgtgtgcatattctggagtatcatttttaatttgatcctgaaaactgccttgtgaaggtggggaggatgtattgttgaccctacaggctcagacagcaacaaggccagaatcacataggttgtaagttgctgaatgggagctgcaagtccaagtctttgactctaaatccagcgctctgtccagagccccgctgctgcctctgttggcagctgaagctgtcagtctgctgccccctgcccagttcagacagggtggctggaaatggaccaaaggatggaaaaagagaataagagcggacttgaagggaactgaaagtatttgttaaggggaaagcagaaggaagaaagaaagaggcatgaaccctggggcctggccttgaagcacagtgttccaggggaggggggatgccgctgtccccacccctccatgggggcctaagcagatccagagctgcctggccttcctggagggtggcgtccaagcatggatgggaaggcagcaaaaataggcccatgtcacttctgggagaagacaaaagagggaagagaggactactatagaaaagtagaaaaagaggaagggagggaatctaggcatacagatcggaaatgtggagcaaaacaaaatttttttttttttttttgagacacagtgtcgctctgtcacctaggctggagtgcagtggcgtgatcttggcttaccgcaacctccacctcctttgctcaagtgattcccctgcctcagcctcccaagtagcttggattacaggtgcacgccacccagcctggctaatttctctatttttagtagaggtggggattcaccatattggccaggctagtctcgatctcctgatctcaagtgatctgcctgcttcagtctcccaaagtgttgggattacaggcgtgagccactgtgccccgtgtgaaacaaattcttatgaaacaaatttaatttacatgtgcttaaactttggtgtcaacttgcatggaatccccaggcttgctagatttttctagtgcctccagcccttaggtctcttcctatgttctctcagctactcctcctttccttcaacactgttagccgcttatccagggccctacgtttcagcccactcctcctccagcccctctccactccacctccacaatgtctgttggaatggaacagttggggatactggctgtttggcccccatgggggtctctccatataggattcagagaattggaagacttcttgggctgaagcagagaacgggatgcaattttgaaactggctttgtgagtcactgtgaacttcaagcaccctcccacttgaggtaagcttcaccagtttggcttgtgggaactgtcagaccagctccaggcgctggggctttctcagtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggtaaggaggtcctacctggcgtggggcgagggagggactaggagctgtgcccctcagggagatcagagccagagcctctgcttgtgccacatacacagtcatctggaacttgactccgagcagctcctgacagctctgacagtctaaatcagacaggacaggctggcagtgcactgggaggtctgtgagaggggtatctggccctgccaccagcaatccaggaagtcttgggtgaggagattccttcccactggcttcaatttacccttccgtgtagtggagagagaagcctccttccagccgcctgtaaagatgatgaaaattgcatcctccaattgtggcatgagagaagagaagcagtcccaaggaagtgggtggttctcgagctcagagacagatggatggacccctgaggcaggaaagctgagcccagggaggggagggcgaggccagcagccaggaagaagctggaaggcatggtccctcatctccccggcttcttcagccatccagatgccacaggagcctggaaattattagggacatgcagggttggggcagaagaaggagacaatatgaggaagctccacagcaaacctaaagctgtcagccaggcatggagccatctaacatttactcctggggatcccagctgagggctgctcccctctttctccagttctggggtccaggatgctctgaaacctggatcccgcatttaatttaattgaattaatttatttatttcatttttaatttttatttatttatttattttttgagacagagtctccttctgtcacccaggctggagtgcagtggcgtgatcttggctcactacaaactctgcctcccgggttcaagtgattctcatgcctcagcctcccgagtaggtgaaattacagacgtgcgccaccatgcttggctaatttttgtatttttagtagagaccaggtttcaccatgttggccaggctggtcttgaactcctgacctcaggtgatctgcccaccttggtctcccccatccaaagtgctgggattacaggtgtgagccaccatgcccagccagggttctgcattttagatcagtgactctgcaggggcttcacggaggtggagagcgtggaattagaggagggtacactctgggcacaaagaggggaaactgaggcatagtgttgtgtgggttcagggccaggtagaagccccatatgcaataaagtcccatgcccaggtactcaattcagttaccgagtccctgagcattcttgtgtccttcaggaagacacagtcaaggctcaggtggactcaacatttgtaaggatgcaggcagcctagggcagagcatgatgaggaacagggagcagggagggaggagtggagcctgcagctcttgtgggtgggttggggggcctagtggcccaggattctaggcaggagagctaggttggaacctggtctaaggatccttgaatgcagctcagacagccgaaggaggactgatgggattggtgcctggctgtggggatgagagtaacagagaagctgaggttatgaccctgaggtcatgagcctgtgtgacagagggcaatgctccctccacccccattcccagggcttcagcaccatagctgggcttggctatgccggcccttgcacggtgaagctggtgagtgacttgttaggcacagggagggatggacttgggtcttcctgagctgcttcctcctccatcctgtgtctatagggcaggcctggcataagttgactgaagctgctctatttctttaatttttaagctttttagtttgaaataattgtgaagttccagggaagctgcaagaatagttcaaacgattcttgaatttctttcatctagattcaccaattaacattttatcacatttactttatttctctttctctagctgtatgtatatgtgtgtataaatgtacaataatttttgctgaaccacttgagaacaagttgtgacattatgtccccttactcctaaatattttagcacttatatcctatgaacaaagacattctcatgttactacagcacaattgtcaaattcagtaaatttaacattaataccatcaaatatgctttccatattcacatattaccaattgtcccaagaatatgctttattttttttttttgctgacccaagatgcaatcaagatcatgtattacattcagttgttatgtttctcatgttcagtctatgaccatactttaacctttcttcatctttcatgatattgcattcttgaagaagacaagccagttgttttgtagagggttccttaatctgggtttgtctgatgttccctcatatgattcaggttatcatatgcatttttatttattttatatcatcattattattattttttagagatggagtctcgctctgtggcctgggctggagtacagtggtccaatctcggctcactgcaacttctgctcccccgggttcaagtgattgtcctgcctcagcctcccgagtagctgggactacagatgcatgccaccaagcctggctaatttttgtatttttggtggagacagggtttcaccatgttggccaggctggtcttaaactcctgacctcaagtgatccacccacctccgcctctcaaaagtgctgggataccaggtgtgagccactgtgcccggcctattattatttttcaagagaggatctggttctttcacccagactggagtgcagtggcatgctcacggctcactgtagcctcgacctcgcaggctcaagccatcctcccacctcagcctccctggtagctggaactagaggtctgtgccaccatgcctggctaatttttttttttttttttgtagatacagggtttccccatgttgcccagggtggtcttgaactcccgggctcaggcgatccacctgcctcagtctcccaaagtggtgggactacaagtgtgagccatcatgcctagccatcatatgcatttttaaaattattttttctttaaaaaaatttttttctgtgcccattgacagcagatattatatgcatttttgacaggaataccacaaaagtgatactgtgtctttttcagcgcatcccatcaggagtcatatgatgacagtgaaatttaaaaaaccactttgtttactgaataatttaacaggagtactatttatgtaagatgtgcatataactcttgagcattgcgaaattcttccaaagacttcttctttcatgcagagtaaaagccatgcattttacaatggtgcgtgacctggcgtccaagacccactcctctttgtctctcctcttgctcacagcatttcagccatgttgcctgctggtcctggacctcgctctctgttgtatccacagttttctctgcctgggatgctgctcctttgctggctacatggcctcttccctcaacccctcagagttttgctcaaatacctccttttcagtgatgccttccccactgaaaatgtcagcctgccattctgcaaactcttagctctctctccacttaatttttctccatagtcctcatctccatttatgttccatcctgtttacttatgtttttcattttctgtctcccagtctcctcttcagccccctagactgtaagatccttgaggccagggcttttgtctgttttgctcaccgttgtctcctcaacatctagagcagtacctgccacaagtcaaccctcagtagatacttattttcacaatagcagccccctctctgttcccattctttctctggatatattttgaatagctctgaaccagggctattgaggattcagtggcaagtaagtccagggcccgtttgttcagagagcttgcgctagattgcctgagtcactgttactacagttgtgattagtgcctggtgcagtgccaatgcagtaggtgttcaaaacatgtttgttgagtgaataagtgaattattttcaggcatcttaacgggcagcctgggatgttttttgggttagacatattgggaaggagggatcttcaaatcattgcccagggaataggcctgggccctaaaattcattttagacccaaaattcaggtttcagttgtccgttctgaggaaaccccaaaggacacacaggctggaggctatgaatccccagatgctttacagcctgagttgagatctgctggacaataaaagggcacaggtgacaccttatagattagctccaagggttgccagctgtttgcgtagattgtgttggaactgtcacttctcagggagtggtgtctaactgcgactgctttggctgggatccaggcaagctgtagaagggctggagtcgtttttgctcttctcttcctcattgcacctcccctccaacaaagggtgaatggcaaagtagctggacacagaaaagagattggaattcaatgtaccctgggctacagcaccatccagaaaggaatccactgaaatcacttcaaggagagacagggcatgtcttgtttttttttttaattttttatttttatttatttatttttatttttttgtgagacagggtcttgctctatcacccaggctggagtgcagtgatgtgatcacagctcactgtagccttgacctcctgggctcaagcaatccttctgcctcagcctccttagtagctgggactacaggcatgtatcaccacacttggcttatttttaatttttgtgtagagatggggttttgctatgctgcctgggctggtcttgacctcctgggctcaagcaatcctcttgccttggcctcccaaattactgggattacagatgtgggccactgtgcccagccaggccattgtcttcacagacaaacctctcttattgaagtgcaacatacagaaaagtacacaaaattacaaatgtacatctcaatgagctattgttaaatgaacacactcttgtgtctaccacatgttctctcccattcattacttcctctgtcttccataaatatagccacaattctgacttctaacatcacagatttgttttgtccgtatatatggaatcaaacggtatgcactcttgtgtctgactacttttgctcaacatcttatgagatttatgtatgttattatttgtagcagatcattttcatggctgtatagtattttatcgcatgactatatcatagtttattcaccttttctattattgatgaacctttgggttgctttcaattttgtttttgctattataataatgctgtgatgagccttttgtgcatgcatgtctgttgggtatatctctaggggcagaaccatggagtatgtgtacgtaactctagcagatgctgtcaaactgttttcccaaagtggttgaaccaaaatagtgcatgagagttcccatgctgctttggggccactggcttttggttctgaaggtctgcagatggaaaattaaattgtggaaatgtggagcttggcaagaggccaaaggcaagggaattacagctctgtgatttctctggtatcctgcatgaaattctgacaatagagtcatttttaggagttatgtgagatgcattgttgaattaattaatttaaacggattcatgaagcccttgcttgggttgttcattttgctgttgtgacgtttgaatttcttgtctattctgcatattagttgcctgtaggattcatagtttgcaattttttttcctattctattggttgccttttcactctgtgaattgtttcctttactgtacatgatttttttttagtttgctgtaataccatttgtttattttgcttctgttgcctgtgcttttgaggtcttattcataaactctttccccagcccttattatgctccaagaactatgcaaggttttgtgggggaaacaaagatgaaacagatgtctattctacccttaagaatctttcagacagaggaaaatgggtatgtataattacaactataagggaagatggaaatgctatgtgtcattaacaggcaagatacatttagaataaaaaaggagctaagaagatgaagattccttcctaggtaggaacactggggaactggccttgaagaataaataagagtttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacccaccttccctgttcctttctgcatacaccaggcaggccttggctttttctttcaatggcagctcccacccaccgcctctgggcagccactcctaactctgcagggcagaggaaaacatgctttccttatgcttgcctcacaccctgggcacacctccatagcacattccatattgcatttcagttggctgttttaggtctatcttcctttttcactttttttttttttttttttttttttaggcagggtcttgctctgtcacccaggctggggtgcagtggtgcagtcatggctcactgcaacccctgcctcccaggcttttctgatatttagctaaaagttgggtttagctgagatgagtgaggaaatctacaaattcacttgctatggtaatgtttccacaatgggcaagtcatattttgcttttatcaaagtacatcttagttaatagtcagaacagttgagtgagaggtagtcattactctttttctgcttttttaccaagatacaactcacagctgtgtgcacaaaatttaaatcaacagcttgatgaacttttatatgtgtaagtacatatcaaaactacccacatcaagatgtaacacatttctagcacccagtcattcctttttggcccttcaagttgataacccccctcctgcaagggtaatcacattctaacctctctcaccatatattagtttttccagattttaaactttatatcagtgaaataattcactatgtactttttggagtctagcttcattaatactcatcattgtggtgagatccatccacattattgccaggaaaagtagcttttctttttcattgctgtgtaatattccttataagactataacacgatttatttgctcatctaatcgtgatagacatttgggttttttctcattttgagttattatgactaaagccattattaacactcttgtacatatttttagtggatataaacaccagattttctttttttttgagacggagtttcactcttgttgcccaggctggagtgcaatggcatgatcttggctcactgcaacctccgcctctcagatttaagtgattctcctgcttcagtcttccaagtagctgggattacaggtgtgcactgccacgcccagctaattttttttcttttttttgagatggggtttcaccatgttggccaggctggtctcaaactcctgacctcaggtgatccgcctgcctcgacctcccaaagtgctgggattacaggcatgagccaccatgcctggcccagattttcttgtgtacaaattcttctggatcaaagggtatatgtaagtttagttttagaagataccgtaaaatagttttccaaagtgctggtaccaatttacactctcactagcaataaatgagaatctcagttgctcccatctctgtcaacccttggaattttcacatttatttatttacatttattttcgagaccaagtctcagtctgtcacccaggctggagtacagtggcgtgatcttggctcactgcaacctctgcctcctgggttcaagcaattctcctgcctcagactcccaagaagctggtattacaggcgccaccaccgtgctctgctaatttttgcatttttagtagagatggggtttcaccatgttggccaggctggcctcgaactcctggcctcaagcgatccacccgcctcggcctcccaaagtgctgggattacaggcttgagccgcttcgcccagccttcagacctttaaatgttagctattttggtgggaatgtgaaatctcattattctctgataactaatgttgttgggcacccttatgcatgcctattggctattggatattctctttcctaaagtgcctgcccaagtctgttgctttttttgtcattattgtcatcagtgtattattgatttccagtctattattgtcatcagtctattattgatggaattctttatatactctggatatgagccctttttcaaatgtatgtattgcaaacattttctcccagtctttggcttgctttttcactctctcaatgttgtctttcaccaaacagaagttctaagttttagtgaagtccaatttatcaatattcttttatggttagtgatttatttttgtgtgtgtgtgtcctgttaaagaaacatttgttgtttgggtgcagtggctcatgcctgtaatctcagcgctttgggaggccaaggcgggtggatcacttgagcccaggagttcaagacaagccttggcaacatggtgaaactctatctctaccaaaaatgcaaaaattagccagtctcataatctggtctcaaaataaacataaaaatagattaaaatgtaaaaataaaaaaggaaacatttgtctatctcaagatgtagaagatattctcttgtgctttttcctggaagctttataggtttagctttcatatttaaatttatgatttgttttaaattaatttttgtatatgatatgagggagatatcaaggttttttttccttatagatatcaatttgaccaagcaccatttattgaaaagatcaagtatgtgttggtttgtgtgatattgtgaaatatatatttggttttcaacctcctttcctggcatacaattcctaaaatttttagaaattccgaagtgatgtctttttgtaggctaatgaggtgaccgatggctggcagcctgtaggcagcttcgggataggggccggtcaccagaaagaccaaggcagggttggaatattggactctgagcccgtccccaaccttcaggaaaaggagagggattgaaggttaagttgatcaccgatggccagtggtcaatcattcccatttattgaggcctccataaaaacccaaagaacaaggttcagagagctaaacatgcggaggttcctggagggtggcacgccctgggaaggcatggaaactctgtatcccttcccctacaccttgtcctatgcatctcttcataggtaccctttgtaataacctttataataatccagtgaatgtgtttccctgagttctgtgagccatctagcaaattaattgaacccaaggagggaataacgggaaacccagtttatagctagttggtcagaagcgcaggtaaaacaatctggagcttgcagttggcatctggtggatatctacaggtagatagtgtcagaattgaactgaattagaggacatccagttggtgtccactgaagagctgattgcttgcttggcacgtgggaaactccccacacgttggtcacagaagtcttctgtgttgattgttgtggtgtgaaaccagaggaaaaacagttagtgtttttcccacacacagggtctatttctagactattatattccatcgactacttttcaatccttgcaatactggaatgctatcttaatttctgaagttttacaatatatcttgatattaggtagtgaaaaccttctagctttgttcttcatcaagattgccttggctattctatgtcttttacattttcatataagttttagaatcaacttgttaatttctataaaaataacctgcaataatttttattggaattctattgaatctataaattaatttaggaagaattgacatcttagcaatattaagtcttccaataaaaaccatggtatagtctcctgtttatttagctctttaattttttctcagcaatcttttgttgcaataggtgtataggtcttaaatatttcttcttgaaattatttctatatattttatcttttttgtgctgctgtaaatagtattgttttcaaaatttcatttttatctgtttgtactaatatatagaaataaaaatgatttttgtatattgaccttatatctagcaattttgcaaaactgacttctacactcaaataatttttcatatagtcctcttggtttcctatatacacaggtatatagtttgtgaataatgacagtttcacatattcattttttttttgagatggagttttgctcttgttgcccaggctggagtgcaatggtgccatcttggctcactgcagcctccgcttcccgggttcaagtgattctcctgcctcagcctcccgagtagctgggatttcaggtgactgccacccgcctggctaatttttgtatttttagtagagatggagtttcactgtgttggccaggctggtctcgaactcctgacctcaggtgagctgcccaaagtgctgggattacaggcgtgagccactgcgcccagcctcacatattcatttctaatttttattccctttgactattttccttgttttgttgaactagccatgacctccagtacaatgttgattaaaagaggtaattatggaatcctttttctgttcctgagtttgcagggacatggatgaagctggaagccatcgttctcagcaaactaacacaggaacagaaaaccaaacaccacgtgttctcactcaaagtgggagttgaacaatgagaacatatgggcacagggacgggaatatcacacaccagggcctgttagtgggtgaggggcaaggggagggaggcattaggacaaatacctaatgcatgtggggcttaaaacctagatgatgggttgataggtgcagcaaaccaccatggcacacgtatacctacgtaacaaatctgcatgttctgcatacgtatcccagaacttaaagtaaaacaaaaaaaaaaaaaagaaagagatgggtacaaatgtgaatgtttgttgttttgaacaaacctctccaaccatgtttttcctctgctcccacatcaaaataataacaatcatcaacatagaagacttctgtgaccaaatgcagggaggtggatttctcctcacagcaaactgaataatgtattctgcagtggacaccagctgggtgttctccaattcagttcagacactaactggagagagtgtcagaccacagaggctgggggctcagtccccaacaccacccctccaccacaccagttctaagtctgggcctccagaacttcggaccaaccagcttccagttggggttctcacaaccccctccttgggttcaattaatttgctggagtggctcacataaaccagggaaacatttatgtttgctggtctattataagagatattacaaaggatacagatgaagagatggcatagggcaaggtatgggggaagggacacgaagcttccatgccttccctgggcacactgcatgccaggaatctccagctatctggaggctctccaagcccagtcctcttgggtttttatggagacttcacttcataggcatgaccaacaaccttgtagaaatgtgactggatgaaaagggtatgattccatactaacaggctgagtggagaaacccagcaaggcctgtctgttcagattcttcttggtctctctgtgtagcatttctttctctagaatctgaggcaggaacttctctgaaatgagggtcttttgatttatatcagattagagttgtctacactcagcaatggtgatcttcttgctggtcttgccattcctggacccaaagggctccatgctgtctgcaatattcatgccccctttcaacttgccaaataccacacgcttgccatccatccattcagtctcggcaatgtagatgaaaaactgggaactatttgtgttgggtccagcatttgccatggacaagatgccaagacctgtatgcttcaggatgaagttctcaccatcaaatttcaccccatagatgaacttgccaccagtgccattatggtgtgtgatgtcaacatcctggcacataaattctgcaataatcctgtgagagcaggagctcttgtaaccaaatcatttctctctagtgctcagaacacaaatgttttctgctgtctttggaactttatgtgcaaacagctccaaggagacacggtccaagggttcatggtcaactgctatattaatgaacatggtggggttgactacggttgatagcaagagactctaggtggtgaaggcacctccaaagcaccaggtatatacattttaacacttttatttaatgaatttacttttggctttgctaattttctctattgtgtatttgctttttattttattgaagttagctcttacatttactttctcctttctcctttctctggattatcatcatcatcatcattatttgaattactatttctttttctttggtttcttgagattgaatcttgcattattgacttgcaaactttctttcttttccaatatacaaatttaaagctataaatttccctctaaacactgccttagctatattgcacatttgatactcattatcactttgctctaaatatttcccaaatttcatttgatttattctttgactcatgggtttttagaaatatgtttcttatgttttaaacattcagagattttctggttatttttctgttattgattttttgtttaattctactgtgcttagagggcataattggtatgatttcaatactttgaactttgttgacacttgttttaatgcacagcatatgataatactttggtaactattgcatgtgcacttgaaaagaatatgtattctgcaattgttaggagaattgttttatatataatttatatatatattggtttaatgatcttcaaattcttatagccttattgatttttttgtgtgcttcttgtagcagctagagagacagatgtaataaaactctccaactatagttgtggatttacttctccttttagttctatcaaattttattttatatattttaaacttgttatatgcatagaaactgaagatgattgtttattcctacttaattggttcttttataatgatgacatttccttctatttctgtatattttttatacatcttatgtctttttttgttcattttctccgttattgccttcttttgtatttaattgatatttttgtgctgcatctttttgattcccttctcatttctttttctgtacattttgttattttctcaatggttaccacaggtattacaatgaatacctccaacaatatagtttgaattgatgccaattcagcctcaatactatagaaaactcctatacagctctatccccccacttttattgtcacaaattacatctgtttctattgtttttcacttcttgtgcctgagtttccattttctttatatctaaagaacatcctttggtatttcctttactgcaggcctttttgtgacaaattctttccgtttttaattttttctaaaaatgtctttatttcagcttcatttaaaaaattattactattttttgagacagtctcactttgtcacccaggcaggaggggagtggcaccatcttggctcgctgcagccttgacttcctgggttcaagtgattctcgtgcctcagcctcctgagtagccgggattatgggcgcgtgccaccacgctcagctaacttttgtatttttagtcgagatggggtttgccatgttggccagcctggtctccaactcccgacctcaactgattcacctgcttcagcctcccaaagtgcggggattacaggcatgagccactgcgtctgctttcatctttgaagtaccgaaattctagataggcagttattttctttcagcactttaaatatatcattccttggaaaaccaaacaacgtatgttctcactgatacgtgggagttaagctacgaggatgcaaaggcataagaatgatacagtggactttggtgacttgggaggaaaagtgggaggggagtgagggataaaagactataaatagagtgcagtgtatactgctcgggtgatgggtgcaccgactcacaaatcacctctaatgaactttctcttgtaaccaaacaccacctgtaccccaataacctatggaaaaataaaaaaaaaagataccattccatcatctgctttttattatttttgctgaaatgtcagctaagttgtttgttttgtgaagggaatttagttttcccccactctggctattttacgatttttctatttatctttggtttccataatttttttgatgtattgagaggttgtcttttgttcattggtttgttttttttctttttttttttttgagacagagtttcactcttgttgcccaggttggagtgcagtggcgtgatctcggctcactgcaacctccacctcctggattcaagtgattctcctgcctcagcctcccaagtagctgggattacaggtgtgcaccaccatacctggctaatttttgcatttttagcagagatgggattttgtcatattggccaggctggtctcaaactcctgacgtcaggtgatccatccacctgggcctcccaaagtgctgggattacaggcgtgagccaccgtgcccagcttgtcggtttgttttgatcttgcttggggtttgtaacacattttacaaatctatcttgatggcttttgtcagttttgggaaattcttatcttttatctcttttgcttagttcctctttcctctctcgtctccttgctttccaattacacttagtttaggggttttgttttgtttttgctatatctcaaatatcttttacactccttcttgtgtatttttatccttttgtttttctttacttcactctggatattttataacagttttctaattctcttttcaatggcatctaaatggcctttttaacctttcaattgagtttgttttacagttattttacattttatttctgtaattttcattgaattctttaaaaaaaatccaatttcaggtaactattgctgcataatgacctactccaaaatccagtagtttaaaacaactacctatttagttagtgattctgctagttggcaatttgggctgggctcagctaggtggttcttttggtttcctcttgcatcagtcatgcatgtgtggtcagctgccagactggccacgggtggctgattcatttatttattttttattgttttttgagattaggtcttgctctgtcatgcaggctagagtgcagtggcatgatatctcggctcactgcaagctccatctcccgggttcaagcagttctcgtgcctcagactcccaagtagctggggttacaagtgtgtgccaccatgtctggctaatttttgtatcgttagtagagacgaggttttaccatgttggccagggtggtctcgaactcccgaccttgagtgatctgccggccttggcctcccaaagtgctggaattacgggcatgagccaccgcaccaggccagggctagctgatttagaatggccttagctgtgttggcttatctctgtatcatgtgatatcttattctccagcaggctattttaggcttgttcacaggtcagccagatgaggttccaagagaacaagtagaaatgtgcaatgccttttcagatctaggcttagaactggcagaacatcatttttgctgcgtttcatcatgaagaccagcccagttccaagagacagggaaatgaaccccatttcttgataacagaaggagctgtaaagtcacattgcaaggacatggtatttttgcattctatcacgctagttctctgctgaaattcttaaacttatgttttatttccttgaacatattagacatgattactttaaagtttatgactgacaactctattatgtagatgccctgtttgttggtttctgttgtctctattcttctgttggtttttggagatgtttccttttcttatacttcactttggatattgtgtatgaaacattctaggaataatttaatgctctggttgatgttattttcctctagtcataacttatatttgcctctagttggcagccaggttagggctaccagagattccagatcattagttcaatccagggttgtgatgattcaaaattgagcttcagttcctgtgagggctgttcatttctcgttcactcttactctttgggtatagccctctgtggtaccaacctcaacactgatggattttatgtatacccgctttctaataggagggacgtgaacttcatgttctcttagttccttgagttttattgtgagctctgctcagcttctcagccttttagctgccatttatggaatcagaagatgcctccagggaacaacagtcagaaatgctgatctcacctctctgaatttccttcttccagatattggccccataatttttcactgctttataaactctctgataactttaacaatgtgcttttacatgttgttcatttttcttctagctatttttagtgggaggattggttagcatgtcttaacctggattttcattacataattagaattccttcgatgattttttatctcaacaattaaggggatgctgtagaatgaaagtgttctgtttccagatcacaaactctctggagtcaggaatcatgccttatacatgaagaggccctgcctcttcaggggctggattgcagtgggactcagtaaggactgaataattgatgaagacagtatatgtcctccttgtaggtttagtaatgattttttccattcacctttgttctcagggtctttgtgcaatatttggtaggttgacttgttcttataaatagtgctaggatcgtaggagacagagacacagagatgcacagcacagtctctgcttttgagaagcttttggtttgctaatgggcagagccagtacaagtcatataaatataaatgggaacctatgtgttttagtcttaggagcatcaagatcaaagaaacatatttcatcaaacaaatagtattacaagtcctttaattatttacttagtctcttgagaaaatgccagggtgaagctgtggcttggagagactgcattcataatgcactggacatataaaaacccctctgtctcaattgctctcttcttaatagcctccattttaacggagccacttgtaaaactctccccatctcttattttctcttccaaatcctccctgagcctccccaactcacccagagagactttttaatttcctgcacctgctgggccatgccacatagctttattactaaaaatggctgtaggaacttccagttttgtacactgactgcacagaattgctctaggttgtcacacccccatattcattaggtttcatcttgattctttgagagggaagtgctgggatctgcctgggaagtgtagttttatttttaaaattgttttctagggagaaatttttgtggagactttctgatcactgaaaaactggcaaacatcaataagtaatgaccaaaatccaatgaaccaagtgccacgagagaggattatgtattcagctctgtgagaggatggttgaggggccatgagttcagcttggacggttagtcttcctgggcctgaccattcagaatttccaacagtcactacttgccattagtagttgcctcagcactgcttggagggagtcaccttagatgtggtatttatagcatcatggttaagaatttatcctctcaagccaaactgctgtctttacaaagagtaaacaaataagctccctagcacctgtgctcccagctactagggaggttgagatgggaggatcacctcaagcccaggagttcaaggctgcagtgagctgtgattgcgccactgcactccagcctgggtgacagagtgagaccctgtctctagaaaacaaaacaaaagaaaacaaaaacataacaccaaactgactaggtttcaggctcatcattcttttaactcatcataccttttaacttaaatagttaaaatgtataaagtgtgaaacctgcctgtcacatagtaagtactcaagattttagctattggtctatgggatccctcagactagggacacagagcttggggacaaggggaggcagatggaggggatacgctttaaggtgctcctaggttctgggctcctcatactcatccccacccaattggcttaagggaagtcacatccagctgcccacattgctcaggcctgacactcttcccgctactttcagcttgggttctctttcctaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttggtaagtctccaggactgttcatactgccctctctgattcctataggcctctaagttctgtatttccaatgcctttctgatcagaatctctgcttccagataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcagggtaagtggaacacactgggctataacaagcgctgaaggtttggaccccgcaaccaggctcatgtgcaagacagatgtggtatgagataaaatcccttggcctcctctcccagtgccttgtagcccttcccagggtagccctggcctccaggcacacagttcctgtaaagctaggcctatcctactctggaaaaaaatgttatccctatttccttctgggagatgcaagcttttcttctgcagagggagggcatagttgtttggtgagtgacagtcctgaaatggctcctgaacattattttcttcctgggagaggctgatggagaactgtcctctcctcttgagtgataactttctccaagccacatagttcaagaggtaactacactgtgcagcagtagcctggagcaggagcatcaggatgaccccagggatacctagatgagttcttgggctgttgcttatgctcatcctaagagttacctgagttaccgttccacaactttttattacataaacagggacttaatgtaccagcagcatgggcattataggaaaaaaaaaccatacagctctcattcataaggaacttatagccaaatggggcaacaaaaataactacttgtggacaaaaaagaaacaagactgaggcaggccgggcgcagtggctccctgtaatcccagcactttgggaggctgaggtgggtggatcacaaggtcaggagtttgagaccagcctggccaacatggtgaaaccctgtctctactaaaaatacaaaaaattagctgggcgtgttggcgggcacctgtaatctcagctactcaggaggctgaggcaggagaattgcttgaacccaggaggcggaggttgcagtgagtcaagatcatgccactgaactaggacactggcttcatcattcagaagctctgtgatctcttagaggtcaggtgtggtggctcacacatgtaatcctagcactttgggaggctgaggcaggtggatcacttgagtccaggtgtttgagaccagcctggacaatatggtgtaatcccatctctatttaaaaaaaaaaaaaaaagaagctctgtgatctctggcagattcattaacctctctgagcctcaattttcttcccccttgagtaaaatgggggtgataataagtacctcacaggattgctgttaagagtaaatgagataatgtttgcaaagagccttgtcagcccttggaacacttaattccttttccttcctcttgttggctggattatatatcaggctacatgtgtgacacaaatcttttaagtagaagttcaaatgaggaagagccatgaaggaaggaatagtggaaaagtgagacggaaaacttgcctgtacaatgagtattttttgagttaaaaacaaaggaatggataaatgtaacatttgttgtgctacatgtccctcagtatccatgacgaattagttccaggacccacctcgcaaccacagatgccaagatccacgaatgtttaagtccctggcataaacaggtgcagtttttgcatataacctatgcacacatccttctgtataccttacttaagtcacctctaaattagttataatgcctgatacaatgtaaatgctatttaaatagttgttatactgtattgtttagggaataatgacaaggaaaaaggcctctacatattcaatacacatgcattttttttccctgaatattctggatccacaattcattgaatccacattgtggaactcaaaactttggagggcaactgtattagatcatgtaattaacccctataggtagataacgttatccccttttacaggtgagaaaatctaagaggctctgaggcatcttccaaaaataagatgacttgagaggcccagagaggttaaataaatagtgcagagctcacagggttagaatttgagccaggcctgtctgatatatctatgctcttggcatcactcagaggaggttaaccaaatgagcaaagagaaaaccttgaccgtgagttctcagagcacgaggcaatcagccacaacacagagaaaagtgggttttgaggcagcccctgcagcaggcaggtgggaaggaagaagagagcgagctgacagctcagttctcacgccttctgtattcctcagaattcagattttggccgtttttggtgatcatcgtgattctaagcgcactgttccttggcacccttgcctgcttctgtgtgtggaggagaaagaggaaggagaagcagtcaggtgagtggaaggtccttagggtggtgctcctgcctgaggccttggatcctgtgactttgtcctgcgtccagtgggatgtgtctgggagcacagcatctccttttcctcaacgagctttggtatgtttgtgtgcgtggtggcggggggcaagcaggttgctaggctctctctcccagttcatgccttctgatcccaatgcgcagatttccctgtagacagctggtttgggaggaggtgtgggaggggcagttcggttgctgcctctgtgctctttggggttcctgggaagagcattaacttgcctcctttctagaaccttttttaaggtttggccatttggggtagaggtgggacctgttagaagcaaaagcccttctggaggtttctgcagctctgctctttgttttcttcctccctcagagaccagtcccaaggaatttttgacaatttacgaagatgtcaaggatctgaaaaccaggagaaatcacgtatgtcatcccggaggctggggtctctctcagctggcttggaaaatgctctttcaatgatggttattcagagcagagggacaaaaaggactgaacgactgtccttttgatgtgaccctcagcccttccccatctatcttttctccacctgcttcctagttctggtgatggaggaaaagaggaaacaaaaggagcagaggagatgaaagggaggctgaaggggcatcttggtgcagaattgcacctgctgagaagggatggagcacaacagaaatcaatgacagaggcagagtgctgctgtggtatttgttgtctgaccacaaattctttttcctaatgagtcagggcttacattcatgagtcccttaatggtgacacaggctgggaagtgtgaccagccaaagcataatagttttgtagctggctcaataggctgcattcacagccttttggaagaagaggcctgagtgtggctgaggtactagagagagtaaccagcctggcacaaagcccaccagcctgagtgggctcctccaggagcctctcgcctgctcttcgcagcaggcaggggccaactctgcctgtcatccaagaattagaagaggaggaaattgcagagggcctgcagatgcccccactgctgtgtctcgcttagggcagatgtggtgacaggcccaggggaaaagctctgatggagcctaccaaactgctggcaggaagtggggcagggtgggtgaagtggggcggaagtgccttctttccactgccccctggcgctttgctgtggagacccagcagcacgcaggaagcacatgtggtggggctcttccgcgctggccacatacgtgaggccctgtgcagcctcgcagagcaggcaagcatcctctcccagatgcctctgggttcagaggctgttagagcagctccccatgcctgtttttttatttttatctttatttatttatttatttttgccccagcagtggctatgggaatgtgaaaaataaagcagtggctattggaatgtgaataataaaaggggactttgtttctctcactgctaccagactctggtacaaattcctgaaagcatgtgaatctacccacagccagtgatgcccgggtgcttgctaaaaataatctatttttccaaaaagaagatgacttgagattaggagaccacaggaggaaaaacaacttagagcaaaggaaacctctttgggattcaggcctattagcttacttcttccgactcaagagctcctccctgcctggcctcagccctctctggcctctccctattgtctcagggctccaatttgaaggcctaaatctcaagtttcatgtggtctcactttgagacccagctctaatctttctagaaacacttcacacgggtctggacgggagagaaaagcaacaaactcctgcagtattttaaaacacaaatgaagttattgacattgtcagatgcccatgactccccagcctctaaggacagctgacagttctctgcttctcttagcttcttcttgcttccaggaattttgcttgcaccttgcctaatgaaccctgctgcctccactggctcccagtagaacccaaactggcaatatgctttcagtggccagcagcatgaaatacctccaccaccgatttcctaaggggtaggaacaagaaaagggaagcaggaagctctgcttcctgctttggcccttgggttcagggctgcacccagcactatagctgcccagggcgctgacttgaggtcaagggcaaggtggcctcaaagatgatctagagagggcttaactgtgtttggtctttgaaatgtttaaactttctgaatttcagtgctctgaggtaaggctcagataacagccctactcagagctctgcaaggaagggtttctaagttactaaaggaaagaaagtgacagcattctctttgagcagggttgctggaacccctcacacctaggtggttccttgctcctgatactaatggttccactccaaactgctcttcttcctgtctcttcccatcttgggaggatcaatgactctccccagtcctgccacctccctcccagtctcctgaaaagccctcttctttgtgctgtttttccccactcaatctaaatctggacagaccgaactgtcgctcatgttaccccatctccatttcttgtgcaggagcaggagcagacttttcctggaggggggagcaccatctactctatgatccagtcccaggtacctctccagtttctctagtccattccatacctatctctggggtttcctaatgcccccctgaaactcacaccattgaatggcagaataagatcttggtgcttctagaatccagaagatagcttggcttcagttgcattaacacattatttgaaaagatccgtgtgatactagagcatcttaacacagctgggaagcctgatgtggacattccttcttcttccgtgtctggcagaaggtctggcccagataaagtctataggagcagaaacctggttaggggactcaacttctgctttcttgccctgctgctgcttctaatacttggggcccttgcactttttatccctattccctattatattcgttttcaggaaagaatgaatctgcattgatctcttttattttattatgacttagcaataatgtccattttcttttcttttaaaacaattttattgtttagagacagggtctctttatttattttttatttccataggtttttttgggaacaggtggcatttggtgtcatgagtcagttctttagtggtgatttgtgagatttttggtatacccgttatgagacaggatctcattctgtctaccaggctgagtgcaatggtagaatcatagcttactgaagccttgaattcccggcctcaagtgatcctcccacctcagcctcctgggtagctaggtctgcaggtgtgtaccactgcacccagctgtattttcttactaaatctcacataacagcctcatgaaaatagttctaatactttagatgtggtctacattccatatcacaatgaggaaaccgagactcaggtcaactgatatctcaaggctacatagctaggtagtggcagagctgagccaaagggtttctgagtctccattgcacctcctcatactccacctcttatattctgggattacagaaattcactcataaactggagaagcatcctttaatactgatggctaaaatgacattgataacccaggctgggacatctctcccaagggaaacactgcctcctggtgcccagtaataaaagactttctgataaaaatggctttaaaaaaaagaaaaaaaaaattgagcaccatcttcagtttggtggctgagctgtggggcaaagaaaatctgattataagagcggttgatatctgccagttctctagtttcagccacattgaactccaatgagaggaatttctatcagtgcaagaaagaggtcccctcaaactatggtgttgggtgagaatgacagtcctcctctggagcatcttaaaaggagaatgtttacctgatttagaggacacctggttccagtccagggaagggaggcaagttgccaaagggaggcattgaggtgttgaggaaagagccctggagagtcttgggtttgaattctgcttctactgtgtacgcactgcctgacttgggctatttatccttttggagcctcatttgtggcatggggcaaattatgatcattcttattttataggagtgttaaaagagttagagaagaggccaggcgcggtggctcatgcctgtaatcccaacactttgggaggccgaggcgggcggatcacgaggtcaggggtttgagaccagcctggcccacatggtgaaaccctgtctctaaaaatacaaaaattagctgggcatgatggcaggcacctgtaatcccagctactcaggaggctggggcaggagaattgcctgaacccaggaggcagaggttgcggtgagccaagatcgagacattgcactccagcccaggcaatagagcgaaactcttgtctcaaaaacaaataaacaaaaaaacagttagaggagaatacatgtataagataaatgctcaacaaatagaagctttcattaatgacagagcgagactagcactcaggttgtctgacctcctggctagtccagggctcttttcactaacacttgaagcttccatctgggcagggttgaggaggagaaacggaagagataacctttgtaagattgtgctggatctgtgcttctgaaatgattttatttctcttctcattagtcttctgctcccacgtcacaagaacctgcatatacattatattcattaattcagccttccaggaaggtgagcctcttcccgtggtggtggtggggtgttgttgatgtagatgtgtattttgcatgtgtttgcagtgagagtgtgtgtgcacatcctggcaagttgttctttattgtgtgtatctgagtagcttctgttaaatgactgtatttaaatgtcaatgggccaatgagaaatgccttactggttctgtctggagaaaaataacagcttctagactaagagaacagtagactagatgagtttttgggagtttctgtgggaggtaaaggacagtcagagacagaaaggaggtgctttgcacagagagactacggggtacttagtaggtcagctgaggctatggtgagagatactggaggggtttgcaaggcagggcatattgcctggagctggaggagtagactggatctagagagacacaatcttgaccttcagagaccagagaaaggtcctggccagtcagtcacctgctggtggaggcctctggactgaggcaacccatccttttgcactgaaatccttctccaagctgagttcgtagctctcttgtgtacttggaaacagagttgggtatcctggtacacatggtcattgtttttctcttgtatggaaggggatgggaagagtggtgttcccaaggctggagccacagtgtgaagccagaaagccttaacatggtagtatgggaatttgggagtccacacaactgtggaagtccatgcaggtcagggaccacaggtttgaaggggtttaggacagattttcagacttttcattcaacctccttccaataagccattcaacctacttggatcccatcgtgagagagatttgtttttaattatatgctacaatataaggccatatagatgttcacaggcaccatgttcacctgctttggtgtatgtaaactctatatgctactgaatgtgcctctgaattctagtgtccttgggttggcaattatttatatgcctggattgtttacattaagggtgtgtgtatgcatgcgttgaagagatacatggtttggggcagtatttgcattaggattgcctgagggatatgtgtgtatgtgtatgtgtatgtgtatgtgtatgtgtgtgtgctctgggaatgtgtgtgtgtttatatatacacaatatatgtatatatatgtgnnnnnnnnnnnnnnnnnnnncacacacacatatgtgtatgggttttaggtgtatgtgggtatggaacagcaaattctgattttggttcagaaatatcatattataggcaaatactgtatatattgtgtcttccctggagaccataaacaccattgttttgctcctagggtgacagattctattcattttctggctgagagtgcctcagaatttttcctgggccctgagtctcttttgggacctctcacatcacttaggagtgggagagcacttatctcgaagttaagtattctttaccttctgaatttctagtctggatccaggaagaggaaccacagcccttccttcaatagcactatctatgaagtggtaagattctggaactcctcaatgggtttactgtctgttgcatagccctgaaatctagccatgaaagggtacacttaggaaaagatcattcacacagtctcagagttgtagggaatttagagatcttctaatgcaagtctttgttttagagatgaagacactgaagcccaaggagagtgagggtctgacccaagatcatattgcgtgtttagatatgatacttactgggcagcttgggttttaaattagggccgtccccgagctagttcccaggctgtgggccacaaactggacatctctcctttccaagagtgttcggaggaggggtcagagaggggaagataaaggactctaaatgattttctaaaattagcaagtctttgggagccattccaggacataggtgagcttaatcttcttcaggggtcaacactgttcagagatgaccactgagcctggtggttgaattgattcccatcagagcatttagggactggaaaggagggactcaacatttcttgggggtttattatggataaggtagcctgccagtgtcttcacatggattattttatttagtcctcacagaatgctacaagataggtataattatactttccatttatactcagagaaattaaggcatggagagcatcccccaacctcccccactacccattagcctcatactacacctgagcctccccacctgtggtccaataaagatgctgccattggtcagaagggagggatgggtggctgcctgctggaattcctggcacttcagctatcacccaacattaaagccaactggacaacccagggtcatagagggcactgtgtagacccaggtagcttgtgaggtcatgaaaaagcatatgtggttaagagagtactggaattggagccagaagaactagattcaagtccctcctgcacttcacactagtcgtggatcctgagtaatttgttttgtcactctgagcttcattttttaaatctgtaaaatggggatggcaagtcatacctcacaggattgtgataaggacctcccagtgcaagggtctgaagtttctccttttcttttgcagattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctgagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctccataccctgcatttttattctctatagcagccgaagggcacttgtgggccatcaacaaacacatgtctgtttgaacactgctgtagagggtctgacttcctggtgagctggcagtgtccttcagccctgttcacactgggacagcagagaactagacactaggggctattccatcttgtgaaggagagccaaggcactcacttggtcacatcctgcaggatccctttcccctgagactgtgctgctggccaggctggtttcctcctggagagaagtgtgaacagaccacatcttaaagcaagtgagaagcttaaaaaccaggcaaatatattcagaaagagcctgggggtccaaggcaggtactgggagttgagttgcagagtcaaggagtttagtgagtagaggcagcaggaaatgacggggttcagaaacagtccagatgaacaccagggactctgaccattgactgctgctggcctttcatgtgtcctgcatagatcttgaactggccagatttatttaaggagcagaagagaccctatggggtcagggcttttgaggatgctgtattctagaaagaaagatgtacaacgtcatcatgttatgtgtctgattgttgagcttccgtgacaatgcctcacaaagataattatccatgcaacaagccagtcaatgaacaagcagtaattaagctcctgctgtgtatgaagcactgcctgaactcctgggagtacccactgcaggtgacagaagccatactgagttcaggatcatgtgcaggagagcatgacagaggcagcacacaattaaaggacctagatgggctgcaaggtgatggtaacagaaatgtacactagagtatcacgaatataagtcaagtatagtgcatcttacaggcagaggagagggctgtggccacagtcttagggagagatactgtgggtattctgtgtccagactggacaataagaagggaagttcttttgggtaaatatgggaggcttatttgaaacaggcattttaagcacctttacaaaatagcaaagaagtaatacacacatatggttttaaaaaaatccagcagtacaaaaaattgtgcagtaaaaaatgtctctttcccaacttgagattcccagttcctccccagaggcagccactaatgttttttgtatttctttccatagcttttctatgcctatgtaagcatgtagacttacattttttcttttcttttctttttctttctttcttttctttctttctttctttctttctttctttctttctttctttctttctttctttctttctttccttccttccttcctttctttctttcctttcctttctttcctttctctctttctttctctctttcttctttctttcttcttttttttttcttgagatgaactctcgctgtgttgctaagggtggaatgcagtggcgcaatctctgctcactgcaacttccgcctcctgggttcgagtgattctcctgcctcagcctcccaagtagccgagattacaggcacacaccaccatgcccagctaattgtttttttgtatttttattagagacggggtttcactatgttgaccaggctggtcttgaactcctgacctcaagtgatctgcccaccttggcctcccaaagtgctggggttacaggcatgagccaccgtgcctggccaacatacatttttttttttaaatccaactggtagcatacaatgcacgtggtcctgaactttgttttttccactccataatgtatcttagagcccattccatattagcacctattagtccttgcttgcttcccaagcggcagggtttgccgttgcatgggtatataatcatatatgtaactggattctcactgaatgaatggacatttaggttatttcctgccttttattttaaataacactgcagtgagcatgatattatgtacatcttgtgtcatgtgtgacaat

SEQ ID NO: 12779 - DNA, 17807 bp, Human
cttgttcaccgagctccagggagcagcgcagtgctgggcacttagggaacactcaataaacatttgttgaataaatgaagacatattccctgataagttctccaaaagtagtcactattatcaatcttctggagctcttttctctaatactctttccttactgacatgggcattacctttcttttttttctttatagacagggtctcactttgtcacacaggctgaaatgcaatggcacgaccatagcaatctgtaacctcaaactcctgggctgaagcaatcctcctgcctcagcctcccgagcagctaggactacaggcgtgcatcaccatacctggctgggggcgggggaagggggggggcggtgtctcgctatgttgcccaggttggtctcaaactcttgcctcaagcaatcctcccaccttggcctcccaaagtgctgggattacaggtgtgagccgcggcgctcagccacgggcgttacctttcaaagcatccagattttatggcgttaatctccctgtttaaaattttctgtgatttggacacaaagatgggaacaacagacatggggtattccaaaaggcagaaggtgtggaggggggtaaaggctgaaaaagttgccgaaaggattagaagcatcacgcaatataccaatgtaacaaacctgcacacgcaccgaatctaaaattaaaacaaaacaaaaacacaacaaccaaacaaaaacctttccgtgatcatcaggaggctgtcatattctcaccccctacttcacgctgggaatcgagctgcgggctttacaacagcgtcagctgctccctttggcaacgaccagagaggtcctttctccagagatttttgtcagctctgggcacttttgctttgtgggcctatcttccactttataaaaaattaaaaatgctactttccactgcattcagtactttttcttctcttttcttttttcttttcttttctttctttcttctttctttctttttctttttctttttttttttttttttgacacagtttcactctgttgcctaggctggagtgcagtggtgtgatcttggctcactgcaacctccacctcctgggttcaagcggttctcgtgactcagcctcttgagtagctgagactacaggcgcccgccaccatgcccagctaatttttgtgttattagtagagaaggggttttaccatgttgaccaggctggtctcgaactcctgacctcaggtgatccgcccgcctcggcctcccaaagtgttgggattacaggcgtgagccaccgtgccctgccctttttatgtatgtatttatttatttgagatagggtctcgctctgtcgctcaggctggagtgcaatggtgcgatcttggctcactgcaacctccgcctcccgggttcaagcgattctcctgcctcagtcacccgagtacctgggattacaggcgcatgccaccacgcccggctaatttttgtattttgagcagagacggggtttcaccatgttggccagactggcctcgaactcctgacctcaagtgatccgtcagcctcggtctcccaaagtgctgggattacaggcgtgagcccccacgcccggtcgcgtttagtactttttaccaaaactaaaagaaattaaaacactttcgtgggtcctggacacttccggaaggatttgtttccagctgccagatgaggaaactggggctcgcagagccggcgccgcaggggaggggctgtgcacgaatccagtgggaaacctctctccggagctaagcccctggtccacccgggcatcgctccgggatcgactgggggcgttccttccgccggtcccctttgttcccagtgccgagcccgcggccctgcccttcctccaggccccgccccttcttccaggccccgcctcccgcccgggccgaggcgcgcggccgcgcgtgcgcccgcccgcctgtccccgcctcgcgcatgcgccgcgctcgctcgcgggagggcatggcgggggccgtgccgggcgccatcatggacgaggactactacgggagcgcggccgagtggggcgacgaggctgacggcggccaggtgaggcggggcactgggcgcaccctagagagaatcgttcgtctccgccgccggcgggccggccccactcccggagaggccgcgcggcgcgaggctgcgggcgtgcggggggtgtgcgcgcgcacggcccgcgcggtcaccgtgtggttcaagcacagcccgccccgcccccgcccgcccggggtcccgcggcgcggccgccggggtccccgcctcctcgcctgcaggaccttggggtgggggtgaggcgccggaggctctggcgcggggcggcccgaggcccccagtaccccctcgctccggccaggcccggcgccggccctgcgacccccgcggcgggcgggacaccaacgctaaggtggagggttgggtccggagctcacagacttttaaacaaaaataaagtggaaaaacttcacagcagcatcatgaggaaaaagtagaacttagggcattcctacatgtgctttactgttttataaactgtactcttcagcaccttgggctgatttcatctgtttttgggcaaactgatggaaaggattttcgggccttgaccttccagggtttggggtggaagcccaggagggatcactctgttccaccctgaggacagggactgcagagccagggcaggtagctctagtctggacagtgtgtccccaccttactctaaagacccaactgaggcgcatgattgaaatgtagcttctcacgtccctcccctggagacggcccaacagttggtctggacgggagcctgggaacttgcatttttttttttttttttgtggtggagtttcgctcttgttgcccaggctggagtgtaatggcgccatcgcggctcactgcaacgtctgcctctcggattcaagcgattctcctgcctcagcctcccgaatagctgggattacaggcacccaccaccatgcccagctaatttttaaaattttgagtagagagggggtttcaccttgttggccaggctggtctcaaactcttgacctcaggtgatccacccacctctgcctcccaaagtactgggattacaggcgtgagccactgctcgtggcccaggaacttgcatttttaacaacaatcaagattggggatgtctggtgcattttgaagtggtattataagggaataaaggatgaagtggggcttacgttgataaacatgggtggtggtgtgatggcggcttcggagccatggtctaaaatgccaaggcgggcgatgtgtttctggaactgaaagaagccctgtgatgttagctgcctggtggaagcagtggcaggaggtcagtagggagcaggttctgaagatccttggagagctgctgaatggtatggcttgttcaggagtttggggcagggagtgacacgagtagatttgcatgttggatcatttcacagtgttggaggcttagggtggagtggatagagtcagacttagctaactgagagcttgggccatgtgtgtcatgcgttatccccttccacacacaggattttgagttgggtgttaccctacttatctggtaagtgtagaaaatgagacgaaaagacttagtgacctgcccaaggtcatgaaactaataaaggaaggagaggggacccaaacccacatcctttgcctccgttgccacttcgtcaaattgctgactaccaaagtggtccagatgagaaggtgtgaattagcttagtggtaggttggtgtttggggcatctagtatatcaccttgagcctttttttctttttttttttttttgagacagagtctcgcttagctgctcaggctggagtgcagtggcttgatctcagctcgctgcaaccgccatctcctgggttcaagcaattctcccgtctcagcctcctgagtagctgggattacaggcatccgccatcatgtccggctaatttttgtattttagtagagacagtgtttcaccacgttggccaggctagtcttgaactcctgacctcaggtgatccgcctgccccggcctcccaaaatgctaggattacaggcgtgagccaccgcacccggccttttttttttttttttttctttgagacggagtctcactctgtcacccaggctggagtgcagtggtgccatcttggctcactgcaacctccacctcctgggttcaagtgattctccaagtagctggaattacaggccggtgccaccacacccggctaatttttgtatttttagtagagatgtggtttcaccatgttggccaggctggtctcgaactcctggcctcaagtaatctgcccgcctccgcctctcaaagtgctgagattacaggtgtgagctaccgtgcccggcctcaccttgaggctttgagtcataaagtgttagaactggggcatataagggccatctaatcagtaccttcactttatagaccaagcacgtgagttatttgcccaagtttgtgcagtcagacctagaccccactgatgggagattggggagtctcatgtttggggaattttaatcatgatcctaatttggcccactgacaccagtgggctctcatggatgaggggggtggaccagacgttcatttcatgtttattctgtgactctgcttggaagaggtacagaaagttaggaaaggtgttaggagggtggcaagaactggattttaaaagatagttggtgacccaaattctgttcgcctgatgccatgttacatagtgggaggtaggaagatgtgtaaggaggccaccgtgatgttcagtctggatggtggaaactaagagctgcagacatgcaaatagatgagtcctgctacagattgcaaatggggagtggtgagaggtcagaacggacaggggaagtgggaagggcacgctcttgctagagctggggcgttttttcctgaaggagatgggaatctttaagcaggagagagacgtcagttttgtggcttacaaagatcactgtggccacggtgtgaaagatgattgaaaggaaggaataagactgagacttcaggggaatgttgctactgcaagcatacaaaaaataaggaagagcagaggcaaatgtggaaagaaggaccaccttggatagacagatgggagatggaactgatgagtctttgtgacaggatgtgggggtggggtgagggagagaagctgaggatgattttcaggtttggggggtaacaagtagatatatgaaggatacctttacggaaatatgggttgtaggaagaagatctgtttctagggaagagatgtcagttttggacctaaagagtttggatacttgtgagacatctgactggaaatgagaatggaatgttggatacctgagtctggagcttaagagaggaaagacggagagagagatccaggctaattctagattggtgagcaggtagatagcatgacccaagaggtggtggaagaggcaggtaggtgagtgcccagggtggaagcccaagagaacagacaacgtgggaatgaagctcggggtgaagtccggcctctgtcatgcccttaggggctcagcgttccccatgcaaatctggtctgagagaagactccacagcttttactgggaagtcatcgggttctgtctgctcccaaagcactgcttttaggatcttagtccagatcaggagtgagcaaacttttctgaaaaaggctagatagcaaatattttaggttgtgcctgtctctgtcttaactacttacctctgcccttacagggggaaagcaatcatagacagtccttaaaagaatgggtgtgctgtgttccgtaaaagtttatttgcaaaaataggagagggctggattcggctctgggtcatagtttgctgacccctggcccagctcttgccccattatgttagagtaggttgcatggaggtctgtctctcctattagtttgtgaacttctttgatggaaaaagccttgtcttgtcttacattttcttaggttccttggttgatgagcatagtgcagactgaatgttcaaaaagcatctgcttgttagttagggtggcagtgttaaagttggacagggtttgggatcacagtccatcctcacatggtcattagcaggtgaagaagcctgctttgcccttagatggagtgacaggcctgaagttgcttccacatagaattgggactggagtccagccagaagtgtggatgcaaggcgagttagtggtctttactttctaatggtaagtgatggctcacgctttcaagaatcaggttgttactcttcagtggcatgtatgaaataagaatagtgaaaacaataataataatagtttactatttattgcactgttacgaaatgtcagggattatgctgggttcttccaaaaattagctcatggaatcctcacaacagccaaatgggaataggcgttattattatcttcacttaacagaggaggaaatggacactcagagaggttgggtaacttgtgtgagcatggaacgcggtttgccagggaggagttgtacacacccactcagtgtgatcctggatcccattttcctagccactcactatctgtccagcccatttcatgaaattgtcatgaaagtcaaatgaaataatgtgtgtagaatactttcaaaatgggcagcattatacgatttaaggtgagattagggtatttgtattaatgaaaaaaatatcctggctcttcgcatttaccaacagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaagctggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgctttgtgggtgtcccctgtcctggctagttacccccacttttttaaaaatagacttttgggtccttataacactgatacaatgccttctttgatttcctggtttctgagacttgtgtaagaaagagctgaacttcttactcatttttatctttatcttactcatttgtatctgcttgcctcttatctttgattcagtaattgaggtttactggtagcctgcaaacgtgattctcattgagctgttttccctaccatgttgtagaattataggattatacagtgtgtgttcagtgtgtcattttcaagacgtctattacagcaagcagtaaatgacggataatttaggactggctgtgattatggcttttagttaatatgatcaaagtagagtcttactgtaaatccacggagccgggtgcagatgacatcactgaagtgcgtgctgtccggaagcttgtggacacactgctgtcccggtgattagatacaagtgtgtctcttttggctgccatctgctccctcctcactgggcagggatgtttttccatccccctacctgttgctggggccatttgtctttatcctcagtgaggctctgcagatggtgctgtcctttccatgaagttaggggtggaccagacttgtgtgttctgttctgtgctgctttttggtcttatcattgataactactttgaagagttccaaaaccttacatgtataagtggtcagaagcaattctttggtatttgattcacatagagacttttgaccatttgctttctaaagccacacagtgaatggacagcttgccattgtctagttgcttttattctctttcaggtgttgagccagtgcaggttcaggaaactgtggaaaatcacttgaagagtttgctgatcaaacattttgacccccgcaaagcagattctatttttactgaagaaggagaggtgagaaattatttttctttgcctagtaccaggccctagggtcttttgcaaattccctgtgtacagtggagcgtggcatatcatgtaagtaatggcagagttgaggactaaaatcagagtgtgagacagaagttgcatctagtcagaattgccctttaaactctgtacccagggtcgtgacatgcttgcacgcaagaggcacacaggtgctgagatcaagagaatgaacagcaagttcccaccatttcccctctcaggctgactccagggcacagcccttggagtgttgtggtggattcgtttggttcctccaagaagcagctgccaagacagggctaggcctgcaggagatgatggggaagcgactatgagggaagatggggtagggctggaggaggctggggtagctgtgatgcagtctgacccttgagggcaagagaaaaggaatgagggttagtaggaagaatgttaggctgcagtgcagtttccagaacgttccagccatatcagtggggaatctttaagccacaggtgcccattctgggagcccacgtctcctggacaggcctgcttttgaggccctgctgcattccatctgtggctgggagcagcctcggggagctggccttggcacaaacaggatggcaggttcagagcacagtccttgaggacatccgtcacataggagagctgagagaaatgtttttctggctactccatgtggtgatgggccagaacacctgtgccatttaaatggcctctttctcttttgctaagggcatacaagctggggcagcatgagctccctgtgtgtgcaaggcagctctatgcggttctcggtgtctcctaggaagcaactttcagtaccctcctgtgttgagtccgattttctaaaagctgagcgggcatctagggacctttctgtcactcagccgactgtgtggctgtggccagctctgggtctgcctcccccagaactagatgcccatggggagtccatcagcaccaatctcctgtgatcgtttatacaacagaatctccactcaagtaaaagtggggcctcctcctatcttgctgtttgtgtgtgtgttggcagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccgtaagttctttctttatgaacctcagattagaaggaggctgctttgggtcttggttttcaagcatgagatgctccttccctggagagaatctccatttctgagggcaccttccaggatgctcactcccgggcccgagcacggtggaggcttggctctcgtccgcccgtctgtgctacagtagtaaaccctgccccctctctccctgcaatcttgcagaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcctttcttatagagccagcaagctgtattggaatcacttttccagtgttgtaaatgttatttttgtgggtcagtcagtatactcgtgaatgacagaaaaacagatcccaacaatgcaaagtattatatgtgtaaaaaagaacagaaaaaagaagctgccttgttagtaacgggctctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttgtaagttgcttctcaagaatccccaatgtcagctggtaaggtgactttggaaagtctgtgcttgtctgattgtctgaaggctgtgaatgcaaatccatcattgtcctggtccttcctcagtcacactctctgcctggagcctgttgggcccctgctgtgtagggaaccctgaggggaggtgggtgagcagtgccctcacgcctgccatcccgaactgggcatatgcttctcctcagatccgcgttccagccttcctggacctgttcatgcagtcactctttaaaccaggggctcggatcaaccaggaccacaagcacaaatacatccacatcttggcgtacgcagcaagcgtggttgagacctggaagaaggtaccatcggttctgggaatttgtggattttttaggagacaaatatcctcctctgctttgatattattttggaattttggctgcaagaaatcttgaccctccctagtatcaggcatgtgttttcttgtgtttctgtgtagagaaagcactaaacgtctccagaaaatgtgcgtaatgtctccaatgctctgcaaaccgtaaattgaaatgtgactaaagaaatgaaactgatttccgtaagacatggacaaacactagtctcattgcttttcagtttctgtacactgtgtgactgtgaagtttgacagctgaattgactcccaacttaagtagaaatagggaaagtgctttgcaagaagtggccgacaccagaacaccccgacagcagggatatctgccctgtcaggctcaccagcttgtgtgtgtgttttcagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtaagcaaaacgaaactcagttcttaaatcagtcctttggggaggaggtcgtttgagttttcatattgaaagctcaaataacaaaagcttcagcgatacttgttcattttatttattttttcatttttaaacagtatgtagggaactttaaacagctttagcagcatgagtaattttcagatgtttatttgccagaagtctgttgagtacaaattaggctaagtaaaagatagccagagttaacaaaaattgatttgaagggtctatttataggtaaagttatgcccacaaagtattgcttacatagaaatgatttgtgattatgccaatcatataaatagacgtgtcctagaaatagtgtgtcctcttaggcatgtctttcccctaataatttatactagggatgaagaaagagtttgctaaataaaggtaaacttcaacccagtccaccaaactcactgagtatcgctcattaatgatcttttcctttcgataagtggtttaaagtgagcagagaattgaactctgcttcttgcaccgcatgttgagtggctgctgatccattcacactatttactaataagcagagcttacgccaggcacagtggctctggcctggaatcccagcaatctgggaggccaaggcaagaaaatcgtttgagcccaggagtttgagaccagtctgagcaacatggtggaccctctctctacaaaaaattagctagacatggtggcactcacctgtagtcccaggtactcgggaggctgcagtgagccatgattgtgtcattgtactccagcctggaagacagagtgagaccctgtctcaaaaaaaaaaaaaaaaaagggttggggggcgtattgaagggtgaatgatggagtcatttgagtttgtttttaactttcctttaatgcttttctagcatattttgtgttttaaattgttttttaaaggaagcattctgccttaactgtaggtttccagtggtagcaatgggtgtgctgaagtgggtggattggactgtatcagaaccaaggtactttcagctgcagactgaccatacccctgtccacctggcgttgctggatgaggtaagagggcggagagctgttcacagcctacacagtgtctgtctcatgctgtttacgttggcattaacattgcatctattcagtgagtttagaggatactcttctcaaaaatagttatttctgtcctgaggattttcctcttaaggacctagcttcattgactgcagaaatttcttaacctcagtcaagtgttactggaagctgatggccctggcttaggtgtcaggaccttcttccacagtgataagctctttggtggctgtgacagtgcccagtttctctgtgtgctgagcgtgaccacactgctcagcgaagctccctctggcctgtttgtagatcagcacctgccaccagctcctgcacccccaggtcctgcagctgcttgttaagctttttgagactgagcactcccagctggacgtgatggagcaggtgagcagtgcccgtggggcttgccagagggctgaggaggaccctctctaaccagctccctgtcccccttcttctgtagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttataggtgaggccgactgcctagccctttactacaatagaaaatgtcagctgggcgcggtggctcatgcctgtaatcccagcactttgggaggccaaggtgggtggatcacctgaggttgggagttcaagaccagcccgaccaacatggagaaaccccatctctactaaaaatacagcattagctgggcatggtggcacgtgcctgtaatcctagctactcgggaggctgaggcaggagaatcgcttaacctgggaggcagaggttgcagtgagccaagatcgcgccattgcactctatcctgggcaacaagagcaaaactgcatctcaaaaaaaaaaaaaaaaaagaaagaaaatgtcatgttctacttcctgtttctaacacagtcactgttttcctcgttaaagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaagtcctgatgtgacattgtttttgtgtgcgaataaggcacgggcagcctcggtctcgtgcagagccagatactttattcatcacttgggcgatttgaaactgccaactccctccctccctcccccacccttgattctaaagtgacataagaatggtgataagtctgaactctttcacctcttaaatgccatattattgcccacagttgccaaatacaaaatatcaagtcctctgctgaagaagactgaggtcccatcgtttcctgtgtcgcaggtcacttcttcaccaggtggctgactgcatcattgtgaggcagagccatgctgtgcaagtgtcataagtcatcccactttcaactctcaggaacactcgcagccagtaccacgctgtcctcgccatccaatattgatagccaccccagttcctgccagccagcctggcacacataaccataggatcccctctggtcatgggtcaccatgccttttcttaaactgcgcttctagtgacatggccttaaacgatggggtccccaaatgtacagtgctcctcgatggcaaggttgtatctggcgcccttcccatccttataggtgctggtcacgatcctcagccagcctctctcgccctgtgagaagtgggatcgcgcgtcagcccatctgcagccgtctcccgctccccttgctgccgtcagccccctgccccctgctttctgcctccatctctcaggccagccttgggggatccagacagcccactcagctgcccctcagctttcccatgacccctgttctgaaataccttttgtgaaacatttcacttggttaatgtttaacatgagggccctctatgccagaagtgaattcatctcacaaaacatgttgactctagactggtgcctcctccagctactactacccccattagtcacctagtaaaaaatgacgacatttcatcacctgcacatgaaccgctttccccccatttcttaatcatgaatttctgtgtcttaaattattaatggctaagactaggtctggcagttaatttctctctcctggatttttggcccaactcgagtatttttgaaaaaccgacacagtattttaggggagcccaaaaaccatgatgggaaaaagaatgagctggttgtaaaggaagagggtggcagagcccctctccagcagtgctcacagggacttccccagggcaccaggcaccatctggagacggttttggtcacactgggattgcggggagtcacctagtgggtggaggggccagggatgctgctgaacacccaaagtgcacaggatggcggcagccgcgcatgtcagagaagggtctggccccaaaagccactcgcgcggtggctgagacagctggagcaaggaaccctctgtcaaggccccagtttttagctaaacgtaaacagaaccattcaagcgagaggagtaccaggacgtttttttctaggaatgaccttaagaaaatgaaaacatcttacccatggttcaccccatgaattccggacaatccagtactcagtcccatcactgatgccccacccagccacggaaacgacatggtttatatatgtggtgtcctggtattcggcatagatgcctccggtgtagttagccagtctttctgttgccattattccacagctgagagcaagcagttaaagaattaccacttttaaattgagagaatttaccgtcattagaaataatctgatatggctgggcgccgtggctcacgcctgtaattccagcactttgggaggccgaggcaggtggatcgcttgagtccaggaattcaagaccagcctgggcaagatggcgaaaccccacctctacagaaaatacaaaaattagctgggtgtggtggtgtgcgccagtagtcccagctactcggtggagggggctgaggcgggaggatagcttgagcccgggcggtcaa

SEQ ID NO: 12780 - DNA, 10698 bp, Human
tgggatatctcaggcccacccggagctccaccaaacaggatctctgtaatgttttcaccctggtccggagtagcagatgggaggtccaggccctttttcttgttgcatatccttatttatgtttccagcagccaatggcacggccagggacatgcttgactagtttgccatcaattcctcatgtactgtttttttcccatctcaatgatacaatatgagcattcaggtgaaggtcagaaatgcaacgtgtcaggattacgggcacttaatactcttttggatgaacatgcttttgtctcaaatccgggggtctgcccatttgcagattgatttgccagtccatgtatgatttgatcttgaaagatatctgggctgggcacagtggctcacctgtaatcccaacactttgggaggccaaggcaggcagaacatgaggtcaggagttcaagagcagcctgaccaacatggtgaaacccagtctttactaaaaatacaaaaattagccgggcatggtggtgcatacctgtaatctcagctactcaggaggctgaggtaggtgaatcgcttgaacctgggaggccaaaaagctcaacaaggttgcaatgagtcgagatcgtgccactgcactctagcctgggtgacagagcaagactctatctcaaaaaaaaaaaaaaaagaagaaagatgtctgagatccatttgatattgaatgccactttgtaaatatcacaaggcttgttcaaaaaagcccgagttcttgcctaaattattcatgtaatcttgggcaaagtgtttaagtcctcagggttattttgctcatttgcaacatgaggaaggcatgactagatgatctccgagaacactggacaagatgtcttgcagcattataatgttatgattactactgggagagccctaaagccatggagataggaaatttcatcttgtgctaaatgccacgacccaagcaggaatttgtactaattcacaccacagttagtttatgttttaaatgtgtaagttcaactaagtttctatgaaaaaaccatagaaagtaatgaccacaatgtttttctgctataaccaatccactggacatgagtcacaggcgttggtggaggttttgagtgatgaaaaatgaaccagaaaatggagctgaatcagagggtgggaaaaatataagaggcttccacgatggaagtgaggggatagtaagccttcctaaggactaatttaaatatctcaggaggggaagttggaaatgtcactagagccctgtctccatcaattgctgcaataatcaaatcctttggatgggagggaatacagagggcaccctcaaaagttagtggtcctaagtcctccaacttattttcatatctttggattcataaattcacagaggttgcagaggagaaaaacttcccttaagtaatcttaacagaaattctccaaagcccccttttacttctccttcaactcaaagtacccatccattcctcccaaataaccttatctacagaaactaatacatattgtcctttttgtctgaccttgaaccttcccttatctactcttggctaggagctttttggcaagaggcggatgaggaggagtttggcctcccttgtttaaatcctttgttcttctgtcacggaagtcaggcctgctccattcatcacaggtttgaccactcaacatttgacaccacaatgataaatagaaatgctaacaccattcaaactttccctacatgctagtcactgtactaagtgctttatatgtattgttacttttaatccacattatactcttgtgaagtggtagtgaagatccatgtccctgaaggtattcaagcccaaaaaccatctgttggtaacattattgccaggcgcattggctcacacctgtaatctcagcagttttgggaggctgaggagagtagatcacctgagctcaggagtttgagatcagcttatatagatggggaaactcccacctccctaagctaagaggcgttctatcacagtgtgtattttcatcacgagcacacatttttatttacctttcctcttatgaactgtggacttcttacaagatctcattagcaatgtgggctttctcatgtccctgtggctccgtggatgttcccaagcttactggttttggagtcttgcacaggtaagcatcctgataagagctataactgctcttctttttgcccattcatggtggggtgggggtagggggaggacattagaatgaagctctgaagtctttgaagcacttttggaagcccagttgtgcaggtgcatggaagaaatgtgatgaaatgagttgaagctctcccaaggagaagagaaggccccctggatgttgttgctactggtatgttttttggtgccatagctcaagggttatcccccagagccccagacactatgaagagggccaaagggtcctgatcttaagggcagggtgtaggcagaggaaatccctggagctgaggatccttctcttcacagtgattctgttggccctcttcatggtgtctagggctcatttacttcagtgtgtggagacttctgggaaccagagtcatgtagaaaagtctcctccccagtctacctcagatagtctcccttctaggagagccagctcatctagctccagttcttgggttactttctttactgaactccatttccgctcctttactccatgttgaaacaatttaagtccatctgcacaagactgggcaaagctcccctggacaccatcctcctctctccaagctcccagccctagaaacataaatatctcataattaagcattctccttttcccattcttcagctttcaagtaggaatgcatcacagttcagccagccttggtatttggcccaaattattatcttcttgtatctcagctttggcttttggaaggctgaatagtcaaattcctatttcatcactattcctggcatcctttaacttggctgtgatcaaggtcacacgaaggattgagtgacaaatctattcaggtagggcaccactaataagaataggccaggccatttggatttattgttaatatctgaatagttacttccaaatattggtgagtactctagatgtaacctggagtgaaattttccttgtgagcttaaaaaaaaattattatattgaaattctaccagccagtggaagtataaatgggtatttattattatttattatttttaagaaagatgctattattaattgttgtgaaagcttatatatgaaacaattatttaaaatttccacatggttaaaaaataggaaattagttgaccgataatataaataataggagagagtgtgttagctagataactttagggagaaccttatgtcccttgatcaacaatgatttgaactgtgcaagtccacttacattcaaattttcatctgcttctgccatccctgagacagcaagaccaacccctcctcttccttctcctcctcagcctccttaacgtgaagacaatgaggatgaagacttttatgatgagccacttccactaaacgaatagtaaatatttttttcttccttatgattttcttaatgacaccttttttttctctagcttactttattgtaggaatatggtacataatacatatagcatacaaaatatatgttaactgaacgtttatgttattggtaaggcttcaggtgatcaataggctattagtagttaagttttgggggagtcaaaggttatacttggattttcgactgtacactaggcacccttaacctccatgttgttcaaaagccaactgtactttctgagaccaaggtatgtatgtatgtatgtatgtatgtatgtatgtatgtatgtatgtatgtatgtatttgttttgagacaggctctcattctgttactcaggctggagtgcagtggtgcccaggctggagtgttacccaggctggagtgcagatcatggctcactgcagcctcaaccttctgggctcaagagatccgccacctcagcctctggagtagcagggactacaggcatgtgtcatcatacccagctaattgtattttttgtagatatggggtttcactatgttgcccagactggtctcaaactcctgggctcaagtaagctgctctggttaggcctcccaaagtgctgggattacaagtgagagccactgtgcccggctgagcccaatgtatttacaacaatttaataaacaccacaagtagtatttaatttaacaaatagtacagaacagaacaatagaaattagattatatcataattctatctatgatttaattactctttttagaattgattggtgtattatgatttattatgtaaataaaataatcccttaagaagtatacatatttgaaagacttttttgaaaatgagatataacttacataaaatacacaaatctttttttcttatttatttttatgaccacctgctgccttttgaaacaaatcttaagtatacagttcaatgagctttcacataggaaacatatccagaccaagaatagaatatttccaggtcctcagaaggctcccccatgccccttcacagttatacttccccaaggctacaactattctgacctgtatcaccacaggttacttcagaactttctagttatttaatgctatttaggtcaacttttaatgctatattaggtcaagtttcaagaaaaagttttagttggaaattcttcttattttgggaggatgcattgaaggcataattttagccactttaaattttgtgaggagaatgtctctaaaaccatattatccataagaaagatcatcaataaagaagatagagttgtgaaaaaagaataaaatgaagagaaaaatcggctgccccaagtatcttgcttttctgtgcaccacaagtgaaaatcatctctttaggatggtaaatgtagtatactgaccacaagagttcaaaacaaattcagattttggataaacttcagatttattcaagaatcccagaagtccattcgatgatggcaatgttctgttttcaggtaacagttgtttttacactcagtcgtttggctgttgtgaccaactcatccacttattggccctcattctgttagaactgtttaatgatctgctctcctttcctttaatcatcctttccttactttctctcctcatcatctcagacaacctggctgccctcccaggactctgcctgcgggcttgtcctctaacccactcatgatcatcactctggcagaaggaagtctctcgggagaccttagtgggggtatttgccttggtctgcgtgttttccaaagatggatattgctactactagttatgatctaacacctgtcagtacttggggctgacaagcgtttcatagatagcatttccacatctttacctggaatcctatttggcaggtaggattcctcacattttgctgtagagaaacagacaagccaattgttcgaggtcatgtagacgggagtcaggatttacacctgattctgtctggctccaaagcttactctgactctggtcagtagtaaaaaagcacaggagttgatggggagggataggtagagtggaatcctcagcagggttgggaatgtcttataatgaatttgggtttgaaatagaacaggcatgggacacaatgcagcttgtttgggactgagataaaggaagaaagaaggggatggtgctggtcaagcaatgttggagagaccatcaggactggccaataccaagccataccttctccagctccagtccccagaacgagagaaatggtatctgtagcccagggggacagggaaatggcattttcgcatctcaacccctcaggcctgggcagactgccagagtggagagccagggtagcaatgaggcaggggagatcattatcaggaggaaggaagctctggcagctcccaccagcctgtttgtgacaagcaggctcagggccacggaagtcccttaaggtcaaaggaaatgtgatcctggatctgggggatgaagctcagacactccctttaccttatgtcttcaggccaaggggatctggccagagccaggtccagggcctaggttggaagagcagtggtctagagaaacgggaggggcagttagagaggaagagagagaaggaataaaatgccagagcacctcataaacaatctcttggctagagaggtaatgacctttattgcagccaacacagggtaactggctcttcagagcactcgtttcttcatgagtgaactcttacctagttcaccgcttgcctctgtaacagtgacttctttcttgcgcaactggtagagtagaaggtacactgtatttagagcaaggagacctaggttcaagtccaggttctgctactaactaattagacaagctctttaattcattaagctttctaaaaccttaatttcctcatccataaagaaggcatacaatccctgtcaagtctatgtcacaagggattagaggattctatacaaatatgaagtggtatttatttatatttttctttccttcaggtcacctcactgccacgtcagagctggggaagacttctagttcaggaacagaaacagctgtgtccacaaatcccatatgccccctttccatttatttcctctccttgtcatgctgccctaatgccagggggcaggggagacatgtgcaatggcatagaccagggaacccacagacctgagcttgctgtttcttggggataagcatctgggaaaacagcaacaaaaagatgaaaagccatccctctagagctcagctcaccagagtgtcagcttcagcctcccagcagaggctgaaccaggaacagccccaagagatgaggggaagagaatgctctgggtgtaggggagtggtgcggagtcctggagagggaattgaaggtcagccaaagagcaagccagtctggaaacctaaaggactctgtccaagtgtacaggaaccaggtggaattgctgagagtcctttttctggggaggcttacaggccactacgtaagacttgttctgtcgcttctctttgtacctgcagttcggatacttccctgaggtgagcttacacatggtcagggacacgggcccgtggctctggtggcagtttttatcgccattcttgcaggctattttgggggtctggcaggtggcggccacactggagaaaggctcgtgcaggaaggtgttgaggtctttgcaccgttttgtgtgcttgttaatgtttttcatggctgagttgcatgcttgagggctgggctgcatgtgctgaattttaaaccactgtgatgaggtcatgcccttgggcttggcactgactgggatctctgccacccacagccccagcagcagaagcagcagaagggggcagaatcctgctctggccggtgccatctctcttaggaggagcagtcaggatggagggcaggggtcgctgggacagaggtgttcagttgagaaattagtcctcttatacctgctcatatgagctagtcacccatctccctactcggttgtctcctttcctcactttgtgtctcatctctgcctcttcttctgtgtgtccacatccactgcagccccaacaacaaccctgtggccccatctctcatcttgtatttctgttcccttcattctgtccctgttgcctgtcactctttgtcctctcccctttcccttaagtctcatcccttttgtgtctccatgttcctgtgtctgtgtctcatcctctcccgattcccatctcgtctgtgttcccattctttttcattttttgcctccatccccaacatcactctcccctttccccaatgcgtgtcctcatctcccctaaatccagtccctcctttatccattttatcgctcacctgagtgtactctcaggatcagaacccatccctccttctctgtcctcactcctccccagatcctgccacagcctcacctttgcgcttggtcttcgtgctgtgactcctgctcagtgggctgaggtggtgtccacgcactcctaggctgtcagatctctgagggcctcttctcactcctgaactccttaagagctggcccgggctacgctgtgtctgtttgggggtgggctgggagcatcactggatcaggaaatgaatcaggttcatgcctctccacttacatgtcccaaatacgtggacacctaaggatgcctgtacctgcctaaacatgttcagcaatgaggaagcttgaatcgtcacattcgaagactgtatttgttccctggccacatgattttaatgactctttaatagagcacctgacccaggtgtcaactgaaatcaatttcaggaagagttgtcattcatatcctctcatatacacttctggcccttgatcctgggaagagtcaatcactgtggtgttaagggttgcttcttctctgacctgaggcacagataggacagcctagaaagatgctttgtctggttccttgtcatctggagatactggttatctttcggaggagatggaacagacacgagggaagtgggtgaatgaatcatcactgtcacgaggcctggcaccatccccaatagcgaagccattccacaatgattcacaggcctctccagttccaggtaccaaccaaggccacatggctttagctggagaaggcagccaacacctctcaatttcacttgttccctcccttttttattgaaaattgcaaaaatttaatactgcccaaatgtttgtgtttaaaatgctgttgctgctctcgacatcctgccttagtgcttccttcaccttgtatgtcctgttccttgtggtggttacagctgtgtggagcatctgggtcagtgctactccaagctcttgtgagcttggaatatgacactcaggagaaccgagacaccaaggcagagaagcatcaccctctgtgggtgagaaggcctgtaaaactgagatgaggaatatttttgttttcagaatttacctgtaagtagtaggcaatctcagaatcttgggcatgcttcattcatgtggtcaacaaacatttatcgagcatctactaagtgtcaagatacttgggatatatcactgaacaaaaaaggcaaaaatggccaggtacggtggcccacacctgtaatcctagcactttgggaggccatggcaggaggattgcctaaggccacgaattcaagaccagcctgggcaatgtggcgaaaccctgtctctataaaaaatttgaaaaattagccaggcatggtggtgcatgcctgtggtcccagctactccagaggctgaggagggaggattgcttgagcttgagagataaaatctgcagtgaaaatcatgattgcaccactgcactccagcctgggtcacagagtgagaccctgtctcaaaaaacaaacaaacaaacaaacaaacaacaacaacaaaaaacaaagacaaaagtccctgcctttgtagagcttacattccattggagaaagacagtaaaaaaaaatacgtatactttgctcaaagtgataatggctagggaaaaaagtagaacagtataggggttggtggtcagtaattttacgtaacatcgttgaaatcgctgactctggggcagagacttgaagataagagtgaacttgtgattatccggaggaagaatgttccaagtgaagagactagcactgcaaaagccccagagcagacagatgcctgaggtgttggaggaacagcagtgtgtccagtgtggctggagcaggtaactgagagttcagagagggaccagagaccaggtcattgggaagacttacggaccatttgaaggcctgtggcttttactccaagcacagtagggaaccctggaagggttctaagtagatgaataaagaacgtgtcagcttaaaggattacctggctgttgtgtggattataactgtggagaagtcgcacaacccatcctgatcataaagtttgtgttctggtccagaatttatgattctaagtcaggaggatggggagtttgttttgaggccaggaggacattattttagtagctggacagcacagctgtgggttgggggtcaggatgaaggatctttagaagcaaaagtggtgctggagatgagaaatgccactagatggcaaaagagaatcaagaacaagttcacacaggcctctggctcttctggtttgtcctcagcgaggccttggttgggggagcagctgttcacttctttgttaaggtatcccaaactttgcaggctgaacttctggatagaagttctggatagagaattatgcccctgctgccgtagaaacatgaatgttaggagataaaatccacggtttaaaccaggctgtgtatcaaatgtgtatcagcacaggccagtctagcctttggagtggaggctggatggaaggctgcaagctcatttgaatgcctagcttggtctcctttctacttctcattatcctagagtgggatgttttcaagccatgatttaaatttccctctacacttgtgttttcctgatattataattatcctagtttgctcttcaactcgagtatgctgggctgcgtagaaggctgccttaggactgtgtgaaagtgaaataaacatggccctgctgcttcagtccaaa

SEQ ID NO: 12781 - DNA, 198632 bp, Human
cactggtaactctggcttttgggttcaggattagacagagtggttaaactaaaatatttatcgtaagtataaatttgttccacaaacataacatttcaaaggtagctttgtttcctctttccttgcactgccagctattaactttcggttcattagtcacgattttcagaatccacttggctgccaccttcctgcagccagaccatcttggatcagagggtgggccagccattcccacgtcacacctgccacgggatcgattttttcccccattgaccacagtcactttttgtcaattaattaatgttattcacctggtacccatcttgtgaatggtaggtcactacggagcggattactacttcatatcccatcaatgacagagccatcattacgaaaaccttttctgacaaccactgaagagaaaccatctccacaccgtgcattttgcatcacttccgttgcttctttacctgatttatcacaaagactatgtaccacacatcttctttattaatgcattgacaatcagtgaagacaatgaaaacccaccacttttgtccgtgaactgagaaagaaaatggcaatgtcatatggcattaatgatgcatgagatctatgggtgtagtgtcacgtctaggcgtgtagtaatccagtcttcggccttactccagggagaaagattcagctttgttactttccagtcactctctcccgtaacacagcaccttggcacagaaagcagagcgacaaaacccagaatgaggacagttaaaattcaactcaagctacagccatcccaacggtcctccccagctcccgcggaatatttaccaagaccgtttaaagcacttaattaattcacttcagcttcgctggagaggtctcagggttcccgagactccattacataatatctttcacaaagtctattcccagctcgaatggaagatggattctcatccagtgtgcggaggttccatgcctttgcttccctttcccggagttcgatccggcgataccctcccgaggctgcagccatcgccccggccccgagcttctggggtacccgccactcttcgaactccaatctggccccgaaggtgcagccgcctcgccctcctggctcccaggccggccgctgcggccacggtgccagcgagcgcccgggacaccgcgactctcgctgctcgctgggtgcgccccaagcccatccgcagcgcacccgcggcgccggggccagagccgcagctcggtggcacggccggctcggtgcgccgggctcggggaggaggagatcgggaagaggtggaggcgtgtgagggagggaggaagggcccggccgcccgagagggggagggggaggcggagggggccggccgggccggggagggggggcagccaatgagcggcgcgcggcgcgtgggggtggggggaaggtctgggggaggaggtaggatgggggagggcgcagcccgagcggctgaggctccagccataaacaagcgcccggaggagcggcgcaggagtgaggcgagcggggcgcgcggagcggacgccgcggatcttgtgctgcgccaccgcgcccactcggcagctcgggaggcggggaccggcccggaggctgcgccgctgcggggccggccgactcggaggaggagagggaggaggcgccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaaggtacggccgcccgctgcgggccccctcccacctggcctgcgccgccccctcggcgctggttgtgccgaacaaagtttgggcgagactttctggaggaaagagggctctgcgggaagaggggcggccgccgcccccaggagagtgcccccgcggccctgcgttccctctccttgttccccccgacgcttaggcagtcgcgggcgaggttgggtatggtgggtgggggcgagcgagtggaggatcgcccctgtccccgcgcagacgcgcacacgtgtggccgttcctgctgggactgggtggcccggccttgctccccgaggtgggggcgccgcgggcggggggcactgcagattctgccgcgcgcgagcccctcggggagcccggccctaccgccctccccgcactggcgcagtgtggcaccgtgagccgcacgccggccgcgaaagtcctttttctgttggcggaggagacgtgtctccagctcgcactccccgagtgactcttattattttttccttgagctcttccttcaccccttcctcctcctccgcagataaatcagtttcagccgcggaatatgtcagcccaggggaagttacacacggtggttactcatttatttgcccattgtaaacggtcaaaggctttctctcctgaaaggaaaggggggtgggggttgcacctgggagtaaaaagttgttgctattagtggctgctttttaatatcagatacccgcgtgtttcctgtcgtgttgccggttcctcctttttgtttgtttgacagcggggattgttctgctggcttctccagcacgcattgtgctccgcggtgtcgagattgacggtgggagaaacagattagattagtggagtctttctcgttggggagccaatgttagtgcgtgttggctttaatccctgcccgcttgcgtcggccttcagggtgcctggtctggtttggggtctagagcgaggcagtgagttattttgatgtggctaacgggggcacggttcggtaagcatcagttaaaagtgggatccctgctctggctgacgttgggctgatgatgctgttccgggggcatcctggcgagtgagcagagcgcacgcagcagcctcgtttctggggaggcggcgaggagggacaggcgccctctgcccggcgtgccttcctcactactcacagccagcaccgtccagggaacggtttattccgaagcatctttgtgtgtgtttgtttagtatgctgggatactgaaaaaggaggtgacagccttaaggataacaatggacctattaaaaggcttcagtgctgtgattctctctaaatacgcacagacacacacataggtacttatttatacctgaatagtttggggtttggacagttcaggaaaataggggagggttttctggtttggaagctagtgggcagtgatgagtgaagggaactcttctcagaggggagggacttgctcttgctttgctgcacacgtaagacattgggttagaagagatcatttgcctgaagtacaaaaaagcctctcacctggtattgtccccttttataacttgtttttatgccttacctcaagaaaaatggccatgagattaacttctgataccattgtatgtgttttgactttgggaattctgaatgacctagactaaaagatgcatctttgaaccctgccgcttcaagtgtataacttaatccggcctctcgtaaatctgaaaagaacaggcgacatgaaacacagttaaatgcagtggaaactgctgtgttccaagaaggacttttgcaggttctgaagattctaacccttgttttgtttcttcttagtctgtttctggtgaaggaagtgctcagggaacatttacagtaatcgagtgttgtggcagcaatatcccatgtcacagtatagagttattttggcagtttcgtgagcctttcattcctctgaaatgatgtgatccctcatagcttccttttttctggcaacaccctgtgtgcttggtattcgctttgaaatgcttggaagggtttgttgacatgattatatctcaattagtttctctagaaacactttttattttacaggcctgttttcaactatcaatattgtgtgtccagggcacttcctttaaaaaaaaaaatactgaaaacagcagtcaacttgcattctaaatctgtgaaaccaaagtaaggacagtgttacctggcatgatataatggttggatttagacagatattttcaatcgtgtgtttacaatttcagtgttttcacttaacgacaagatttatggaaagcatgggataagtgataccccaaccgccccccgcctgccatttttaaaaaaagaattagaggagccttcagatgtcagcagttacctagaaggtattgattatctcttgtttttctgtgagtttacaagaaatttcggaatggccagtgtttccctcagtttccatttttattcagaaattcacgtggtgaagcatggttatcataactaacatgaataggaatcaatatattttattcatgttgaagtctcttttgctgcaatttttgcactaaaatgacccctactggttgtatctgttaatgaaaactcttgaaaacttatttaattggctacgttgtaaaaacatattgcatgttatagaaatattatcatgactaatctccctgctttcgatgacataatttaaatacaaattatattctctgtttgccaacttgcagtaatttttagcagtgtttactctcatactggctttgtaggggaaaaaaattacgtttttaactgcagttcacaaaatgagttagataaatcatgggcagaaatgggcccctttcagcttgtggctcacagccttaggtttttaaggcatgctggtctagttggctctcagtaaaagtacattgaacaaacggaagaacaatcctatccatagaaagaatgctgaaggaaaaaaaatattttctgaatgattaaataatgtgatgagttgtgtcctgtgcaccatgtgagatgtgcacttggatttcttttccgcattgtttagattgttattaaataaattctaattgaattattccttttgtggtgggggctgggggtggtaagtgcatttgaaaaaatgagcatggagcctgatacctaaaagtttttcctactttctgtcagtctagaaagtgctttttggaacttaggagagtgcaggtctttttcctctttccattcgtctgctaagacctcctgttgctctttgcagcatcctaactggcctgttttcttggccaggctgcctgcctccaggaaaatcacctagaagccagagaaacaagtgtggatcctgaacccctgagaaagaaatctggatggaagacatctttggaggatcgaaggcagagtttagaaaaattaatgaagtgagattttctagaaagaagattttgattggacagtgagaattatgttttgagctaaggggttgagagccatttcttctcccatgtgtcatagcgctttatgcttctataaggagtgaggcaaggtgagagagcatgaccagcctctctgggcagttaaagggcagatggtgacttgctttggcagtttgtacagacagagtgatgaggaaccaggtggagactacttgagtcactgttccgaggactctgttgtattagattcaggtgatagctagatcagataagcaccaatttttttcttggtgactatttactcagtagcttcatattttggaacttagcattccatctttttcaccattgctatctaaaaacgacctctttcagaacgcaatcctccttttatttcccccaggaattttaactgttccttttacccatttttcattgggcagtgtgtaagagaactatgtatacatagtggggtacttacagcaaaaaacagaattttgtttcctgaaacttgccatgcaaagtttctttgcttatccctggaagacagtcagtgaagatgatggctgcttggaagaaaatgtatgcgggatctgctccagaaagcaggctgcaggaggccagataatgaacccaaacatttcattctgcacaagccgcatggaaactactctcaccactctgtagtagggcctgaagttaagagtccacgaattttaattcactcattaagtaacgggaggggggcaaaatatcagcttctatagttagaaaaattaagctcttggctttgttttggaataatgggtttcatttttcctctcagaagtccttaggtagacagggagcccttagatcccagagaggaacaagcagagggtctataacattatgttaacagggaatgggaagagaaaccaacgaagtaaacaaggaaataattagttcctcccaaaagtaaatattggcaaaacatggagagaccaactattcactgcacttaaataaatgacaggactcagtgaccttcactttgattgccaggcttatagaatcttccctgttattgaggagtcctgtcacataaaacacttggcaaagggcagatggattgtgtattatcagaatggcaaaaatagcaagtctggagatatttgttgccattcacacatattgtacactgaccaggaaaatctccaagcaagaggttggcagtagggttgtaagcagtcagattaatatatgaagaaaactgaacagtccttaatctgtgtaggcattacatccatttgtaggaggtatttggtgacttggtacaggtttctttgttttgtgtggtttgttgaagatgcaatgaccgggatgaatgagtgaacagctgggtgaggcaggggatgggcattatgaagttgggggatatattgtagatgaaacagatgaccctaaggaggtaatgagggggtggactaaagaatgacgaatgggagaagggaaaatattgaattcatcttagcacaagtatatcatcctttgaagaataatccaaaacacattccagacattaattgtgaaattcctgaaaaatgtgggtgtgcttaacatctcccaggctatggtgcaagcagagatgatagtgttgctttagcctgtaaatacaagagggtaggaggtggtaaaatgagtggaagggaaatacatttagtgaagcgggttcctgtaacactgtgttccgtatggcacgtttggtatcaggattttggagacaccccagtaaagctcatttaattatttgagggagaaacagtagactagccaagcatgcatgaataacacattgaaagctttccttctcagaggtctaattctgcaaagctgcattttcaaagatctgacttgcctttgcatggaaatcagtcattcattcattggtcttctatgctgtacaaggccttctgctggggtgagggggaaactagggagcccggggacctctccaacatattctttgctctgtacacttaatcaagataagaaataaagacagcaagactgcaaaaagtctattatgtagacttgcaaaaagtctacataataatataaattcaagccaagtagaagtgattttgcaagtctgtgtatgattaattggctagtgaaatatatggataaaattagttgtaggaattaaagcatctgaagtgatctcttgaggctctggtggcaaagcagaaaggggaatttgaatttgaactaggtttaaaagtgtgagtagtagccctttcttttggcaggggaggtgatcctacccattctccttagagcctgtgcaattggtctcagtgtttctcaacatctaagaatgaagctgcattcttaatgctttagtagctgtgcttcaaaacggcaagtttccttttgagagtgattttctctttgttctagcttgtttcactaggcggataagcgtgggcagtaaactgggaggtgtccctttatcagcacctctcagcttcacccaccctgctgcttgccctgggcagtagcctggtcacatctttgaaaacctctgtttagtcaagacttcctaagtcaagacagaggaatggttgaatatacctctatgtaagaataccctcaaggtaaacactaaactcttacgtgttttatcttgggcccacatgaaaaaagtaaatgtttttaaagaacctattttcctttgttagttgcaaagtgaacaggtatcaattccttacctccctcctccagtcccagttaattccccacgtgaaaatacctacatgttggtggaaaagtgtaatgttcaagaacttggggccggccgtggtgtctcatgcctgtaatcccagcactttgtggggctgaggcagatggatcgcctgaggtcaggagttcaagactagtctggccaacatggtgaaaccttgtctctactaagaatacaaaaaaattagccaggcttggtggcaggcccctgtaatcccagctactagggaggctgaggtgggagaattgcttgaacccaggaagcagaggctgcagtgagctgaaatcgcaccactgcactccagcctgggcgacaaagcaagaccctgtctcaaaaaaaaaaaaaaaaaaagaacttggtttctggggtcaaatctgcactctgcttctgtgtgtctcagttttctcatctgtgtagtcaggttaatgatagggttgctataaggactcagtgcatccctaatgagcagttaaaagaatgactggcacatggaacatgcttactaacaaggctactaaccagtataagtgaaacaattttacttgggctcagtctcttgttctcttaatccccatctacctcagtcattgatggtaagcagttaaggaggttgggctcttagaaagggagcaaattgttactgaattcagcagtcgtcgccgccccccccccccatgactatctttttataccttgtctaaatgatttctacaaagtttgtatattttgagtaatgttttaggtctgatattattttgcattgatttgtaggaattataaatgtaaccatttatctgtgaacaaataattaaaaatacttaatttggggaggaggcgggaacctagatgtgctataatcagcagtgtgcactttgcttcacattatcttctgggaggaaattttgctcctagctcctgagtgtgcacactgatgaccactgcaggatttggcctggcttgagcaaagaaacagctcgacgccatgggggctatggttccaacctgctgctgcagttggtataaactaggcaaaaccagaagtcagaggattatccattcctcttgttctttttctagctctacctgttcttctgccattcttctgcctgaaaatattcatgagcatcgcctatgggtcttgtctctgtgctttacagtagtgacatcacttgtgtaagccagtttttctgttagtcgtcggtacctcctaggttcgctgtgggggttaagtgagataaaactgtgcttctgaaattttagtgtgcacacaaatcacctaggtatttaaaattgcaagtctgattaagttagtctggggtgatgcctgtgattctacatttctaacaaatttctggctgatgccagtgtcacaggtgccaggaccacacttttaagtagcacaaagctagtacctatgtatacagcatgtatcacagagtatgcatattaaaagacctgataaatgttacctgctattatagtcattatttttcagccaaaataaataagatatggtccttgttttcacacaggccatgatctgatggtaaactggaaaagcagacaattcattacaatcagttcagtaagccatgagataacggaaatgccaagcatgtcaggagcaagtaagagggagtctaacccaaatctgaccaccaggaaaagtttagtggaggatgcagcaacaagaaagacctgagggtctcctctcctccctccttttttcctgcacttcttgtgcaggatgttttaggaaaaagaaaatagggcttggggctagacaaacctgcattgaaatcttaaatctgttatttttttaatcgtgagatcagcttgtttagtttctctgagcttcagttccctcatctgtgaaactggaatattaatagctttctattaagtaaatattgtagtgaggattagagatttatatatatgattacatagatgtatatataagattgtgtgtgtgtgtgtatagtatgtatgtgtatatgctagtttctggtaccaaatagattttttaaaataatattaattttaatttccattctattttctatcctttcccattttcctctttgttagctttctctgtaagtttaaaaatttaccttgtgggcacacatttcctccaaacttaactaaatctcttcaaaggggtgggagtttcgagggggaattcaaatgtcagatgtttgtcaaagagaaaagaaccgtgaagtaccgagaacagggggctgggaatacagggtctatgcaccaaggaaacatgcgttggtttgatccagtgcaactacagttcccagcgcctttggcatttcagcagaatgtgaacacttgcttgattttgtggtttgagcccctacatccaaagagctatttcaaattaatatttatttaaaaatggccttttaatattaatggcatatggttttatgacagtgaattaaatttccttttattgttagaactttttgaggatttctggacatcactggagacgttggagaccccaaggatatagccaggccaggttgatatatctcactgaggttacagaaggaagcagcggcaagcctagccgattcagagaccactgcgggcttgggaatgagcaggagagggtgtgagggccagaggccatctgtgttgcttttctctctcccagtcattctagccatctttgatgtggactaatagtcgaggttggccatgggtttgcactgtctctagggagtctttgtgatatagtgcggggtaggaagaacacctagaatcaaaatatctaatgttactagctgtttagttcttagtgtgggtatggtcccattttaggagaacagaactatgaactatgtttgtgttttttttttttttttgagacagagtctcactctgttgccaggctgaagtgcagtggcatgatctcagctcactgcaacctctgactccctggttcaagcgattctcctgcctcagcctcctgagtagctgggattacaggcatgtgccaccacgcccaactactttgtgtatttttagtggagaccacgtttcaccatgttggccaggatggtctctcgacctcgtgatctgcccaccttggcctcccaaagtgctgggattacaggcgtgagccaccgcgcccagcccagaactacatttgcttaactgtgactctttcctttgtacctgaaaataagtatcatttttatccagtaaatattggctgataattcataaggcagatgctttaaattggctattgtagaacaaggagaaagaacttgatgaagagaaaaatccttggaatcagtggtttacaactttttttttccttcctgatgatcaaaccgtattatcgcatagtagaaattggattttcttccagaaactactttagtacctctcatttgtagcacttctatcaagagtgctggtattcggacatgtaacctacaaacaaaatcagaaagatgtcaaaataacaccctaattcagactatcctgagaacatttgtcttctgaatatttaagaaaaaaaaataagtgttaattatattgtagggtgttaccattttgtatttcaagttcctgagaagagaatttgaacagtttgctatttggaaattttagcaaccagctaccttgcctatggaaagattaaaaaaaaaaggagagggagtagatggtggtccataggctgtaactggaaactatgcctgtcttatttagcatttcaaaacaaaaaccataaacaaacatctcagattcaaaacagaaaggaatttctggcagggcagaatgaaacctgagactgcagagtcccagtctacaagaggtaacttatttagcttcttatccaaaggccacagcaaaacgtttcacagctgtgattaaacaaaaggcatcttttgttggagaattgtgatacttctttttaagactgcgaaagacctgccaaaataaggcaaagctaccttgaggatgtttgacctgaactagactttatgaagtagttggaccacttcaggccttatggtgtgaggagtgtgggatgcataggcttggacctttctgtgtgtgtgtttataagtctgtagagacagaatattccatcatgttatcaaatgcagatctcgaaaaccttttctcacttcccatatttgggagctttgctttttttgaaaagtatgggcttttacagtctgagtgaggaaaagggatggattttagacagttttgtctgtggaagtcaaagtagaaggatttttaaacagttggagacagaatgggtatactgtgtgcttttcagaaccactgagttcctatatttcaggcagattttaagaaaacttattaccactacctatcacatcaaaatgaaagaccaaataaatttctgtgttttaatcaagactgtgactgtatttgtgtatatcctagcttgtttcagaaagggtttgaggctgcccagaaaggtgaatattacagaattcttgtatgtgataacatgataaaggagaaaaaaacagccatggcttttgaatcccccttcatctcttaatagcccagtgacttaaataaaacccttcaacttcccttggcatgactttgccttaatttgtcaaaagggaattaaatagttacctacctcaagacaggggaactgaatcagatgatatcttaaggttctactggtcataagatctatgcttttatgacctagaagtgatagacaggagtcgaatattaccttgtgtttgcagagccagggaaggaaaaagtgatagtgtctacatgactgccaggtgctgtagacagaagggcttagaggaaaagatcaagagttcctccatggttatgtttatcaagcggcagtggagacagtaaagcgtagtattgggaagttagtgacagcttttaaatgcctgaagtcttttaaatcatattcaccgtggctgagtctggattcagggtagaactcaaacctctcttatgtgtttgctgccttccctttctccattttcttatgtacttcattaattattaagactatgaggtaggtaggtgacagagactgcaaagggagaagctagagcgaagacaggccaaaacttgcccaaattcacatgctcatttctgcctctgacactaggagagagttgagtaattgctcttcttcctaatactgcaggcagcagccaaattctccacattcttttacctttgctgctgttttcacttgccagggagtttccttaaggagcagactgaatttaaagaaacatagcagtaatagtgcatgaaagggggtgtggggtcgctggccaaacgtggcatgttggtgcctcacgttgggaggatgaaaggatgattcctgcagagggacatgctgcacactgcgcaagctccctcacctctgtgtacagctgagccactgaccaggaagctctttgcttgtatgtgagacagcaaatattcactaaatatgtttcaagtacaagccaactgcgaagcttggaaagttgtccagaaacttcacccttcctttgcatgttgtccagcggcaggacgttgagcaaggttaggtagtatgaacctgcggctctaaaacttaaagtaataggcattattcgaaagaaaatgatgcccagcacggcttccagtgtatattagcaatcagcttgtttgccttgtggttattacattttttgccaagagcagccttccagaatgaggtactagttaattcccattgggcatttattcattaataagtctgctgaatgtgaaatattccatttgggagtatgtcatatgagaaaactcagtggctaattattacatagctctcttccatgattctcactttcagcgcagttacctaagccaccatttcctaggtatgtaaacttagataatttttagttttctgtaatactttttgctttttgctccagaaaattttttttcactccaatctgtgaaattgttaaaagtttactaataactggataaacattttatgttgtactatggcttgctctttctttccattttaaaaagataatatcaaaagttaaatcctgttccagatcttaccgtctctcttccaggctagatttctgggatggggtggtgttaatttactaacctgagcttttgcccaatctagggtctcctttactcttttctggtgtataaataggtctttatttgcttttcttccaggttggttggtgcatattagcttaagaacttttaaacctctgcggcagtaatgagaatctgcatgccaagggcccagcatttctctacaaagcagcccatgagtgcatgtgtgtttgctgtagtgaagggtctatgttagaaggtgagttagagaccccacttgcccacatctgtgtgctgtggtttggccctcctcctctggtgaatccctaccacagcccagtgcctgctggatctcaagtgtcctgaaagccattggaaagatgctttccagcagtcttaacatttgcctccatgttctttccagcaaggatgagtgcacacagctttccagctactgggcaacccagccattgacagaaggtggtgcaagagtcaattcctctgtgaggatcccttccaataacagtgtgtgcattaacgacaaaaagttctgtaaaaatgtttgcagggggagcttttgacctgcaaacatttctacagaactttttgccatataggaacatatgaaatgttatatgtaatataggtcagaaatgttgccatataggaacattcgagaagatgataaatgtgaggaaagtgataaaagtttatacaacaaggatctgtacaagattgtggtagatttgctggcctaaaaagatgtactcagggtagtgaactatttctgtagcatcagccactgggcccctgagtgggaatactctttgagagacaggaagctaattccttctttgaatgtgtagttaactttgtgccattggatgtagggtgtgcacgtgcatgtgtattttttcagttgctgagggcacaacacagacaaagaataccgtgcattgtattatggatgtgctggaaacaacgccccagcttgaagcaagttgactgtagtatctactctgtagatcagcaaactgaaaatgacttcttaataaaaggtcgcacattgttttacttactgcatttgaaaaaacagttctaattaagatgctttgggttttaaactgcctgttaattgggatatctataagtgggcaagtagagcttctgaatattgctgacttatttcttagtgattgggacaaaagctttttttttttttttttaaatagtatgccatcattaaacagtttttgaccttacgcagaaactttaaatgtgacagcagaaagaagcagcagaaatttacagtgagaaatggaagacctctgtaggtaaataagtaaaatgaaagaagccagaggtgttttttgttggcagtagatgaaattattttcaaacactgccctgggaaaaggtgagccctcagcaaccaagtttattgactgtctattcaggaaattgtattagttgctttggaaagagaaaggaaaaagaaaagactttctgccaactgagggctggaaaacttgagggagataaagtatttacatgctttaataacataaagcatgtccaaaagaaatacataattacagctatgtttggcactgaaaataatccaggttattatatttttaaaattgtgtgtgaatatgtaagtgaatgcccttgagtcagaaatgcttgagtgataatatttcttgagagaatggaaaagtagatggtattaggagctaaaaagagagagaagggataaaggatgaccactagttaagaaggaacagtgaactttttttctttagaggggacatatttcatatgcatagttattccccctctacttctaatcttagtataataagcatttaacttcccataggaccttagcagtctgcatgttattactaaaagcccacaggtaagggaaaattagacccctaaattaaagacctgaccatcttgctcctgaagttttaggttttccaactttatttccagtgtatcttggacaaagaccctttgagagctcagaaaattaggagatgtggtcaacacattcttcttaatatctagtgcaaccaaagacttggccagcaactaaggccagcaactggaaaatgggtgtggtgtcaggtttcagacgcccccatagttgtcttcacgtcctttaatatgtgttggcatccctcaagccctgccagtttatgctctttcctttgtgaagccttcctgccctgcccaggaaaaagtaatgccatcccccatcccccatcccccagtgaccataaatagcactttctccttcccctgttatagcacttttcatactgtgttagagttcacatttctgtctctctgcctcattgtgatctatttgagtgccaggattgtgtgttattctagcgcttggcacacaggaagaactcaatgagcatttgttgactaaatctagactcaaggtcatccaagatattatacaaaaactttttcatcgaaccatttggtctgcattgtggaaactgaaacgaatggcactccccgttaagagaatcccagtgagaagccatagcattgcaggaggaagctcaaactggttaactttgctcatgccgatcagtcttagaattttttgtaatgtttccatgatgaattagtttcagctgtatttttttggcaaatatttaaagataatttttatttgtgtggacttttcttcttgtcagtttgtcataaaggtgtcatctttcattcactaaccccttatcagcttataggaattttcctcgtgggtggttgcttgtaaccttctcttgactgccagggatctgatatactaaacggttgagatactgtggtgatcagctgcttgtaaacaataactgataaatcggttataaattatcaacacacttcagatgaccatatcatcatgacttggtgatagcaaaatagacttctgaattctcagctaatccaggattgtgtcttaacaaacatttatgttgattaatcaggagggtgtttagtttaagaaacatgtactgaatgttcaatatgtgagtgccaagtgcagtgtggtgcaacctgtttactgcttcaggtgatctccagatatcctaaggaatttttaactgtacagcttctttggggaaggaaatcctaagccaacaacctgagggtggaagtgtgtgactgggaataattaaaatgcctcacaatggttcgagcaggaattccataggaatgcactttaaggcatttaggaaagcaaaattccgtttggatttactccaaaccctatgacttcagagacaggaatttttgatgattagtggctggagccccaacttgttatttagtaattccacattcagtgtggaattgttttttctgtagcactagttataagttctttgtttgtttttctaaaggttttaaggaggtttacaaattaagatggaataagacattagaaacttaaggatacatagcaaattaaaaccttgatacatttggtgctaagcttttcagctgctaaagatagagagttttggccaagataaagtatatagagtcaaagacacatgcagaattctcctggatataagttcaggtacctgtgccattttatcactttagtcaatgtgcccattttcttagggcaggtttaattttctgctgcggcatggcccttcagctttcccaagtttacgatgctcatctcatacctgatggaaattgttgataatgttagtgtatggttggtggctttcccagtagcccacttcagatccttttattggtcatcaccagttacaaaagttttaggaaagggaaggagagaagctggaactgatggctaagtaaagttatagctgtagagctctggttgtccataatgaacagtggcaatgaacagtgaagatttaagcaaggttattttttgagggtccactgatgattttcctataactcgttaaaaatatttttaaaacttttatatggcttcatataaaaaaagcttaaaaatctgttcccagacttcctaggcaggtatgttttcttttcagtgttgccttctctaagactttatcagcagaaggagtatttgagctgatggcaaatgctgccaaaatgagaagtgtgtgtgtttctcaaaactcatgatcccacagttaaatcgagggtgtgggtaaaggacccagaactgttcttgctgatggaatagcacacttttcctcagacattagtagagtaaatgaatggaggcagaggattgggaaacactcttgaaggagggagtgcccatcagcctgtaagccaaagtaaacagttcttgtaactgaaaaatagacttcctggaaggagagaaccagagaagtgggtgtgaagtgcaaccagcaagtaccattttcagtgatacagacagctggcttaacctgagtcctgacaagaacctctcagagctatttggggaaatcagttgcttgaaccagcctttgactggcctatcgttcctacagctgtacccaaagatggcacttggggagaaaaggtcacatttgtttgtgatagagaaagcaaaccgatggggcattttgagaggtagaaatgaagtcatcatttgcggagccggtggaccagcagaatggccgtgggaaggtatccctgaacctgtatgtgtggaaatgcaggcattctctgtcagtcttttgtcacagtgagaaaatgtcattacagtggacagctatgcacacgttggagattatgtgatgtgtgcatgtgcatccatgtgtacaacatacacccatgcaaaaattgctcacagggtcatgtgcgtgtcctggtagtctgttatgtccattcttctgtaataggagtatgtttttcaaactgaagctgttaggttctgttaattccaacagaacaaaaaaaaatctgcctctggccatcattcgttaatttacatagattagatacatgtagtctgtctcctaagtggcttatataaagccgtgggcgtcttttcctgtgtctcctcttcggcagttcctaaggcacctaccaggtttatagttgctgatgtcctacccatactatgtgtcaagaaaggtagactcaaaaaggattgatgcagatattccttagaagttttcatgcccaaagattcttggaccttagttgcatgagggaagaggccttgcctcgtgaaaggagaccgaagccccttattaaaggggtcactcagaaaaaggtgttatctaaattccctctttgtagttttatttcttcaatgtattccccatcactagctgtgtgtgctggagccaaatgttgggcccactgccatcttttaaagaatgctactgtaaagggataactttactagacagtttgggaaatagaagaaacaattatctaaaatgctcttgttccaaacacaaaaactagcttcatgtttttgtgtataaccctgcctagtcttactctgtagacatccttccccccacacccatcgtgtatgttttttatccccatctaacattatatcaaatacattgtcctatgttgctaccttgtcttcattattatgatttgtcaagcaattgggttgtactgactgcagtgttactcctcatttcctttccccctttcttttccatactacttaaaaagcaagaaaggaaaaaaaattctatttaagagaaaatcctatgtagtcgtaatggaatttattttcctgagtgcctgggcgtgctccaaacagatagctgtgattgtgtcatctcttcttactaagcatctgaccactcactacctgtgcatctgatccctaggctcatggcatgagggctgtggctcttgatgttttttttttgatgtgcttagtatcaccagaactgtattgactctaagagtatggaagctttgtaaagttaactaacgatttgtaggttttgtgcaaatagccagctctccaggtagagacattttaattctgttgctttttttttttgtagcatattattatattgcagatgtttacttagtatgaaaaatggatataattaagttctaaatgggtactagatattaacttcaaaatgaatttgcaacttgtatgctttgcatatgccgtatgctttgcatatgccatatgctgttgtttccaaggatgtaaagcagttttccacttccaccatcttataaattaaaaccagagggctagacgttatccagcaagggacctacaaaattcgaaaaaaaacttcggatcattatcaggattaagtttgttgaaattgtatcaggaaaatagacttttccttgtattattattgactcatataatgcaactcatactggtttcatattcagaaggtatatagcacctgttgtaatatttcaggttgatttctgcaatctttatttaaaaatacaaatccgcaaagcaaattgcataaacggtatacaaaatgaaatcaccaggcttcaaatatattttatgtaaatgttaagtgctctttagattagcaaaaggaagacaaacattttgattacctctttaatactaaatttttgtttctgaattataaatctttgaagatataattagtgtaagatatataccaatcaacatagtccagaaaaccctgaacctggctgcttattagttggaaagagtacctatttagactttctaagccacagtatgtggctaagtgattaatatgcactattacactttcacaaatactttttggaccaacatattgacttaagggagcatactttgtactaaaaaactaatttgaaggtgaaatcacagcaaatttaacagttcaaccttgtgtatttgtagagttttagttggatcataggataatgacattagctaaagtcagcaagcatgtaaaataaacattttgaagtttaatagtcatttatgttctacaataataaatatttggcacccaccataaccaccactaccaaaatatgtatgctgaaattgtgtctccaggatgaataaagaggtgtaaggcaagctgacacccattagaaaaaaaggtttagaaagggagagagggcctggacttccctaagcttaaccccaacatagggcctgtagctcctgttggaaccaatttataaaacttcaaggtgggaatcaatagattgtttccagtgttatatagttcctctttaatcagttgatcttcaaccaaagcttcaagtggtttttgtttttatttattgccaaaagcttcttaaccaatgtgattataaatgtttaaattcatttacagtgaaatggatttgtatcttccttgctctacagtagatagtgaagcctccgtgacctgtgtaagctgcaggttgaggagaatgtttaaacagtaggcgagcgttcatacagtgtccctggactgcatttccttgcttacagagccttggagctgggccaactcgcatgagcgggaggaggagaggctcagttttgagagccctgggtttatttctggctgtggggatacgagaatgtgggagaaggtgtaaacatagtttgagggaggtcgtagacttggaggttcttgccaggggtaaatgctggctggatttgtttatggatggatttgattatagctgcttcacgcttttacctctggagttggtgcttccaaggggtgatgctcattgtctggatctcctttagtgggcatctcagaattctttgctgcaccaaccacagcatttcttttccctttcttttggtatttgtattcaaatgcctgacttcctgacctgctgtgagggtttttaaaaataatgaacaccaagcttcttgggaaaagacaggtatgtaaatactgcaagcttatagcatttgggggatggagttgtgggattttggagtttgtgacccccatgtgtctgtgtatcactctctctaatgtagagagacagagcagcagttcctgagctctgtcttttgtctcttcatgggttggtcactgatttcccctttcagggtctgaatccctttcccttgcctccccccatgtgggttccggaaggcccacatccaacagctgcccttggtcaacccccagccctgcacacaggtgttttctgctgttcagagctcaggggcgctgtccagccagctgatgacagctcactggtggcgctggtctcactccagtgctggctctgccctcttggccctgttgcttcctccttggaggattagtcaccccagtcttggggcattttacccacctgtatgactagcacacattgcatccacttgccaaggagtgttagggatacagtctcaagaaaacctgcccagtagaaatgacttcctctggagaaatttagatgataaattccatagggagaaatcatgttttattaatgagaaacaaaatcgtgcactagtgggagttcaggctcagaagccagtgcatagtccagcctggcgacctggcatggtgtgttaccctggccaaagctccccaacctctgttcatgatttgcctctgtaaaatgggaataacaatagtatccatttcttttgggtggttataaggaatacttaagttaactcattcatgtaaagcacttgaatagtggcttgtatacagtaagcacacagtaaatgtacattgtcattgtatctttgtacctcaacatctgaaactatggtttatacatagcacatactcattcatgctttgttgagtaaatgtaatattcagaaggtgggaaagtgatttccttctctcttatcataaaataagagttatatttggttgaaataaggcatcataggcctgaagacatttactccctggctgctggcaggggagtagaatgttccaaactctatgttgataactgggtgcctatgatttgttaatcatacctaacaaactcagtctgtcaggtgtttcagtaaaatttactgactcccaaggtaattttgaaaggacaaagccatcaggtgatttgttttcaataagcattattgggatatttcagactccaacatgtgcagtggagatattaacgagactttaccctttctaaacttaggggcttactctgcattgtaacgtatgtttgcttttaaggcgatagatgggtagatagatgctctgtaattgaatagcctactgggcttctgtgtagcacagcactgtgtaagtcgcaggtgttcagtaaatgtattttaaatcaatgagtaattgatgggatatttttcttcacattacatcacattgaagatgcttgtgaggaagttttgttcatgattgtcctcctaggcaggcgccacctaacatgtttctctctagctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctgcagtcctgttatcagcattttgtaagtgcttcttctcattctaaaaatatgtattgattttaaaaatgaattctgtaacaggatagcaacagtagtaaaaatcctttttatggagaaatttagagctttcagctaacatacacacatactcattcaaatgaaacagcttgtcttgttttaaagaaatatttctgttgtccattgtacaaattttaataacttgtctttcctttttttaggtctctgtgttccagatttttttttgtaactatgaaatccttgccttgtagtcaacttaaaatgaaataaatttatcagtgcaaatgagtacactgtggttcttgtgtggcaaaattatgcaggtggtttgaaggattcattgttttattaaaagactagaagaatgtacaaatgctttccttctttctcatgtttctctcacccaaactgaagtggtccatttaaaatctgatcttcataaaaggaagagttgtcacaggacatctgatttatgagccatctgatttgcttctgctgtagttccacactctgctggggtacaaaaatcaggcacttttatttcagccctgacaacagtgcggccttcccaaagtatgagaagagcagcgtgcagaggttatgtgcagtcttccgaacagagcactgaactggtttttaatgaagggtaatatgtacttggggtccaaactctagttaattccggaaaacatatcccctcactagtgttgggtcttagtaaatgagtgttctgtgttgaatccttgcttgagaggaaggaggtcataattggtcagggattctatttctttctttctctcttttttttttttttttttttttaaagaaaagcaattgcttagaatgagatgaatctatatcagggtatgtttttgtaggatcatattaatcatcttacccacagactgactttgtggtcaaactttactcataaggatttattaaaagcaatggtttggttaaaaaaaaaaaaaaaaggtatgtttatgggaggaatgtagacatttagttgaagtacagttgatagactttgaccactcagggatattttctccatggactgtcttacagaggcagagcctaactgcatatgcttcttatgactctgatgcatgaatggcagccctaaatgggctcctcttcacttattccttctccccaatctccccagcactgtgttctgtttccttccctgcaagagtctgcgtttatcagtcaggtactcctgtcctcagagtgccaggccagctctgcatccttctccacaagaccaggctgaagtctgcctgttcacctgttgatgctacacagtttgagctcaagctccttattctttgccggcttcccttttttgagttccagtggagtggtactcttgtgtcagagggattcagcactgcccactatgtcatggtactctgcgctgctcctcttgggtctggatggggccacagttgtccagtcccatcatgctgcagccctaagctccagagggtgaccttgataggatgcacatcctggagcttaatttcataagccttgggggcctgcaagcaggaggagttggaagcccttgagaggccagatcctgtgggtttgagcgcagagtctacagagttaaaacctgcagaacaaagaaatcaaaagaaggacataaagaaagtttgggagacattgagtctgcaaagcaaagaaatccagtattgcaaggggaagattttgctttgggaggttgaagttttgtttgccctccgaatgaaagtggtatttctgttcgttagccaaaaaatcatcagactttgaaaatcagtgaggtcagaggactgttgccacaccaggaatcagaattgtggcattggaagtttcttcagaaaagcacctttaggcccgcccaactttacagattaaggaagtgagacccataaaagtttgtcatgttctcttattttaaaagatatctcgaccatgtctgcagttatggcctctttttcctgcctcacccaaaggggtcgaggagctttctcttgcccactctggagagaactcctggggcccccccgctgctctccctgccccatgactttgtcccagaatacagaacacagtgggctggatcagcctctgctgaacttttccctgccagcctccctgcccgccttcttgcccccgcccctaccccccacacaggaatctagagccctcccagtggtggtgtgaagcctctggaatgtggcactctgacccctggcagttgagtgtcctggatggacctggcctgggaaacaggaaggactcgggggagggggaaggagtgccccatggccttgaggtgggatggagggaaaggaaatgctgcccagcgcggccccacaggcagctcccgctagactcccacactgggggcggggctggcagggcagggagccggcaggtttcctcagaccaggcctgtggccccggggcctctggcagagccaggctcaggaaggtgaactgccagagcagttggggtgaggaggaaaggatgtgaggggaaggaggaggagcaggccagaatgcagaagcaattgtagtaggagaggacaaaggtgatggatgagaaaaggaatgtccagtgactgtgtggactagacacacttctcactttagaaaccaagtatattagaaagcggaaaagaccctcctaaagaaacttccagccaggtgcagtggctcgtgcctgtaatcccagctactcaggaggctgaggcaggagaattgcctgaaccggggaggcagaggttgcagtgagccgagattacgctactgtactccagcctgtatgatagagtgagacttcgtctcaaaaaaaaccttccatgccatttttattttagagtaaagcacaccccatttggataccccagtgctttttaacatgctcagccttggcaaagatagggtcactggggttagtgaaaggggtgggtgcacatgcaagtgtgaggccaactgttactcacctgtccctttctgttttctttcattggtggacccacctggaccacacttgggtctgttacctccctcaaagaggtttccagaaaaacctgaggacgtgcctcagggtgatgatatgcccagcagctctttgctcctctccgggattagggaaccttgtatcctcaacttcctcctaattaaagcctttggcagaatcaggatgcagaaccagggcctggaaccgcctcagtaaacccctgtggaaccactagcagatcatgctgtttccaaactgcgcgtgttggcaagccagcttttcactggggatgtttaaaattaaattccatgctcttgggaaaggaatagaaactataggcagagtctgtttctgaaacacctgttttaagtggaaagcgatcctaactgctgccatacctgaagggcttgtgtttcctgtgcagctggaatctctctgtgctgagtaaattaacttctgtgcccagggtagtcttgaatgataattagtgctccgtggccatgccacacatcctgtctgaagcaagggtgctaataatgtcctttcctctcttctcacaagacattatatgaagtcctaggaatagtggtcctggtgctaaatagaaatgtcgtggttatggcactaatttattgggcctgccagcccaggtgtgcagcatccctttcctccacccgattgataagacaccaggtgaggtccagtgtgatgctccaggcagtgctgcagctgagttggcctgtgtctcctggctcaaggggtgcatcttctggtctgccttgagaacttaccagtcttccataaattggaagttcaaagcaatggaatgaacaatggagagaacaagcacatacacataagttaaaagctgtgcatctctgtatattctaatcctttgaaacttggtgatcattattgttcattacataggatatggatttgatcagagcatcctttgggagttgtctgcatttggtatttccttttatatcctgaaagctgttagttcttgaaaggtgtattgaacctaataaaatagtaattagaggtatttccacaaattgtgagctttgtcatttggatagtgtttttgagacttcttttccactctaaataccaactttaaatagaataatatgacagaattatgatcttgaaaaatttatctacttaactgcatgtgggaatacatatttctgtagcatgtggaaaaaggactgagtgatgcatacctgttatatttacattttcttttggaagcaaattattttctacatgtgtatgtttatgcctacatgtgttctaatttgaaatgtaaaaatctataaaaaatttttccttgactgctatgttttaaaatatctgaaagttacctgcttcctagtccttggaaggcctgaattattataaagtttatttctttgcatctcaatcattcccaaaagattttaaatatgaatgcataagtagtgaataaacaaacctgaaagtttgatacctacagaacatttttaaagctgcttctttttttccatgcagtattgttagtagagtataatactagttatgtcgtagagcagtcacttactcatttatttacttcagcaagtggatattggggcctgctgtgtgttcagcacagagtgagtatagaaatgagggaagcagtttctgctctcaagaagctcagcaatgccttaggataagggaagtgctgggggcgggtgtgctggaaagagagagggatgggtggaagaaaattgaaaatcagacttctttgaagaaaagatacttaagctgggcacactatggtagtagcagctttctaggtagaccggaggaaaaaaaagtgttcctaagcagagaaatgggatccgtaaaggcccattggagtgaacatgcatagtatactcagggaatcagttgattgagtaaatatttatggaggccctactatgtgctgagccctgttccaggtgcagaagatacagcagtgaacgagacaaaaattcttaccaactggagctttctgatagacagaatcagccaaattagtaaggaaaacatacagcatacaagaggagagaagtgctacggagaaaaataaagctgagaaaggggacagagacaaccacagtggtatctggtttgcagttttaatggtctgccaaagtcttgccagaagttgaggttgattgaagacctgaaggtgtgctggagtgaaccatgcacacacctggagtaggatgttccagacagagggaacacaagtgccaaagccttgaggctgcagtagccggggaagggaagagcagctgtctgcacagtgggaggtaactggacggtcagctagggctaggcacaggcctcatttatcagtgtgaggggtcagacttgaccctgtggtcaggagagtgccatcatagatttatagatacggcttgtgctgtcatctctgggacccccaaagtgaggacccagtgagttggagctgagtgtctgttaggtatagaggtaagatactacacaaaggaaactcagttttgtgaaaaacgtgtaaatatgtttttcaaacatgttcttaagactttttaatctttctatgttcttgttgtctggtttatttcccatgaatgttagggatcagatcactgctgtgtaaataatagtccacccaaggtattcatatgcatttcttgacatggcctaaggcaagagtcctgctttccattgtcccctaatttatatttgcttctttctggagagttttaaaatgaatttcaagggcttgatgcctttaaaatcagtggatcaggccctgtgttgcgagatttcttaatgggccacagttgtctctgtgattctcatttccagtttatagcactactgtccacctaaacatacactaaccatgtggatcttaatgatgttttaagaaaaaaggttttgacatacatgccagacttccacttaagatgaaactgggcaactaggaaatggtatgccgtacatatgaagcactgtttattgaatattggtggcaaattttgttttgttgctaggaccagattcttggagtgtgtagtaggaataaataagaccaaacacaatcttgcttcactgaaaaaaaaaaaaaaatcaaaggtttgggtttttaggcaagatatttagggaagatatttctttgtagaccagtattagagttaatggcaaggatcagtagtataattgttggaatttatgtcactctttcatttatcttccacttggtttattttgaagacttcagataaattattaaggtaaagtgcataggagtgctgaagttgatttgtaaaagcattccttgcaaaaatgattgctagctgatttcacaaagttgttatcctgaaaagattccttattgcaacttccagatcattacaccttttaaaaactattatttgcttttcaggagtattgctgtatatgaaggtcttagcaaagaacctctcgttttcctcgatgatagattagttgagatcatgtttatattggtgggttttcagttctgatggctctgcagctctgttccttggctgcaaggtgtcatagaggggcctctgcttgtcctggtggttaaaggaccatcagcaggagtctccaggccgtattactggagacggacctcaccagagtgagatgggagaattagtggtgttcctgtccttcttttccctgatgctcaggtcttccggattgacattaacttgaaattttgcccagcctttgactacctcactttcctgtttcttcagctcctcatgtcccctgctgggtgacagcctatatgggatttagacctaggttgctcagcttccctcctcagtaaaactgatgaatccatggagagtgcttattccagtgtctggcacatagaaagtgctcagtgagtgttagctgttatcagaagattagtctcagggggtgaaatgtgctttattatctgtgctacctcttcacctagtataatgaaaaatgtatatccttcacagtgcttattttcagagcaccatgtgtatttaattgttagaaggtctagtcacatttcttttcactctagtggttcacacttttggatgtgtgcaattcccatacctagtcttctggtttactcttggtgatttgactaacagattttaggttagagcatccattaatatttataaaatggtactgtgcattattcatgtcctcaagtcacattctggcaagaagcattaacgtgtgtcacattatctaattattgtcataatacacagaagtggcaggaagggagattaaaagtttattatttaagttattatttatttatctaacatggttgaggcatattatattcattcactcttttgacatgtcataaatattgatttgtggaagtgttgcttgatacagtattgaggttaaaagaaaacttgcgctaatattaatatttcacaagtaggaagactgagatccaaagatgtttctctgttatttctaaataattgactttcttcctctaccaacaaacttactttccagaaaaagtttgctgctcaaagattcacattgctttgattaaattcatgtgctcgtcctctctatccctatttattccttctgcaggtatttattttgctaagctactatttgctaagccctatgatagttcagtgatgaagagtaaaaagtagatcgttagtttcaaagaacccacttcgggtaaaggagattagatgaacaatttcattgtgctgctgtaagtgaagtaattttaatagatatgcagtagaagtcctacactggaaatagtacttaattcagtccctatagagtggggaaacctaaaggaagtattaaccactgaggagaagtttccagtgcagatgaagagaagtagctttctaggcagagagaacagccatgaatgtcatgaaacaacatgggacattcaggcaattcatagtcactaagtcttactggaggaagaggaaggcatggcagagatgaggttgaagaagtttgctgggatcaagtctaaactggctttgtgttattccatgccgggtactcaaatgactgcatgttggacttcattttgtagaccattgctttgcaactccatatccttaagaagtttggttaggctgttctcttaacactccttgctgggtgttacttacattaaagcacctctgtaggaggataaaacactgtgaaccaggtatgtaagagacagctaatgacctggcttaatccaaggatgtctttttagagtatcctgatgaagagatcaaataggaaataattagacatttctccaaaatacttttttcctcaaccaagatttattaatttttaagtaagagtatgtttgataactgaaaattgatatcctttgaagctggataaacatgcagttacattttttactggacattcaagttcagagacagctgcgttgcttaatcatggcatgtgtctgaatagaaggctgatctagcacagcacaaacatggaacaggggagaagacctgagattttccttggaaactattggattttactctcaaagcagagggaatataagagagttaaggtctgtgccacaaagtgcagctaggaaaacatgtaaatgggcattaaatacctaccttggtgatttaaaaaatttcggaaatggagccattcagtgtctaactttgagtaacttcctggtaaaacctcaaaagagaaagtgattgaaaaaatagacatcagagtatctggatgagttaacatgctgtgtgagactactcattaaaagccatttataagatgtcttaataatctttctcaagaaccagttttttaattttgttaactgtttttgttgcttttactttctccatagatttattatttccatcctccttgattctttggacttactctgttgctcttttttcaagttggatgcttagttcattctttttttttttttcagcttgtcttatgccctgtgaaatttccctttaaacactgtcttaactgtgtccccatcaatgttgacatatggtacttccactgttcttcatttttaagtatttggtaagttccctataaacccctcacattaaaaaatctttttattatagaaacttccaaatatatacagaagtagagacagttgtgtaatgacagagtgcttcagcagttgtcagttcatagccaatcctgttttattaaacgagatttactgagacctcagctagtaaatcctctaagaatggagatactggaaaggtcctggaaagtgatatttattacattaaaagacctttggcttgccttactctacatagtgactttgttttcaaaacaaagtctaattggtctgataatggaacattattttaaatttaaattatgactgccataggcatatgattctctggcactgtccccaataaattgttagcattgtacaatttcaataaagatgctagaatcaaacacaaggataaagtctaaaggggcctcatggattatccattctatgtcctttttgtaattaaaaaattggagcttagagagctaaatgccttgtttggggtcctgccgtgaatgagtgacagagctaaggttgtggtctcctgggccaaggtcctctccattacaccatccccctctgggctgtttcttcgtatgcagtttaagatggcccctaggttaggcagaactgtgaagtaggagagttgtgtcccgtagccccaatttctcctgtccttatcatttcttgtttcatgaaacatgaaacatgaaactggtgcttctctgttagttgtattgctgaggtgtatgatgaaaagtacagcaatgggacatatacttaataacaaatattttgctgtaagttgatttattatattggatcagtactgcttgtttttcagtgatttcctcacttggacataatacaaatcagtgttcttgttgtttgttatacatttagacatttacatcagtttaaaagttagtcttcaacaaatatttgtgtccacactttagtattccattgtttgaaagattcaggctttgtccactctggtttatagttacatatgcttaaaattttttcactttgtggaaatgtctgtaaaatacatttttgtaacatgaatcatttctactgataaccataaatttgcccttcctgctttgcactgattgcggcacaaggaagagaaagagaaggaagcaccagctttgggaacataggccttaagcttgaagcagagagaatgaaagcagactgtattagattcctcctcgagcagaacggaatgcctgataacagccagccaggagctgggggagttaagagcagcgattttacattacactggagtttttaggctggcatgaaaagagatgccagtattagctatttgcatcttcctgtagccacagggatatgtgaacagctggagaattaatttgatatatattcccaggagcttctcttctgccaacagaattccattactgtgagcttctgcgtgtgtactgtgaatttgtttcttgctttttaatatctgctatagcatatttctggtaagtggattgccatataataggatgcagccatctcttggtttggagtaaactctattaacctaaacagatacaaggtggaaaaggtaagaatctgagcatacaaatgccttccaccttcaggctggcagaaatttcatgtgaacacacagtactttgtccagtacgtgcactcatacctgaaatgttttgtttcatgttagtggaatttcacacaccagcaagcagatggaaagatatgttgaagagcatagaggttgaatccaggaccactcaggctagtgttgccacagctcgttcctgtagctccttagcacagggggctatatctgctggagctgcttcttcacatatctggtgttcgttatgcctccacacatcttgtaagaggcctcatgcttcatatccttctcagtgcccactttcctgccctcaggatggaaacttctctccaactagcctttgcattgaaaatctttcatgtcaaatgtagaaggaaagaatttcaggcatcaccgagaatattgaaagatattcttagaggagaaagactaagtccaggacaagactgaatgtagctattggaagtacaggtgtttcctgccttggcaatataagttgttcactcttataaagcaaataaaaaaacctactcatattctgcaaaatcattcattacactaaaaataagagagctgttgggaaaaaatagggttggggaaggtcactcaagacctatgcatctgtgtgtatagaggataaatgcaaacaataagaactcaaataaaaatactggcccaggtgagctgtccctggcatttatttgcacctggatctctggtagcccatgctttgcagccctccacactccgaagctcattctgcctcctttcagggcacggggtgttgaagatacttacttttcatgtggaacggtgttaccagaattaaacataacatccagtagtttcttcatcattgtttttatgggggttttttgtttgtttgtttgttttgttttgtttttagtacaggggcaagtgtctccagccttctcatttctgcttgcagtttccccagatagtttaatacagaggacattttaaccacgagagcagtcatttcttgcactaaagaaaggaatttaagcaaaattttcagccttttcttcaggtcttccatatactggtaagacttaactgtgagaaaacttgctcctgatacttatttttatttatttatttttttgacagagtcttgctctgtcgcccaggctcaagtgcagtggtgcgattttggctcactgcaacctccacctcccaggttcaagcaattctcatgcctcagcctcccaattagctgggattacaggcatgcgccaccatacccggctaatttttgtgttttttgtagagacagggtttcgtcatgttgcccaggctggtcttgaactcctggggtgaagtcatctgcctttcttagtctcccaaagtgctgggattacaggtgtgagccattgcgcctggccaacttttgatttttttttttttttttttttttttttttgagttggagtcttgctctgtcacccaggctggagtgcagtgacatgatctgggctcactgcaagctccgcctctgggttcatgacattctcctgcctcagcctcccgagaagctgggactacaggcgcccgccaccacgccagctaatttttttgtatttttagtggagatggggtttcaccgtgttagccaggatggtctcgatctcctgacctcgtgatccgcccatctcggcttcccaaagtgctgagattacaagcgtgagccaccgcgcccggcccacttttgatttttttagaacattaatgtgctgggaaaaatcacatgagaaccagcagaaccgctgtattatactgacaccattttcctatttaccagttacatattggctaaatcacattaaagaaacattcatttttatggttccacggtaactgttagaagaggtacccagcattcttttgttattccttggcctaggtgtacctgcaggacatgctctttagaacagcagttctcaaagtgtgggctacagaccgcttagaagcctgaagccctttttgggtggtaaatcaggtcaaaactaattccataatcctattaacattttatttgcttttttttctttttccactttgcactaatggtgcaaaaaaaaaaaaaaatggtacataaaactcctgatactttagtatgaatagaggttgtggcaccaaattgtgctagtaagttactgtattcaccgtgtactttcagtaaagcaaaatggtaaggaattaaaataataaaataaaaattagtttccttgaatgcccttgatcgaagcaatacaaattattaagtttattacatttcagccctcaattatacatcttattaatgttctgtgggatgaaatgggaaatacacataaagtaattctgctgcatactgaagtacagagcttgtcatgagaaaaagtgttatatttcaagatgtcttctgaacatccaagtggaagtgttggtttagcagtttaatatacctggcacttcactgtagtactcaatattggacatatttgaacatatatgaatttgaatatatttatgaaattaggtttctctcttttatacttagagaaagtaacttatgtaatatcctaatttggtatcttgcagaaattataaacttaaaaatacatttgcagaggtacctcagttgtcttcacctttcaggctaggagactacatcttgtcacatttagggtaccaggaaaaaacctacttcatatagttaaaaaccagtacctctgtttttaactttttttttttcctgaccagtccaaggagaaaccaggagctatgttagagaatcagaaccttgattcttgtgctgtgtatgtggatttacttaggaaaagagagattttaaaacataatttgccaactgctgttagcagaactcttgggctcagatttgatttccataatccaacctcattacatttttgctttcagtccttgttgattttgttaaattattttaaaatatagtgttctgtaattgaataccagaaaagcatttgtctcagtagcatgttgtacttgatcctatgaagcggtggttgctagggaaaccatttcccaagaagaaaaacaaagtattgattaggagcgggcagagaattgaaagagtttactctcaaaaaaaagaaaataaaagtgtctacgatgttgttagctttagagtcagtgatgcttcctggctgaacatagtggcagcaatgtttctgaggggaatggtcacctttacctgagcatcttcaggtgagtctgctgctgctgccaggaaacttctgctgagaaagcagcagaaaacagcaaggggccagcggcctcatcaaaggccttttagctgtgattccagatttgagggaaatggtcttcctgtggggaggcagagaaaagcatctggcagtgaaaaccaattagctgtgagatgggctgcttggaaggactgttgatgccagccaggtgataagaagttgaagtcttagagctgaacggggggaagagagtaatgatagatgatgcctagtgagaaatgtgcccagtattccaagcatttctttgaaatgtgtgcctcatacagtgctgtaatgataagcttttaaaataggatttgtattgtttaaacatgttctttatattatcttgaaacatagttttccttgtgatgttttgtatatatgtgtgtgtatatatgtatacacacacacattttttaattagacactttttttgttaaagacacaactgcattgaccataccagtgacatatatgtgtgtctatatacacatatatgtataatacatatatatacatgtgtgtatatatgcatatgtgaggcttctttgtctaccggggaattatggcttacataaaaccactatggtaggggacaacaggtctgtgcagatgtttgcgggagcatagaggatggagcagcttattctcctggggcaggtagagaaggcttctcaaaagaggtaacatctgagctaggttttgaaggatgagcaggagatagcagaggaagaagggaaggaggtattccaggtggacgacactcccgagtaaagcatgggagcagttcctgcgtgtttctggtaagagcctcaagtgtgcctagagcattaggatgtgagagcgactggtgaaaaatgagtctgcagaagtagctacaagccatgccatgaagaagctgatattcagcagtaagaagctgggacattttcttattgccaagagagaattactgggcaggtttgttttttgaggaagatggatctggggacattgtggggaatgaggtggagagacaagagaatagtggcagggagccaggttagaagacattgtggtaattcaggagagtggtgtcttcagggagttccagttagaatggtgggaagggatgtttactgtggaaaaaattctgcaataggatcaactcaataactgcacatatttataagaacagtaataaagatttcctcttaaaactgtgaaggaaaggaggacaaatatacatggtttccagtagttcaaatgttacttgaatttcttacaagttttttttaattcctagggctaaactgcctttcagttataaatttgcatatgtagtcacaaaaattccttcatggcaaatctgactgaactgtagtaaaatgctagtactactggcatgttaacagttaaacagataagaaatcacttggatgcacattttgttataactgaagacaaatatcaccttcttttctatgttgaattttttcaatatggtgtttttcttctttttctgattttcctttcagagtactttactaatttcattgttgtcttgaagataggaatgtacctttatgtgtctatgttatatttgtgtgtgtgtgtatgttgcttctctctgtctatatatataaaacatatatatatatcttatatatgtatgttgtttctcagaaccaaatttaggctaaataggagaacagattttaaataaaacataaattgtgtgtcggtataaacttcaaatctgaaagataatcattttactaaaagctgaggctttgatcaaataagtgagcctgatctcctgaaatctaaaacaagagattttctattctcccttttcaaaggaccgccctgaagctctttatgtagtagatgacattcttgtaacgacctcttgatgagaaaattatttatttcagtcaggaagagcagacttttacttcacttacgtactgagcaatgatgccagcaataaaagcttaccctataaaaataagagccatttgtttgtactgtcttttttttttttttttttttttgaggcggagtttcactttgttgcccaggctggagtgcagtggcatgatcttggctgacgacaacctctgcttctctgtttcaaacaattatcccccttcagcctcctgagtaactgggaccacaggcatgcgccaccatgtccagctaatttttgtatttttaatggagatggggtttcaccatgttggccaggctgatggccaggtgatctgcctgtcttggcctcccaaaacgctgggattacaggcatgagccaccactcccagccaaaaacagatttttaagatggcatttatacctgccttagtttgagcaagaggtttaaggtttcttaaattcaggtactttaaaaaattctcttcagatatgcttatcagaaacatgtttactatgtaacagtcagttcccatttcaggtgggtaaagtatctgttaaagataatgttaagtgtgaaaaaaccccatataatggcccaaggattcacagagagaaatagtctaatttcctatgaggaatattatgaagaattgagcctgcatatgattctgtcgtattcattgcattttttggagctgagtcccatgatagctctttttaaaatcgaccttatttattgtgacctgctccattccatgatcagaacctgatttggtctcagcctttgtattcagttacctcagcctgtcactaagctgcaccactttagtttttttgttgtttctggctttgggttggcagtgatggatactatcagtctccccaaacgcattagaggggatcccctccattgtaactcttttggtggtgtctgatttttgatgttgattattagctgccttaatgtagtaagttgaagagctgttttaaacctaaagttggtctctatcaatagagtaaaaaattagctttttaaagagagtctcaccctgtttcccagaccggaatgcagtggcgtgatcaacctcgtgggctcaagtgatcctcccacctcaaactcctgagtgctgggaccacaggcatgcacaaccattcccagctaattttttgttttgtttttgtagagactgggtctcactgtgttgcccaggctggtcatgaactcctgggctcaagtaatccccgtgccttggtctctgaaagtgttgggattacaggcatgagccactgtgcctggccaaaaaagagctctttaaaaaataattttgtagattgacaaatgtgactcttgtaattttattgaacatgaaaaaacccaggaatctttatttgatattaaacatttttaaaggcatctcagttgttgttgtaataacacattaagagaagtagtggttttttatttccaacctttgtgcatatagctatttaatgcctacatggatggctattatttcacttttttcagttattatgaagagattgggtttcattcatttgtaaagtttcagccagactgcctttcacaaattgatttgtcaaaattgaatgttaatcttgacatcccagtgcgtttttgcccgcgaacaggcctttgaatgaagctgcaaacacacattatctggttgttaattgttttacagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaaggtaagcattaatttttgttaaccatccagtcgtaagccttagcattatgtaaccctgagtagtaatagtatttgagcttgaaaaggcaaagacaagtttacagagagtggtagtttgtataatcccaactaagatgcataaagtttaccaggtgcttatgtggtgggtgtgtttccgagacgctatggaatggcggtgctgtggtggtgtgagcagggccctctgtgccagccctcctaggccacctctgcataatggatgatttcacaagcggtgtgcttgagatcagcatctgttgtcaccaggtccattctgtttgatttaccgtaggatggtgctccatgaggagtctgctaattagaaatgcggctcatctggcatgaaagagttatctctttagcagaaatgggagaattatgcagtgatgattgaaggcttaggttggttttgctggagggcaggaatcacatagggcgtggagggatcattaggctcttcacctctggagataagtcagaaattgcattcaagtaacaagaaaattatactgatatggctcataacttttgtacattcatacatacaaccaagaaaaaacttcaagaaattgaatatatgactcatcaccacagtaatcttgagtgaagtacccagagcttggtgccatggctcatagccaaaaggggtaaagcctgggtttgggtctcagctctgccgctaaccagcattaaactctcgtagccccagtttcttcttgagggaaaaaagtactgaaagaggcattcttaaatatacctcttatctctaaaatgatgtcgttgtaagatggagtgattggtaatataataccaaggattcttaaagtccaaaaatcaagcttataagggcagtaaagcaggactgaagttttggaaatgtacttagtttccaagttatattaaatggtaaggaagaagaaatttgcagtagcctacaaaataacatttctctttgtatttaccagtgctcctgaatcattagaaaagaatagagtagaaaacaatagaaataacatttgcgaattgcagaggatcctagagaacatttagtccagtccttgaacttgaacactgggaaactgagtttccacgcatttgatgagtatcagtgctagtactaatcacaccaagtattcttcctgtcacatcatgacttaaacaatgccatgggttacctaactcatttctgttgttcggttgccctttgctccccacacccattgcctgccacaaaagggtattttgccaacttcagtatgtaaacatttagggatatagatgacgtgatcacatgtctgtttacatagttaataatttacgcatacacatttaaacttactcatataaagtcatacacaatttagaatcattactttttgctattcttacatttcaggaagctgtcctaaatggtgagtgcgtcaccattgctgtcattgtctctactcaggcccccttccaggtcatttaatcccctgctcctgaacatgccctcttcactgccacctaagttgtttgagatgcagcagattttgaatctaaggatgatgctatcccaggaagttttgtcccaaaacccagtgtctcgtcacataaaattaggacaattgcatttgtaattagttaggcgtgtatttatgatctttgcaatgtggagattgacatgtggagattaactttattgatttttaaagtgattctaaaaaggctgtttgtgagatccagcatttccaattttgagatcattcccacaggaataattaccgtatctgattgaatttctttacttgttattttccaacttattatttcagatggcttctatgtaatccaaatgtggaattagttgaggtcatttaaggttaatgtatcttctacaaacagtgctttgttattcaaaataaagtaccaggcagtatgtgagatcttgtaagaagtcaggattaggggatttcccttttctgagaaggaattttgaaggaaaaagcatacttatattcaggtatatattgtatatgaaagaattagtgatgaaatcatacttaataaatagtcacgtcgttaatagtgacagagacttggaatgctataggacctcaatgccaagaaagtatgatttggaattgtgtgataaggtatcatggagggtagactgaacgatttagaatagtgatgatgatagatttcagaagtgaggccaacatggacgaaagaagaaaatgtggaagtgggaatctgcatgacttacatggaatacacttgggaaactggtctgaaagagcagagttttatgttggtggacaataggaaataaagattggagggaggataggaccagattatgaaatgtcttaaacattgtgcaacaagcttaagccgggtaatatgagcaatcagaaatcattataggtttatgaacagacagaatcagaaagaagatggtgaagtcaacattaggcagactttggttgtggtggaatgcaaactggattagcagagggagataatggcagtcaagaggctcgttggagagcttttcagctgtttagatgtgttaccacaagaaactggactagagtggcagcaggaaaacagcaaagaagagatggatatgcaccattttgatggaagaacctacggtatctgctagcaggaaagggaaggatgaaaattacacaaagatgattctagggtttctaacctgaaatagaatgatagtgcaagtaatagaagtaggaagacttttgaggagtctcgtgataaaatggtactgaaaataggggtaattattttagggcaatgtagaggtcaagaagagcttaagaaaatataggagatactacagcatgtttggatcatgaccggaatgatttagtaagaaggaaaagccaataatgtaagaaaggcgattgcaggagcaaagactttaaggaataaaaaggacaaaattgtttgtttctcagggaagtataaaagaaggtcatcatctgacattgagatggaagaaagggtgtggaaaatcaaagagaaagaggaaaatgtaaacagacatctttaaaggagaggacaaatgaattaactagggaaatgtagtagggtcacctactggtgctgacagcttacttgaggttagtggttatgcctttgaaaagaggctggccagcacagttgcgtgattttctctagttcttatgtaggtgtgcagtttaggtagagaggtagccggttgggtattttcttgaccattctggtagaaagagagagagggagtcatggggattgatgattatataagagaactttatggtgattgaccatttaatctacactgagaaggagacaaaatcagggagtcagtgatatggagagtagaggggaggttctagtgggattgaagaattaatggagtgagatagctaaggaagcaagtagaaatgaatacttgaagagaaagttattattggttgtaatgagggttagaaattactatggatgatgtagttgattgaagaggggtgaagaacaacatcactgggggtgggaggtcagataggtgagtcaggatggagtgcctctaccaatgatgaagatgccaaggaatagtagcagggaagagacatggagccagaggttctgcaggtaaatgccacacctccgtgtggctggtgataacctaattgcttatgcttcaagtggagaaagttttattttttaaaggggaaaaggaagaatgatctttaagtagcagtgagaacaaagaggatacctatgccccttccaggatttatggaatgtgggagataaagccattcccatttgagaagacttcaagggaaaaagagtaatcaggtactacctaggtttcaatttacacaagaaggtgaagggaacatccagatggaagaatgagggcagaaagaattttgttgataagctctagaaggcacagaatgggatttgggagggaggcttgtacagggcatgggtgattttgcaaagccaggaggggttaagagtgcagtgatgatggatgacctggcgaatttagacttgctctcgaatctcttacaggaaggtgaatagtctagttaaagcctccttttagggactcttctttgagtagtttatagtattaagggtgtgcagtggtggggatagggcaagcagaatggtattcttggcagagcataatgagaaaacatgggtctccatttctgtgtttttggtggtgatgctgaaaatgaattcgaaatgttgctataacattttttaaaacgtgtggaagtcattgcaggccatttcaatgttatagacttatggagaatactggaaatttctgggcattgaaaaagttcctgtgtattacttatgtttgtttaaaaggagttggtcctcaattttactcagtgttttcttttctaaaatacttgaacatatcaccataaaatcagtttgttaaaaatataaaggaaataggatactggataacagtcagccgtggcttagtgcagaatagtttgtcagagtgatctgtattttctaaggaagaagtctgataaagggaatgacctgcaagttatcccaccttgatcttaacaaagtttatgcttccgtgccttactacttattcatcagtgatttgggatatgttagactgagcaccacaaaagttaaattagtgcaccatgggcacatcagtttgatgcagtagtaaaagcagtgccagcctctatagcgccagcctctgcagctgccacaggtgtgttctaggggtctctctgggctcagtggtcataagtaatgtcaataccaaaggtttccatgatgcagtgaataagttgaacttttaagtttgcctataattccaagttgggtacatggcttttaaaaaaattattgtaattcagtggtcataattcaagaattaatcagaaatgtgaaaccatgccacatttggtgaagaatataaaacaccctggaaatcattcatctgtttatttcatccagcaagtatttatgaaatgccagatacatacgtggcactgttgtagttgttgaggatacagctctcatggagcttaactccaaagggggacttggactgaagtcctgccaccggaactctagcatggagacactttcagctgtagcaagaaaccttctgccatcccctaagtacagggaagacagaggctcccagctctgtgcccacccacatttttatacagggctgaaggtccatggggagcctgggtgtcatgcaccaagggtgtctcctaggtttctcaaacttgagagagcctgatggtcacacaggcagtaaatacataaataaacaagaaaatagcatatggtatgataaaagctttggaaaacagtaaccagtatgctgtgatagagaattacttggaaaattgctgtattcagggacctcagggacatattctatgaaggaagggcagtccaaactgaaatctcaaagcccaaaggagtttgccttatgatgacctgaggagagagaattccatatggacggaacagcaactgcaaaagctctaaggagagaacaagcttggtgtgttgaaggactagcaagaagaaacagcgtgaccagaatgggggggagggaggggtaagggccagaccacctgagcccttgtagaagatgatgagatgtatggattttgtgatgagtacacaggaaagccattaaaggattgtgagcaaaggtttgacatgatttgtcttttaaaagatgaatatggtggaaaaagagactggttggggtagggagatgtaagagtatgaacagagctggctggtaggggttcttttagtagttcatgtaagagataatggggactcgtacctgagagctggagatgaagagaattaggtgcattcgagataccattggaaatagaattagcaggagttgttaatatggatgttgagggaaagagaaatcaaagagtactcttcgatgtggagtttaagcaaattgtagtgccctttactagagggaggaccagatttaggaaggacccaggagttttgggcaaattaaatttgacatccacatagaactatttgtcacaagcaatttttaaatgtaattcagtaactcattaagtagaattcatacatacatgctctatggtgtataattacaaagagatatccctgagaaaagtcaaatctctccagaaaaagttataacctcatcaggagtttgtatagaaaaataagaataacctactttgcagtgatttatcaccaggcagaaactggctgaagaggtgtctgtgttatccataaaatgtgttttcatcattgctgcatcacacatcacatgggttagattggtgtagaatatgtggaacctagtgctgcttgcacagtgaacattttgcaaaaggaggaagacacttagggctttagataattctcctctgttttagctgaaaacgtttggagaacgttgaatggtttatgatttttggctgttttgaattatttcctctatatagagaaaaaatagacaatcaaaaattggcgtgtgatactatacatcattgttttatattgagtggacaaataagaaccgtgttgcattcataagatggataaatcaaggaaggttttgtggaggaactaggaattgggtccaactctgagaaatttgttgattggctcagcagaagggaaggagagtttaagagcagccttggatagaaaagagaggacggacagagaggtacagataggaagatattaaggaggccaaatcagtgggcttcagtggctgattgactttcggggatgaagaaagggaagacttccagattgtgggaggactattatcaagataaatgctggagaggaggtggtcaggatagattttgggaggatgataggatatattgtggtgtcatttattagaatgtgaaatacaaggagagcagctttgtgggaggttggatgaggtaggtactctgtttggttatgtttgaggtatctatggagaatcaaggggaggatgagagttacaggtctggaactcagagagagatctgagctggagataagaatttatgagtcaccctctgagggagactgtggtgtctaatgactttttgagtacataaatgatgtgaggagtatgagcatttttaggaagattaatgtgacagtaatgtgcataatggaggaaaaaagtgactggcaatgttaacacacgaagagtgataccaagtgtatcttatacaaaaggaccccgtgcagggaagctggcacaggaagtgactcctctgttagcatggtagaagaaaatccaagggttgctactgttagccaagtgaaagtctaaaacacaattgccagtgcccatgatattgagatgtataaaatggaatacattattttaattaattgttaattgattggttgactaatttatactcccttgttcaaaaaagcctttaaaagtatctgactatagtagagctggtcagacccacacctggaattagggctagttcagagtagaagcactgaaatgattaagtaattggatagagaggtcaagaaataggattatagtcatagactctttcagtccagaaggtactcagcattctctacaagtaccttccgaggcgaccgctttcagtttagagctgctttaattgttgattcattcatgcatttattcatgtattcattcaaaaagaatgtattgagcacatgccatgtgccactacacctcagattcactagggcaaatttagtttgcttttacctgaggactattttctaaatgacctaaattgcaacacattttcaatatactatgggagcttgctttgtttttttgtttttatattttgattttacattgtatggctatgttctctgaaatgaaactaatttttacacaaagacttctgttttatagccttttttcttttcatttttaaaagcgcagataacagttgcctcagatcattaacttaattatcctgtactctaaatttactatttcagtgctacctaaggaaatggtaatatcatgagttttttattccatttttagttttttacatttcacttatttcacttcctttttttctttacacaagtaaagcgtacgtgctaaattttattctcgattgttacctcgtccttggtctagaggctgtagtacaaccctgtgctgtgtgtggcctaataaaatgttgtaaatcttatgtcatctgtaatgtttgtcagtaaacaaatctttagtatttagaaagaaatattatgccattttttatttatataactttttttctcaaaagcattttgggtattttttatgtgcgtgggagaaaatgctcacagaaaacacccaagtaaatgtgatctggtggagctgggagtattagcattcatgccgcctttgaaatagtgcaacagaatttcctcttaatgttcctgccactagaaccgcttcatggagacacttttcagctgtagcaagaaacctgctgccattgcataagtacagggaagacagaggctcccagctctgcccctacccgctgtcccatacggagctgaaggtccatggggagcctgggtatcatgcactgagggtgtctcctaagtttctcaaacttgagagagcttgatggtcacacagagagctggcttaactaggactagactagggctagggaaatctgcatttccagcaagccccaggagaagctgctgctgcccattttcaccacagtttgagtagaaaagttatagagtgtttatgtgaatcgacttcgctgcacagagaaatggatttgttgtgctggtgtcagagaacatcatatcttcaagtagtcactggacctaattttgatttccactacttctttcattgtttttttaaaaaagcatatcttatacattgctttgcttcaaatgttaatacatggtaatgatttcattatgcaattaaaaaatttttttctcaagtaaatgttaaattaaaaatgaaatatttcatattatacaggacctcatggtaagggacaaaacaaaccctgggactcggatgctggaaaaatcatttgcttttaatagagttgatccttttcataggtttacccatttggtctttgctaaactttacaaatatgtctaaaactttatgtctatggattttttttggcaattatattgatctcctgtatggcattaaatgccattatttcaaaatatttcctaatatgttattgactgtattagaaataatcattaattcacaaaatcagatatactgaaaattaaattatatgttctccaaaaatataattgctgtttactatgagagtattatatagcagagttaaactaataagacagtcgttacaaattatcaccactgtaattgttccattggagggaggatggaaatgggtgggttttgtacattttataaggtttatgaagtttaagggaaaggattttggggaaagctcttggcctttccaaactgctgttaatatactcattgatagtggaatatatgacctttgatggcacttgggaagctaaaggaaaaatcagctgggaccttgatgataacgaggtccctgacccacccggaaggtgaggttaaatgtgttttcctttggtcaagggaagggaattccagatcctttgctcatgtcaggaaaaacctttgtgggggccaggacttagtgttttaaacttgataagtcttactagtttaactctgctaatatttgacccctcccccccccccaaaaaaaaacaaaaaaagataacctctcaaactgattctcttactcgtcctgaaaccaagcattctgtattgcaagggccatgccctctttgcttcaggactttcatgtgtacagattcctaaattttaagttacacagctgcttcatcaaacttactcatcatagattctagttttcttaggctagttacatctgaaagtggtattatgcttgtgaatgtgttgctttagctcatataatttgtttaaaaagtttattttagaggaatccagttaacactgcttatcaagtttagaaacactaagtcctggccccctcgaaggtttttcctgacatgagcagaggatctggaattcccttcccttgaccaaaggaaaacacgtttaacctcaccttctgcgtgggtcagggatctcattatcatcaaggtcccagctgatttttcctttagcttcccaagtgccatcaaaggtacttgtttataaggcagtaagaccattatgcaactttaaattttatcccactctgtttgtaaagacaatcacaaattgacaatattctttgtcttttcttttttggagcatatatacagaagcacacacacatatacatattcgtgtgtatgtatatgtatatctgtaaacacagatatgtaaagtgactttaaaatacaagtacatgtgtttcattttaaattctagcgatgtcattgggaaagaaagtgtagacaaagttacatatttttgtaagtagtgtacttttatttacgttgacagttaatatttaaaaattttttgttacagatacaaattttggggagaattgtccttagaaacatgttttaaatcgttgttctgatgtcttgataactggtaccaggaaaataaaagggttaccaaaaggcagaaaccagtttcaaattatctgggaaataaaaacaggaaactcagggaacttggcctgagaccagttggagaggagcagttgttggttgaataattatacctgcattttaactgttggaagtcatacagcgaccttctggttgttgtgatttcttgtgcccgtcaaaaaaaaaaaaaaaaaaggaagtcacgattaaatatcttatgtccagttaccaacaggagtgtgagtgtaaaggagcctctttattcctacacattaggttacaaaaaggattggtataaaaaacaaattttccagttgacatttagagtgatactttctatacagtcatctgtaaacagcataataatgttctataccattcattcatggattttttttcaccttcttctttgctttaactcttaactctgagctttgaagccatctcttctgtccaaagatgtgcctagttcaagcacttttctgtcctctttccatacctaatcccaggttggttaaaggagcaccagaagttgtaggtgagcaggttttgctacatctgggctttatttcaggattaaatagaatgtacttactatgtgtttttaaaagagacttattgttaatattgcaaggacaaaaacaacctgacaggttgagccagataaatggtgttcttgagggccgtgcctaaaacttcaccaacccaggatgcctaaaaaatgttggtctaatgactgaccttagcagggtgacatgttcactgctggggtagccctgagcactcctgcgcgtgtttgtggtttctgacttggctgtaggtgacctctcagtttttcccagggctcggcgtgtgctctgtaacacagagctgctgagttgctgctttgcccagctgtgtccggctaagccctggcccccacaaaggtttttcctgacatgagaaaggatctggaatcccagcccgggaggccttctgagctgctggcaaaggatgctgtgagtggagaccactccccatggcagagctcccttccctctaaggggagctggagctgtcccttctgtgtccacaggggttctccgcctcctgcagagcggagctgcagccccaggcttgtctccatcaaccagagggtttgcataagcaggagctgtcaggcaattaaaacctcgttagttagtgtaattagtattccaagaccatgatctgggattttggacaactcaaccaagctggacagtttatatcctgcttatgagaagaaaaaaaaaaagtctgtgcaagggaagttcaagaaagagtctgggagcataaccactttagcataaactcacagacagtcaaaaaagtgatcatttcaaatgttcttataattttatcactataggtaaggaatctctattagacactgtgttttttctactctcctgtcttgccagtattatatatttactagtatcttgattaagagatcctcagaggggaaaaaaaaaaagctcttttaaataaagagagttttaattaaaaaagaaaataatttgctaatgggaggaagcagggctgaatgcataccatcatacgtaaaaatataccactaagcaaagccctactttcctccagttcttgttgaaggttaatagagctaaccttacatgaaaattgtaaagattgccaaatttgtctttttcccactatgccctccctattcttttagtttttttccacctcagaagcccagcatcatctttctctcgtttccaccagtaactataatctaggaaaaattttaaatttaaatttaccctttttgattggttgtaccctagagtgttacctctgccagcatccccacattttaatcttaattgtgaaattcatattgaattcaatccagaaagaaggagcaaggatttctgcagtcaatgataccccttcctgactgagccctgctcacttggggaggattgtcctggggctggcccattgcataggggcatttgagatgaatatggaaaggacctcgccctaagaagtctagtgggagagatcatagacacaaggagttataatgagggtagagcagccatacccagtctgaatagtgttatgcccggtagacattctagaagacattgataaacaagaatcaaagctaactttaatcagtttaaaagctactttgtgatttatagacacatatgtttacttctagaattggcacttctttgttctttgtgaaatgtgtaacttaagaaaggtatttaggagcactaaaattaaatatttgagtttttttaaagaagcattctaataataaaatttgactcattccctagttcatattgaccttcactaagcatactgttctggggcatttgaataatttgtttcaaaagctatgagaccattcttttaatggtgcatacgctctaagataagaataatggattcccattggttgatgatacatgcaaaggtagggatatactcttacagtgtgccttcctgcttttgattcgtggtttctcttgctaagtgttttctgcatcaggaggaggtgacagcagtaagtggtgcctgtaaagttggaaaagggaaggaattaacatgaattaatgtctgtgtgagtttttaaggaactggaatgtccctctaaatcgaggatgtgttttttttgtttctggttgacaacttcctagttttcctacacttcattattcttttctctgtcactgggatttttttttcaatttcccgaaaagcaaatgaagtgctttatccttatcagtagcctttcttttcctgttccaataacaaaagaacaatacaggaatttaataatgttaaaaaattgctgtgtctttttcttaatatatccatttatatgtctgcagataaaatccaagttttacagacatagaggaaagctgtttatataagtaaaatgagctactattgtatcttgtccttgtcagggttttctttttttgtcttttcacccagtttagaaagtggattttttttttctctttaaaatgtgtgcccatgttctgttattaagaggaaaagtcctgaaaatacaaagataggtgaaaacactggttatcctctaacagaaggacactttaaagattcctaaaacacattctgatcttgtttatgtatctatattctattaaatattgttatttactcttcctgctgctttggaaaaaaaaaaagtccaatctgcctcacagaccttttataaatatcagagttgtggttttgcaacagtgtacatgaaaagacacttgtttcagtgtttgagttcatggcagggtgcattaacgtggcgtctgcaagtatccttgaagccacattgaggagggaacttgggacttgttccatggtggtcctgctctgacctcagaggaccttgcttgctgacttttttaaggcatgaaacaaattctcatattctcagtcgtgtctgacgcagatctgggtactagtcagggttctaaactgcctaaataaatatcttgcatataacatctaaagtgacatttatctctgtggtactaaaaagaaaatactattccacttacatgttcttggtgccctttggcattttgattgctaattacaataggaccttcagattgccttctgattgagacctaacttatttctgtttcatctggaatttttcaaatacaattattatgtggtgttaacacttcattgcagcatggaactcccaaaaatgttgtgtatatattctttcatgcctctcagcctggcttcatgtctgtctaggtacaggtcttattataatgttgcccttgggggtccttttgatatatcaagaactaaacctctttagtcaggagagtgtattctgtatggatttataataaatagtctgtgttcatatgcataggaaataatgcattttctgaaaaaaattatgcatgtcacttgtattttttgtactttatgtgccggaagaacattgtatacaaatatgtcccatgtgcatgtatgaatttatatagctacatgtatataagcacatatacatccatgatgatatcataggtaatatgtggaaataagtgcaaccatgtgattatttttatcttattctttgtgtgtgtgtgtgtgtgtgtgtgtacagttacctgtgtgctattaaatgtgacagtgccgataatagtgttacattctctggttaagtgtttcctgagaattttggtcttccttaatggtgcacattagttatagactcttaacccgtgagatacattccagtggttcgtttctaagaatcgatgtaatattatgcactttgtaaatagcttatagaggataagctatgactcctgaaataaatattattcaaactgcttccattttcatttcccttatcactataacaaccacacccaactttgcaattaaattgtgttgtctatctgcttcccgcacactagtgaagctgaccctattgaattcaaaggaaatatgagagataaagtcgaaaactgtcttccttttgttgacatttctaaagcaacaagtcagaaagcttgactccctttaggtagaccagagctgctacgggtcatgattagatggtatgtccactagtaactgtgatgacgcccaacagaattatttgaaacattctcagtaaataaccaagaactccagtaagcaaaaggggagtagctgttaacttgcagtttcagttttctacaaatgggggcgcagggggtggggggcgcacggaataccgaggacaaaggtaaagatcgacatagaatggaagtcaccagatttctgcgtttaacccattcttgcccagcccaagtgaaattgtgttttggagaagcctccatatttggccatcgagagattggcagtgggaattcttggctgtattttactgctctctttattgaaatatttgccacatctgacagttctgtcactgttcagttcagagggatttttaaatcatatactgactttgatgcttcatggatttgtattatttgtgtattcctcagtcatactaacctttgtatcaagatttttgccatatgactcatatcaaagtttttaagacatatttaaaacaaatgaattttaaatagtggcccatttgctatatgttaaatttgatatacaaaattttatacatcttaaatttatatatctttgatatcttaaatttggtatacaaatggtggcccatttgatatatgtttgcttaacataatgtaacatgattgattttgttatatttcccatgagctgaggtactgttgttttctattaccagagaagacatttcagatcttttaaatcttatgtgaagtacttcctaagaagagaagtaaaatgagtatatctcacattagttactattatctgcagcatcaaaaataaatgaatatccccaggaaaaaggttataaaattacaacacctagacacattgaggtaggtagtaaatgtgaaatgggcttacgaatgactttattcacttactggcatttgggagggactcaggctgtcaggaaaatgaaccaatctgtattaatataaagcgctagaaatataaataaatcatgtttgaaagcgataccaggattttccttgaatgctgctgaataaattctgcttgttaaatgtcagtgaaatgtatgtcacctgcatgcataaagtgagagggccacaaaaaacatccacttaccactttgaaatatgtaagccctttaatgttcctttgaccttcagttaaaggacatagtctcatagcagaggaaatgcctcaaattctagcatctgggtttgtttctttatacttttttggcatagttacaacagtagggcttttctgtcctttaatttttttcacagtacagtcaacacaggcttttcacacaagcgggaaaggacggttgtgaggccaaaagcaatatgtttcttctctgtgctccacggcagagcctaattgaatggcttgttgtttcagagagagcccagaaccaacaagcagacaaacagaatcccacacaaatacaaattgcgtataaaattagatacctacacacgtgcgtatcaatggatatgtactaaaaatgcagtcagcgatctcttattttgagctcattggcttagtcaccgtgttccaattctttcatctttgcagtttttggattttcatctgaattttcagctggctaaagatgtttcttctacagctgaaaagagaacctagtttcattacatacacttgtaaagtgtatgtatttggatgggggtgctctatttcagccctattcatatgtcaaccatattgtcatttatcattagcaaaaggtcacttttaagctttgcagaatgaaacggtgagatccgattttccattaattaaaaaatatacatcataacagtatgctggagacatcttcatatatttgtgttttccctgctttacatccaataggtttctgtgtatgagcttctcctgagactgaataatagcagcacaccctaatgcaccttttttaatgggaattcagttgggtaccatatgcctttctcactgctgaaggccttcatgctttggcatctctgctctcatcttaccggtgattgtgggccatttgtctggttctgacatggaaatattaggaagcagtgctgttatatacaaatccttatagccttaaaattaaatgcagctctcaaaagcagcctaaaagttaaatgacacacaaaagcttgttttgtctgaagtttatatgtttattctgtagagttacattggatagggtagttatcagcccttagcaaatgcctacttagttttccttaatctgttattcattcattcattcaacaaatatttattgagcgcctgctctgttcagacactgtgctagattcagggcaaacaagacagataaggttctagtccccccccgagctttcagtcttaagtggcaaaaataaaattatgtgattgctgttgacgtacagggtactgagactgagataggatagcttgagaaagtctctcctctgaagagctgatgttttaagttggactgaaaggtaagaaggagctggctgtgcaaagagctcgtggaagaacattctagacagagtgaacttgcccatgttcagtgaccccagtatgggagaaagagttttgtgtcccgagggacttaaagttgtgatgtggctgtagtgtattgagtgagtgttggggagagtggcagaagaggaagctggagaggcagggaagggctcagttacacagacaacatggtaaggagtttggattttattctaagtataataggaatccatgaaagagtttgaagcttcagatggagatgagaggatgccctttttaagatcaactgtggctgccatgtggaaaatggattgtagcgggaagctagagtagaatcagaaacattatttaggccactgaagaagagcccagccaggagactgctatgtggctggaccagggtgctagcagaggagttggatagattctctgttccatttggaaatacagttaaaagggctcaattaggttggatttgggggtgaggttgggggtagacttcagagtgaccccagggttctggcttgagcagttggtaccatttcctaagatgggtaagactgggcaaaaactaaggggagtcaaaattacctgcttgagaaactgagagtatactggaggcagaagtgattctgagtccttttcttcgtgtggtgatgctatttggaaatcaagtcattagagtgtttcactacctggaacacatcagtaaaattgtgaaaattccaccttggtagctcttggttacagctcttcagctttgtcttgtgctgttttatctaatcctctgtctcttctgtaggctgtttctctgacctttggagaaggcttttgtttcttccccagggatgtcaacacaacccatatcccaatttgtttggcttccctttaaaattgttcatagattctttctgtaagtttttcactacatgcatctactatttcaggcatgattatcgtcacactagaatcccggtggaaccaaggctagctgggggaaatgaaagattgtgagtgtcatatctcatgcacactccagagcatgtggagaagcccataccatttaaatcattcttcctccatcccctaactgaggacttatgtggtaggaccttattatacttagtctatgtctgtgtgcttatcataccacattttattttcctgtgtgcctgccaatatcctctgaaagcagggacggtgcctggcatctaggggatagttaatgagtgtctgatgatttaaaaaaataatggattggggctgggcacagtggctcacgcctgtaatcccagcactttggggggccaaggcacgcggatcacttaaggtcaggagttcaagaccagccagggcaacatggtgaaaccctgtctctactaaaaatataaaaattagcttggcatggtagggtgtgcctgtaatcccagctactcaggaggctgaggcaggagaatcacttgaacctgggaggtggaggttacagtgagcagagatcgtgccactgcactccagtctgggtgatagggtgggattttgtctctaaaataataataataataataataatggattggaactatggaactaaattataaaagataactttcatgatatgctaaaaaatgggactttattgccattgaggaacctaaattataaaagataactttcatgatatgctaaaagaatgggaactttattgccattgcaagcttgtgaggagagaggtagcatgtgaagttaagactagaatgaccggttccttgattgaaaacaatcaataaaggtgctgtgaacagattatcagaaagtatctgtaagtataaaacacattcagaatttagaaaacaagatgtaactcctactacaacactgcgtttgtcttctgaaaggaagagacatcacaggtttagtattttttgacctgtcatttgattttagtttacgcctaatttcatttaagcttatccttttggccatagtcccatttcttttcagtgtttttgctgccagtttttcagatacagaaggaaagtcatatttgctgtgtgcagttggaagaaaccctggcacagttcctccagaaaccaaagacagaaattattagccatatccagaccagtagctgactggctccaattcttcctcccatgagctttcctgattaatgggagaatctgttctgtagtcgaacagcctctttcctgagcccagtctgtcctggcttcagagcatgaccagctgtgcagctgaagccattgccagggctctgtttctgattctgctcctcagcatgttggaggtgttggacggggaagcagaggggtgggaagagcatccaggtcagtttagatgtttcagcaggtaacagacgtggcaccgtccacccagaatcccgccactcccattggactctgtcctcttcagaaggctgtcattctgcatggtgcagatgttgcagtccttcccttattcttttgtctttttgtccagaccacttagctcctgtgtctgtggtgattaaatgctttgtaactttttctgacatccttttcttcacccctcttctctcttcccctactgtctcgcccaccatacctcttctgttttctgtttgcctttctttcctctcagctattgcattttcccctttacactgaaatagctttgtttattggcctgtttccagcaatattaacatatttcaattttttactcacctgtttaccaatttaacaaagctaaggtggttcatggcagtatttggggcctgaaatatgaaatactgtcatagcagattgtatacgttcaatttctgttacctttctcttacctttcttccttattctagactcaatctatttcatttcaggggtctgttatctgagtgtttggagtttgggatccttgtaggatcttcaaagctaaagacctatctccactgcatctctgagatcttaaaaacaataatatgaagatccagaataaattggtgtcagttaaactctaaccaaagaaggtttaaatgcagtgagcatttgagtgataaataaggtacggcccgaactcaagaggcttccagttttcttggggagacaggcatgaacaccactcactagaatagaaagtagaatgaaataagtactttcataatttacaggtacgagaaaaatgcacaggattactgagaaaggagttatattctgactaggaaaatcagaaattgtggcattttctgtgaacattgaaggatgaacaggatttcagtaaatggagaagaaaggcaggagggcttcctagaccaaggaggtgatggtggtggtgggtggaggagaattgtgcatgccgatcttctgtgcagcactgggtggcaggcacattgcacctaaatgagcactgactatgctttcaagaagttgggactaagggaacaggtgcaggttagaattgtagcctgaaggtaaagtaagagctcaaggaggagtgtttacttcctgaattttagaaatgtagcatgtttataaatagagccagcagagagggagaaattcaaggcacagtgcaggagtgcaaggccccaggtaacacgacagactcttctttgagtcctgcctctctcacttttcatgtttgagctctttttattgtttgctttttgagatggtctcgctctgacacccaaggagaagtgcagtggtgcaattatggttcactgcagcctccacctccccaggctcagcttcccaagtagctgggaatatatgtgcacaccaccctgcctggcgaatttttgtattttttgtaaagatggcatttcactgtgttgcctgggctggtcttgaactcctgggctcaggcagtccacccacctcggcctcccaaagtgctggcattacaggggtgagccaccgtgcccagccacttgagctctttattctgccatgtccgggttccccttttctatgcaatgcagaggtggtataaagccactaaaccaaggaatcagcttcagaaacaaggtaaagctgccttcactcaatgggaaatcacatctatagatcaccgctctgttggcagggtcagatgactgaggtgtcttgtgtcttgatcaaaagttttgtttccactgggtctctgtcctgaggtctccatggatctgtgaccttggacaagtcatttaacccctaggcaccttccttgccctctctgttaaaatgagatgatggtcccagcgctgtcttaggcctctgtgtcaccaccactggagttgtttaaaatccaggctgtataggttctgtctcctcttctcctcccactgccttccccacttctccttcctctctcctgctgtagtcattagcctgatgtatcctgacagtatccctgtaataaatataagtggaatttgctaattaaatgctagcatttttaaagaaagtttccagcaattggtagagtagctgagtggtttataggcttcctattcaagagggaggtgtcctaaggtttaaaattaaggttctagtcataaagaaggcttttattattaggacaacatggtaatttggttgagagaggacttactctctgcaacattaaaacatacatatacttttgacagtttcagtagtagctttgtccttttgatttacttctttggacagttgtgattgacatcagattgaacacatggttcagtaaaaactacagctccttgaagtacttttgttaatattctaatctcctatttgcatcattaacaagagcacattttattgccgcttgaaatagactcattgacatcccagaataggtagttttgatattagctacttgttaatgctgcccaggccattcacattccatgttcttgataatgtaccacgttcttagtacacagcccttacttaccacattgaagagactgaatgcactgattttaagaaggaggtcttgtgcctcctagggggactagctcttttagtattatttctcttatttctgaagcttatgttagaatctgagcataaagcttcatttcattttccctggagccaattatgatctcaaaatgagaagtgcatgagtaaataaatttaaagggggcttttgggaaatgttctgacataggcgatctgcgcagcacatctgaaatacctgggatgtggttatatacagtggtcatcatattcagtggtgacattcagaaatgatggcagtttataaataatcctaatttgtagcaaatatgtggctttaaggccctgtgatgtgattgttttctttgttctgttgatcttgtgactttaaagtggcattcagttctctgttcattttaaatgtttgtcgcttctgacttctgtttcctcttattgttttctgtttttgtgtttgagcccttaactcaggtgtatttatttccccctcccaacttcctgccctctttcttcttctgatatcttctctttgataaccatgtcttccatgtttagtgttctcttgccctccagcaacctatgttagtttggttcatttgtttaaaaacaaatctcctatttttgagaatgagaatgtggtgttattaactaacatttagagcatgcttatatatcagatgtccccaggcattttctatggattatgttatttaatatacccaagaatcccatgaagtaagttaaaggggtgaagtaacttgcccaagatttcacagcagggagaggtagagccgaggttggaacccagatggtttcattctggatctcctattcataaccaatcctgttactttattgtctcaactgttcagtccgtcaagatttaatgatcaccagcgttgtcccaggcacagtgcagacacaaggacactagatccctttctcttgccatatgtacggggtcttaagtgccatttgagaggttcttccatagcacctgtgcatgccagtgcctaactcttttcaaaagttcaggaggtcttcatccctgtggagctgaggtttgcaggataattaagagtttgccagctggggaagcagagaaggcatagggacatggggtaagaaaggagagcacagtcgacactgcaacagctctcatgtgactggagcataggtgctgccatagcagaacagatgggcagttggggaatacgtcgtggggttggttgagtccaggtggccaagggctttgagtgtcatggcacagaatttggacttcatttttcagccatttaggaagctagtacaaccttcttgagtctctcctgcctgttttgcctcattccacagaggccactggagatctggaaaccccgtggtgtttaacattggcagctgagacctctacgtgatcagcttagaggaaattttattgcagtagcattgtaaaaactagtgttttcatacagtcttttgatccttggtcccgcataactactgttaaatccaaaaccataagcagaaatttaacatgagtgcttatattcttaacttgtaagatgaatacagagatactttccaaagaagtttttaatgtaaatttaaatgtatgacttttatgcaggtatggtatgtgctttttcctgattaaatttcctttttgggggagaaattgagaatttaaatgatgtcatgaaacaaaaggctttggatactgttgaaaagctgcaatcagtactgtttaaaatgcttactcactattacaattaatctttataaagcaaacatctttcttgatgggacttttttcaaaaaccatttttattagtctgttttctggtggtagtaagatgactagatatgagcccagtttaaactcaaattcttacttttccactttcagtaagaaaaataattagcattaacatttcagtggaattgcaaatatattgccctagcttactcagggaaagggaattaccagctggcgaaaaagcagtagaatgaagtgtagtcaggcgttatctcacattgagattcttaggtggggactctttgaaacaaatctcaaaaaaattttaaaatccagaagatggcctcttttcacagccattaccttggaggcccattttcttgtcctaacgtagctgcccttgcatgaaggaggaatgttttttgtgtctcttgctctttccctcctttctttccttctttcctttttttatttttaattgccttcagtgtttgcagcagttttttcaatgcctttggtaatggcaaactttgattttttgaagttggatttaattttgggaaacagccaaaaggcatatggagtcatacctgattaataaaataggtaagcactttggagaattctatttttgctaaaacataagcttaaactattaggcactgaggcagattttattgtatatctcatgaactgcctttaaagaaaatgtcaaaaggaacattacagaaaaatgttgagaagtggcagaattgggatactagatagcttccttaggtgactttgaagaacaattttattgatgtgaatttataagtcctattattttgtttcttgggggatttgtctctattttgcggttttatcttatatattcaatatagttaatgttctttaattaaaaaaaatctttaggatactttagtagcactcagtctttaatttgaatgtctgttagtgtagtactatatatgtggggatatacctgtaccagttaatagagtgtgtagttaataaaaggtggcagggtggtaaacctttctccccctgcataattgaatagttttaagtgccatttgaaatcctgaatatccaagattggattccaataactgtgtagcctgagaagctttgctgtcagcagctgctggtgtttgtaagagttatttcactacttatcgctcttcagattcaccatgaatttaggtagtaatttaccattgcagaaggggcaagctctgcttctgatagtgttatgatactatgtttttgcttccttaatgatacgattcttgaggtagaaaaattaaaaatatgtggtataaatcagcttcatgaattaaattccccagatttaatgatgacagttttattcctgggatgcttacgctataactccctaaatgcttcatttaatacttcggaaatggttgttctcataggagctgttattgcaaagtcagtaatggctctggggctgaaatttgctttcttaattctagtccattgtcttttgttgtcatgtttcctcagtttccttagatatgtcacaccaaggactggttacagaaatactgcagtgcattatccaatctaagcctgctttactttctttcaaatgagcttttaagcatataagtagcgtatataatggaaacagaatttagggtgcttaggtaagaaaggaattacttccatactagagtattttacagctttgtttgatctcttaattgtctagatcagagattcttgggtactttcaaattcattttaatgtaccatagccctttaaaaatgacaaataaatttaggcagtttgttttcagaactgatttgaagaatttcagcatactatttaaggtaagtagtcctatactggggatcctaagctagagtcagcttggactcgttgaaccacgtgaccacccagggtttcctatagagcacgtttttagctatttaaaataattaccatgctggacctggagacctgtgaatagtccataaagttaattacaccttgagacacaccctctgctcagctactcaagtaccgtatccactttacaatgttcctttgttaacaagatctatgtggttgaagtatgtattatagtaatgtgcaattcattgtgtacagacatttccaaagtaagataatggtaataattacacagtaaaagagttcaggccttttgcgattgttgtgtagctaggatcggaaggctttgtaaacttgatatgtttttgcatactttgggttggtgctacctgattatggtactaaagtatttgagtcctctgcccttgtatcatttgtttgttagactttacattgttgactgggttccatgatttataaaaagatcccagaatcttttgtaactatttaaaggtcagcagctaatgataatcagaactaataatagatgcttacttatgcgccaggtattagtctaagccattgatgtgttagttaatacctctcaacaagtaagtgaggtagagacttttattattttatagatgaggaagctgaagctaggaaaggtgactgaggcccacagacttgtagtaagtggtagaacaaactaggcagacaggtacgtaggtaggtggatagaaagaaatagagaaaaaaagagatttaagaatagtagaaggtgtcagtaaaggatataatagctgatttcctgcctgctgtggtctaggcattatgttgggctacaaggaaacaaaaatgtatgaaactcaggcccagtcctcatggaaatcacatttggtcatggattaccctgatataagtgtaaataattaatgatgcaatgtgaacattttataaagtaggttgtgcataaagtctacgaaaatagactgagagaaggaatccaacttgtaggggaggcagagatgaagagatattcacagaggagaaggcttttgcttaaagatgaccacagtgccctttgagagtgggaaccatgtattgttcaaccgtgtctctccagatctctagcaaagtgcccaggatgtcatggttgctcagtaaatgttgggtggtaggtggtagcagtctggccagatgggtgaatgttggggaagagcattgtaggagatggacatatctgatgaaaagcacagaggcagataaggccatggtatgctcatccacagtagggctgtgtccttgggaagtaggacatatgggagcatggccactgtgctacttcacacatcactctccttttacttttagtctctactcccaacatcctcactttacctgctttaaatcgtatttgtatttcaaaaccctgataaaaatttctcacttcctccgtgaagttttttcagcagttgccatgcaccctagtctctcctttctctagtcacaatcctttttgttcctgccactcatgagcctcaatggatatctcacttacactgatttgatctttacaaattgtatgcatgtattaaattatcatatgtacccacccccaaaatataacagattgcctgcagtcacctctttgattattgttttcttttgttaaattatttcctctattctctcttcttggagtgcagagaaccttaggattcatatgctacccttcctattggtacaagaggacacggaagcccattgagatgaaaataattgtccaaatcacgtaagcagttaaagtcaggcccgggactgagtccatggctgagaccaatccatgctagctaatgttcctcttgttcttccgagctcagtagtgagtttgtggaggtgagggactgggtatcatactcactgtgggtcaagtagctgctcaggaacatttgcaaatgaaagaatgaataccacttggctttctgagtaatataaggataatgtggttcccagccttaataaacagctctagcagactaaacatattgatagtaagccctcaactgttagatatactcattcagaaataatatcagaagatcaactgctgagcagaattttcatgttaaaactatttcactaggagtactggtacaggtcggtgttagactcattactgaaaactcacttgaagaactctattagctttacatatttctagcagattaaacttagattacttacttttaaattattattggaagttagtctaagttattttccaatatagaatcattgtcttaatttaataattcttgcttcacaataacataatttggaacggaaattagattccagagtgcccttgtaattacaaattgaaaaatccttttctgactcaaaagggggcttactggtgacaaattccattatcagcaacattctcatcagaggctcagatgaggtggtgccttctgatgcattcttaagtgggtaatgggtagaagagttaggtgtgaggttattgctaaatacgaataaccatgaattatacaagatttattactcagaaaccaacagagtagagccttgcaattcattgctttaacattcatgaattcagttatttatgaaacagtgacccagaggatccatgtcatgtagtggtttgtcatttgaatcaggtgaagcccctgtgcaggggaaaatcacttagctggtgacaagccaaccacccaattgtttttagcccattatcacatatgtaggaagtcatgaactagtcaaaactgttttctttgtgaaagaaggcctggtgatgggagtgcagaggaataacatgttcctagaaagtgatgattctttaccaaaaaacagaaatctgggaccaattaaaaagccggcatgctgtatttggcaatagattgaatctctgaaatgcatagtccagaaccaagaagagcaatttctggaaatacctcagtgagtgtactggccagtgtaaaatttcactttctgggacaattatgatccatccgttttttataggaggcccagtaatgatatcttgactgaattgcctttttgagttacaatcattaatcttgaaggtcatttgagatgtctcaagtctcttatttaagtctttgagatcaagtaaaatccctagcatgtatcaatagccacctgtatcaaacattgtgtatgttttttaaataaagaatatctggctataggattcccttagcctctttggaagaaattatcttgaatagggaagatagtgaagaactggtatgtccaagtagaactaggaattagagcaatagtctggatcctggagctcagaaaatgggcagtaagtcagggacaaaaggtggcttcttaatctgttgttaaaaattacttagagtagaaattcacattgagccagtccatcaagctcccagtatcactaaagaaaacctgtggtactaccactcccccttgtttatatctgacctcccacaaggctccttttttgtatgtgtagtgctttccctattccagacacatttttatgttttttaattataacatggacaaaggatagcattgacataaaccccaaattttaataaatgactttcctgaaaatgagagtagcagtgactttaaaaatggtaagaaaaggagccgtgcgcagtggctcacgcctgtaatcccagcactttgggaggctgaggcgggtggatcacgaggtcaggaattcaagaccagcctgactaacatggtgaaaccccatctctgctaaaaatacaaaaattagccgggtgtagtggtgtgcgcctataatcccaactactcaggaggctaaggaaggagaattgcttgaacctgggaggcagatgttgcagtgagccgagatcgcaccactgcactccagcctgggtgacagagtgaaactctgtctcaaaaaaaaaaaagaaagaaaagaaaaagaagaggagaaaatggggaagaaatagagaaggctggcttcatcctcctcatttgctaggtaggagatctgcagtgccttcacaagactagggaggcagatgcatccactcaatatagggatagagtctttcagccatcagcaggagatgttcaggtaattaacttcccctcataaaaccaaggatcagaacaagagcagagaagcactgtttgaactgtgaggaagccatggcagcatgagagggtcttgtagacagaaagctttcagaggtgggagccgtaacaagccaaggcctgaagcagacacacaacttccacaggaagcattctaccatctttcatgttgagacaccctgtctagtcttaccagtggctctggtggaagagcttctactttcctctggctggacttcatcttctgaatgggttaaggagactgccagaggtctaaacttctggggattcagttgttacagagaagtccctatggtatggaggccctaggttgttcctcatgggcgctctctctgtctagggctccagccccaagatccttggtgtacagacagattgcccttgtattccatcttgcaggcctgccctggctcccattcctagcccatttgttcactgtgtctcagggggcgaggctccgcctgtgtggctgggtagcctatcagcacctggctggtggacagcactatagctgtcctatgactaaaggttgctcttctgacctttcttagccactccactaataaagggttatttttgtgttggtttggtttgtatgtttagctgatttcatgataaaggaactttgtaatcaaacactttttcagctagattctaagcaattttaaatattatgtaagagatcaaataactatcagtgtaagatgcagactacagactgaaaaatgagaaggttaggatgatgactgtgtgttttgatggaagcagtgcaggacttcccaggagactgggcttctggccctgccttgacattcataggtaaatgacccttgggcaagtcatttggcttttctaagtcactgttttctttactcatatctacgaatttctgattaagacaacttttcttctcctttgacaagtaagtcttgtagacagaatcattcccacatttgtatgtaatattgattcccctattctcttgtagttaaagcttcaaatctctaattcatcttttttgtaggaaggattagattgatttattgaaaattctgagctatagaatactgtagaagaagcctgggctttctgcttaaagttcatatatacagaaaatctaggcttgtggatgacaaagcgttttctgtacctcattgcttttattaaaatacccaacttattatagtgtctcttatttagcagttggttaaatattcctggagttaatgagtaagaatcttctatcttgtaacaaatagatgtagagctttggtaagaagtacacatattacttgtttgagtgtttctcaagtgattcagaatgctttacttacattcgctcttaaggcaaaatacttccattattcttacagttcattgtcttaggaaacttgttgcagaagtttctaattgtccccatatacatgtgttcattctcctcttcctgcgtagatataaaatgtttaaagatacagtcacccagaataaagacaccgttgagggaggtgtggccacgtgactgagtcctggtccatgaagtgagcataaatgacagtgctccttttcccataatgctgtttagagttgcgccttccccttctacttttcccctctcccacagttggaataccatatggacaagggctgcaccgtagggattgaatgggcaaaaaagctgaaaggaacttaggtccctagcacctgtgtggagcccaatccccataacatttatagaattaaatttcatgacactcttattgcacataacacaaattcccaactactggcatgtggctttgtgagagctgtttcaccataatctgttgagacttatttgtggaatcatgatgtcccgtgacatttgaaaatggaagagaatcctggaatatgggagcaacactgacgcagaacacagtgttcactttggaagcagtcatgatctcttcttgctgtggaagcctcaacagtttgcctgttccctccattgtactcctctctgaattctctctcaggcctagatgctgggctctgtgtgggttgctgtatggtatagaagaggatgagattggcggggacggctcttgttcaggtccatcaagactgtcgctgtcctctataccttgagccagctctactgtgcatttatagaaaagagagaccagcacacagaaagagagaaagcagctgtttttagggggaggagagaagatggtggagcttacaagagactgatgtttgcaagtggatatggtataaagtagtagttctcaaagcacggtgcctagacagcagcatcaggagcctgtgaatttgttagaagcacacatcctgaggcttcacccaagaccaggggataagatttggcaatctgtgcttaaaaaagcgtttgccttgctcacttctgagaaccagtggtctaaagagtgttgggaagcctgacagtggtagttacaagggtgtaccctgatgggagtcctgggatcaaaaagacttgaactagaagtaagggaccaggtgagggagcattcccttcagagagagttgttaaaataagccggggttctcatgatgctgctgaaaggagtgtaagtactgtacctcctgtgtttgggaccaagggtgtatctagccttaggcttccattccagcacatcccgtcagccagatgtgcaaaagttcctccgtatacacactgtactgcttaaattgctggtattttgaaatagaaaaaggtgcttataaacccatactgactgtgatgaacagggagtactttttccacctacctctgcttgggaggctgaaccccatcttgccctggaagatggctttgagccagaagccaagccctttaatggctatgaaggggggaaaaagtatgatttccatgtaagggctaccaagaatataagtacctatttaataaattatttgttgaaatgccttttctattttggtagttgaagtttgaaaaatgtttggagtactataattatcatttctgggaaaaaaatacacattgcagtatttttgtttttgctacaggtcaagttgtagttcaggatggaaagtaaacacatccctttgctcagctgcagctcacatatttgtagtctctgggtgccctcttggcagtcgtggtggatacccaaaggacacaaacagggcatagaaacgcggggctccatcaggggcttgccccagtgcaagtctgattaggaagtttgctggagccgaaggaatggcccagaagggtggagatgccttcacagaaggagtcctaggaccagaatgaggctgttctcagaggcatgcccacctctgggaggggtctgcagaagcactttctcaccagggagagcctttatggtatgggtctaaacactgggagatctttgtttgtttttggaggcactccttaccattctatgccatcttgtcaatttgacaactttgtaaacagggcccatccacacatcttgaatgtagaaatagctgagaacagtctccaggagaaattacctatataaggctgcttccttccttctctccagagtggagacgatttataaagagaaagtattggaagctgacagagaaacagcacttgagagtaaaacttttggcatgtaagaggactgtgtgtgtgtgtacccatgcctatgagtgtgtgtctgtgtttcagaatcaactttacctttctgagacatagcaagcatggagtgattacatctgtgccttgggacatcgcgttaggtgttaggtttaaaacaaactgaggagaaaacataagaacctgtgagtactctgtgtgtgtgtatatgtatatacacatatatgtatgaaatgtttttatacttacacactttatattttacataatatgaaaaagtatatattcttttactctccaaggcagtcttgtagaataaatgtctttatgccctgtacactctattcagcaccctctttttgttcttgctatatcattttaattacataagtaaagtcactttcagaaatctcagatcaacacacgatattctttgaagtctttctaaaaacatctgaaatccatatgccacctctgggactcgggaattttttgacaatattacgataatacccttggtttattgttccttgtctttaaaatcacgtaagatcacactttctactacactactaaaaactctatagagtgttgacaaatactggaggtttaaaggaacatgactggctgctcctttaattcagcaagcgtttgtcggtcttccttgaatgagcaggaactgagcatccttggaacctgactgcataggaagggctctcagaacatctggttggaatatgttcataggagacacccacaagggccagcccctcattttacagatgaacaccagacccttcactctgacatatttaaaatctgacattttattatgtacttttttcaaattgctgtcattgttgcacaaaggaagaaccaagttaccgtgtcccttcctcagtggaggaaaagttgatagaggttttatttgttgttctaaaatggatgccaccttccggtaaacattacttggggagttcttaatttctaatgtttatgcctctgtgacattttcaagctgttataaagagtcttcttaaaatgttgctgagctggctatacaaatttagttcatttaatttacctcattagtcatttgtcccattctctaataattttgattccttttttgtgggtcagtgtttatggcaaaatgtgttcggtgggggaggtattcagagaagactgtagtttattaggtaaaattaaacgttttgaaaccagtctttagttctttgtacatttatctaaaccatccttaggccttattttattgccagatttttaaaaaaataaattcattgttacattttgaaatttgttatggtgtgtgaatatataaatataattatttgaatggcaattttttctgggagtaggttggatatatttttctggtgtgaattaacagatgaaataaaatgtctctgaactcagtaaatatttgaaaactgttttaaaattcagtaggatgcaaacaggccacatttggcatccggctctcccactccccagtccttccaccccactacctcccataaaaggcaaatcctggaagccactctgaacttttttccttcctcccaggaagctctgacttttccaggaagattccagggaacactagttggatccgatttcctaagaattaaagcagctttaaatctcctgggagtgtagaggatgaaggggttgagggtccctagaacaataggtcagcattgactgcagattggagtcagctggggaactgtaaaaaaaaatatataccgataccagggtaccacttccagtaattctgtttaattggaattggtctggggtgcactctgagcttttggatttttaatcttctcctagggtttttaatgggcagctgaggttgacagtcattattctggcactaaattttcaaactatagtatgcatgagaatcacctctagggtttgttcaaacccagattaccgagccccactcccagcatttctgattctgtaggtctggtgggccttagaatttgcacttctagcgagctccttaggagatgccgatgctgctggtgcaaggatcattgtttgagaaccatcactttagagcagttcatctcaaactttactgtgcatcttgctaaaatgcagattctgattcagtaggactggagtgaggtctaagtttctgcatttccagcaagctcccaagctcccaggtgttgctgaggctactggtctaggggccacactttaagtaacaaatctctaatctaaagcatcattatgaatgcaattccataacatcgtttgggaagaaaagatgtgtggttcaggagattcctagaggcacggtggggccgatatatgccttagacctggtggcaggcagagatctggagggctcagtgcttctttggcacttggccagctgtggcttgccagggtgttggaacatgcccttggcgaagctgtactgtcaatagggagcttcattgtaaagattctctgtttgcttggagtaaggcagtggttctcaggcccaattgcacaatagaatcaccctgggagctatttaaacaagtactaatgcccaggctcctcccccagaatttctgatttaattggtttgaggtgggatccagacagtggtatttttaaaatctttgtgagtgattttaatgcacagccagggttgagaaccactgaattaagaaatcacgttacagtcttacagatcacttttttccctttatatttggctaagttatactgcacagtgatgcaaactagctttattaggtagtcaaaaacaatttaatatggcatttttgacaaaccaccaagaaaagactctgcaaagattccgtcgctgttaaatcctaaattcggagtcttaagatagtgctgggaaagtgcagtgggtgtttctgaacgagcttgaaatatgaaatatttctgggactgtatcaacaagtctaattttttccccttggggttatgattgtgcggaacaagtcttcacagcaaagcttgccaaaaaaggttatgataaaatcatggaatgtgtatgaaaagaattcacagtgtaactttaaaggagtcagtctctaaatttaaaaacttagggatgacatacgtattacatttgtaataaaagttttaagaacaaagtaatgctgaatataagaaagttcctccttttatcacatgatatctctaaggccaaggaacaagtgaaatagaacagccagcaagaaagtaatgaggatacgctaaagacactgaacctctttatctttgcaaattaattttgtcctctgtatttaagcaaaaatgtagctattgactaaatatacagataccagcaacgccgagtaggaaagttgaagctcttcttgcttttggcattatggacgactagtgggaaaatcatgggctttggcagttctgccacttgctttgtgaccttggccaagtttcttatcctctctgggtctctctcttcatctgtcaagtagacatgaagatataatctcttcttcacacaggagtacaaaggcgtgtgagaatgagtagaggcgtgccccacacgtaggagatgctcaattagtagagatttctttcatttctccagcatgaccatgagaatttaatgcttaataagaagcattatccatcaaaacatttttcttgttgagtctttattggtattttctgcctattaattgtatcagtttagatttcttattaataatcatgaagtctgtttttccacttgaagagtaggccctttcttcttgctttagagccatcatttttgccattccctttgtctggaacactcttgctttgtgttttgtgtgctttctcccttctttcatgcaagcctgtgttgcgatgccatgtcagagataccttccttcactcgcctggtgacacatggcacccgtatcactgaatatgctgcaaagcctttatcataacctggcatggtgctgtgtagctttttattgtctgtcttctccagaattgtaattctcaaggttggtctccctgtgctactgagtgaccaagggcccccgtgatactctaggctgataccacggctactctagggctttagattataaaagacatcagagggaggtgtcggaaaaaacagtgaccccagactcttctcttgactttgtgttctacctactaaatttccgctatcaaatataatccaaatttggggtcctttgaattccccgaagtagcttgaaccgcccaaggattgtctcaggatggctgtgtatctcactgtgtgtgtgtgtgtgtgtgagtgagagagagacagagagagagaatgaagaacgagaagagatttcaaaatagaagttttcagtgtcagatgtatgggactctacaaactttaaatagaaataatggtaatctgccaatgtaatttttatcttctttttttttcctcttactaccagtagtttttcatttgtctttgtgttttatttaaatttgcttttaagcagaagctcttgcatgcatttgcttctcgtagatcatgattgtattaggttggtgcaaaagtaatcgcagtttttgtcattactttcaatggcaaaaacagcgattgcttttgcaccaacctatacttccttgacatatggacctgaagagggcctaaaaatggccaagatccagtcatacacattaaagtgaccaggattgatagaaactttccagggttatggtaaaatcattttatattgggtgagcctgtcaatattttaatactaacttcttaaagattattaagatgatgaaaccaggttatttttccatagttacttctgttgcaagtgatattgtcactttggtctttctatatctgggcaggctttttttttttttaatgtctgttgcactgttatcagtgtaatcagacatagaagttattttaagtattatatatagatctgttagacaccatagggaaagagttaggagagacttcaaatagataaaattaaaaattcagaagtaatgtcagaaaaactttctaattgatggagtggctgtagttttatccttattttctccatggaaaaaacatagaatagagacagagaagaataaataaaatctgatgggagaatttatagaaaaggctgaaaaaaaaggtttcagaaaaacaattcctgatgttatggtaattgtactacatttaagtgacaagctgatgactagttcggggcagaggaagatgcagggtgagtagggattctagataatttattgaaaggtgaatagagggttgaaagaagagaaaaaggaatgttaattacaaaataagaaagatggagacttttgaaatctaaattatttgaaagcataacttcacaatttgaaggcttgaatcttatgcctgctagtcatgaagttaaaaacatagctttgaaaaattaaagtaagtgctggaaatttgaagagaagttactggctcgtagtagattttacagatccctcttggaaatcaggtaaaaaatgggaggtataggtaatcagaatgtcataattaagcttgatttaatagataacgcaagattatatgtaataaacagaggatatatgttcttttcaaatacccatctattttaaaattggttatgagaccacacatacatacacacacgtgctaaaaaccaaaaacatgcaaaactcaagaagttaacaaaagtagagaattgtacagcctacattccattctctggcaaccaggcagtaagactataaattaaaaaagaaagctccccaaaatgtagctatgcagaaatttaatatcactcttctaaaaagtctttaaaaaggaaacatataaattacttagcaacaagtcacactgaaagcaatacattatcaaaaatcagaatataaccaaagcaatatttgattgaaatattcaaagcataattaaaattgtttgtataataactctttaagaaatgtgtttgttataagacaaccaaatagaaatgaaccaagcattaatcttaaaacactagaggaggctgggcacggtggcgcacgcctgtcatcccagcactttgggaggccgaggcgggcagatcacgaggtcaggagatcgagaccatcctggctaacacggtgaaaccgtatctgtactaaaaatacaaaaaattagccgggcgaggtggtgggcgcctgtagtcccagctactccggaggctgaggcaggagaatggcgtgaaccggggaggcagagcttgcagtgaaccaagattgcaccactgtactccagcctgggtgacagagcgagactccatctcaaaaaaaaaaagagttagtgtaactttgaaactaaaattggataaggccaacataaaaagagagagaactaaagatgaacattactcaagtttataaatttaaaaatcttaaaatgttaggaagtcaaattcaacaggatctttaaaaacagtttattcttagaacacaaggatgatttaaaatccaaccgattatattaataaagagaaagccagtgtgattgatcatcttgaaaagttgaaaagcatttaataagatttaacctgcatttttaacattcttacatcccttctagccgtcaaactctgatcgacttacacttaagactgtgtctttggtagcctaccctattccacttttattacaaaggcagctcttaagacataaatccatctcttcaggctcgaactgcaaaacacacgtcgagaggtgacaatgttgggactgtcaaaaagaacttaaagagtgggataaccagccgggcgcggtggctcactcctgtaatcccagcactttgggaggctgaggcgggtggatcacaacatcagaagatcgagaccagcccggccaacatggtgaaaccccatctctactaaaaatacaaaaattagctggatgtggtggcacgcacccgtagtcccagctactcaggaggctgggacagaaaaattgcttgaacccaggaggtggaggttgcagtgagctgagattgtgccactgtactccagcctggcaacagagcaagactccatctcaaaaaaaaaaaacaaaaaaaaagagtgggataaccagtaagatctaatatgttgggttttaatggagatgtttaattgaagcatatgtttcaaaattctgattattacatactaaatattttgtaaaataaaaatgtaatagaatatgataagaatatattaatgacagcaaattaacaagagtaggaattaagtgctatttgcaatcaaagtcacaaagcttttcttaattataaaacaatgtgtttgccagataagcagtctaccaaatgcagtttacaaactccaacttaatctgcatacattcaagattcgccttctcctcctcacctctttgatttattctcctccacactgatggggctctgagagtggaattccttattagttaatcatgttctcttctcacggcagttccttggggggttatactatgaaagtgggctagatggattctctgagactcctgtttgacccaagcacatgtggcgtataggctgtagctcccatgagacatgcagtgagataagactggtaagagggagcagggatgtagctaacccggtagctttaacaaaaaccacatttctgaaagggaaggagctgtgcccagagaaatcagctgatgactcaggatcacagtagtgattcctgagacaggagtcatattattacagaggaacatagctggaactggatggaccaagtttcacatcaccacatcaccatttactagctgtgtgaccttgggcaaataaatctgaatctcagtttcatcatctgtaaaatggagcaaataataactaaccttctggggttattgtgacatgagcacatggcatgtgtgttaatgaagtctgttcttaggacagaggctgttttattttccattctgctttaagctgcttattggatattggcatgtgggtgatagccacagggagggtagaggcctgcaaatgaatgtttcccctgagtgaggcacaggtgccatgaagtggtattctatccaacaggaaaattaagtgtagtcataaggtaggtggcagaaggaaggcagcattaagactcaacccatctcatctcgttctccaacacacccggtacccagctgtggtaaacagtgctagtatttgtcttcctccatattctttcttgccaagtgcctttccaacctcctcccacgtctccttcctccccagatattgtgtgccttcctgttgttgcccaggttcccaaagtcctatctttctaagaagggacctgtttttctgaattattctcttcctctttctatataatcaaatctctaatttgtcccatagtgaacggtacagtcttgaaaatggcataaggggttctaaatcgccaggtacccctgctgctcatccaacctcatctcctgtttgtcctctcactgtgcctcagccacactgacgttcttactcttcctgggacacacaagcctgcgtcagcagttccttctgctgggatgctcttctccaaagtatctccgtggctcgtcccctcactccttcaagtctttgttcagccgtaaacttctcaatcatgcccatccattctcaccacattgtaactgctacccacttcttctaagcattccaattccctcttactctgttcttgttttcccctcatagcacatatcaccctttactactatataatttgcttctttataatgtttgttacttatgttctgtcatcctccaccaccatatcaactaacaaggtcaggaacctgtgtctttcctctttactgacatatcccaagctgctgaagcaacaggtgctcagtcaatgtttcagtgaatttactagaactataagtatgaagagtctcctatattatgtcttaggtagacaagaaatagataaggaagaggaaagatacagcaatcaaggtagaaaatgactagaggaacaggcatggttttaaaaagagatccactgctatgatatcaagacctgagtggactggaatgaggtgacctggattcttgctttaagtttaccaatgaccttagccaggtcacttaagctctggggcctcagacgttctttatctacaaaatgagaaaactaaactaggtgaccttttgggtcttatcctactacccaattctgtgtttgggttttactttaggaagaccaattaacacttacggaaacattgcctggtactaactggcatcaatttcacctaatgtctcctgaactccccatctcccaccaaaggtcctgggctgggatgatgtcttttagtctatttccatcttttcctcaagggccttatgttcgtataggtctcttaaaactcaacccaagaagctaaactgtggactggggtttcagaagccagggctttgctcctccatcgtaaaatctgagtaaacccacattgttttatttttcgcatctctaaaattgagatacagcaatgggtcggcagataatattagacagaggggaataaggtgcatttgatggagctctgctagaaatagaagcacatcaggtgccatttcaggaaattacacgggaatttggctcattatccatcttgctaagctgccacatcgtaaagtcacagactattaatagaataccattgataactcagagtgtgcaggtagagttcctccatgttgattgtcgtacacattgtctccagtttctgaagtagccatgatttgtttgtgttttaaggtacactgttttcaaagaacagcctttaaagctcttttgaattcaaagatctttcagttactcaaggaatgggtccagttttcagattctccacgccatgggtgcatcttcccttcagctttcttcattttggtcattgctccagatgttcattgtttaacacaagtgggtagggagacggagaagaagggaatttcaggctcatattttggtgtcatgggcagatcttgggtgaggttttcattgttagttaaactaagtttgaaggtttacactgaatttctttccctaccgtcctctttggctacttaaatagatcatcaggactgtttgttcttctgttgaaagtgccccacactgccctgggcataagctaaattctttctctcccttttagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccaggtatgcacgagctctgtctcagcagccttgttcctttgcatcagagggtagcagatccctcctcagccacccctggcctctcctttcacacgaagatgggccttctcaccggtgtcctgtgaatctgccactttgggctaatggcagcttgacttctggccttctagtcagagaaccagagtgatcatccactggtacataagcgccttcggagagcgagcgtgtcttttcctcttttcttctttttttccttcaaagtatgcttgactggggaggtagggttaaaatttatggtactatggcaatctgcttcatttccccagagaaggtcagagaccttatttgcagctatatctgccactttgaattattacatttaaaaacaatcatcatacgtaaaacagaaagttatttttagatgaatacatgcatcaaaacgccagaagtttcataatgcaacactcagccccaatctttctctttgccaattcccccgcatctgccctctttactttatagcatgtgccaagtcatctttgactgtttactcaccctctttgccaacatttgatgtactgttgtatcccagctgtttcttgctttatattatttctaacatccttgctcttgtggcagcatttccgatgtggtctgtgaacacttctgagttatagcgatttcctctttgcaagtttctaatcatcggccagttgtttttttgtttgggtttttctttttctttctttcttttttttttttaactgctagataaacgctccaagcaaagtgatcctttgtccgtctcttgaactattctatcaatcagaaatgcctctggctaactgtcactatccatgtaaccactgctggtttaattctttctctgtcttcattgtagctcttaaatatctcatccccacctctttccttacacagaaaatttgaggaatattgcagttctatagcattaactggagtaacatgtcgacactaggactgggtttgtggaagcaaggagactttggacatttgtcaagagctagtatttcatttagggactccaaaagcaagtaaatataacaataaacggtgcctctctgtttgcccctttcagttttcggcgtggactgcaggactgtggaatgccctcctgttcagcagaccgcgtgtcccccggacagctatgaaactcaagtcagactaactgcagatggttgctgtactttgccaacaaggttagtttgccattagtttgtcaagttttctcctcatttgttagcatcatctaaggtacattttgagcatgcagtttgttttcccatgagaaacctagtcctttcctgtttctctggaagaaatcactgaactgtttgcattacttggtatttatatgtatctttcctcagatcaaaaccaggtgtcatcaggttaagtcgttaaaccttatagattctttctgtaagggtgcctgtacacttttgagggctgggacctatataagcaaatatgcccctctgtatatagatagggaggcaggcagtgaggtgtctatcaagagtagacacatcatttgatcctctgcagtgaatcttgtaggtgcttaaacaacatgttcaatgtgatgaaacattgggacccttgatgtttggaatcacacatctacccagacccatttcttgctgaggtcaagaggagtcttaattcttacaatgctttctggaataacaaacacatctctctttggcttgactgcggggaagagccactgtcattttaaccctagtagcagggcatgcacttagccccctagaactagtttttctctagaacatgaggatctccgggtcctgtcctttttagtctacaaagcaccaccatagagctgtccctccttcgtacttggctttggggaagactgttcttggaaatgtagggtttacagtctgttttcccccgactactcacccctcttctctgccatgacctcccttccatcttttgcaggtcaacaagccatctttatgactaagtcatttcatgtttttcagctttcgttctgcgtttaataggatgagttaaaactgtgccttatttaactcaatttccaacctcttcttcctcagtcccagtgctaggcatttagcttctgggtttgttgcatgagtacctgtgattatgcaaatggttggataagataggagtagatgtggtccataggtaaggtaagtatcagttatctgtccgtaattgaagagacatccagaatttgttctgataattactttttccttctttcttctcataaaataagttaaatccttggcatctcctagcctttgttctgtcaaacctagtattctctaagacatatcctttatactgtattataaaacagatgcaaagatttttgtgaagataacatacattggtgcagccaccttcctatgacattagaatatgataatttatgtgcagatgcttaggaaggggtgaaatatcttgcaaacataaggtattactaatcagtaaaggagataaatggagcatcgctaacagtaacagatgtcccttcagggtcttcctgaaaaggaaggtggtacattatattggagaacctaattaatcaaaactaagccggttgttaacgaggtagtcctttagtgaggaaaatggacaattctcagttcactattataaatgccacatagagccatctgcacataggaggcacggtcagctattttttcagtcactctagggggttgaaatgggtagaagctacaggaaggtatatttagtctcaatttaagaagaaactttcccacaactagtgatgttctgtaatgaattggctgcttcctgaggcagacagagctccttggagctggatagatttctttccgtctggatggccacctgcccggaatgcttacaagaattgtattaggttggaaaggaggttgaactagctgccttccattttatcctcaagcttctgtgagtctagaaaataaaacttgaagatgattattactgtgttgacataattttgacttcagcattcaaaaatgaagaatggccagagttaaatttgcctctaatgaagacattgaaaacatagagaaggaagtcattcaacatcccactgtaaattatttgcagagaagggataggttctcacagctctttagtttcctgtatgtcagatcatcagtgacccatactcatcccctgctcatttgttcgctttgaacagggtctcctcctccagctctctcacgagtcctgtgcctttgcagttgccactacctcttcccggactcccttctgcatacatataggcagcttctacctctccttcaagactgcatttcctgctctttgaagtgttgtcactcttcggcccctgaagatgacttaagtgtccctctctgctcccttgtcatccatcccctgtgtatctttttatcatagcacttttcataacacattgaacatactgatgtttttttgtctgtctctcctgtcctgtgtgattgtcaaggaaagggagtattttgtagcctcttgtacctaaatataatgtgtcagcccacatctgttggtgaatgaatggatgaacaaacaggccctctcttagccaagatgatttatatgttgaagaaaagaaaaagaatgaatatttttagtttctagttaccttcctgccattgggttgtaatactactccctgtctcattttcaaatccttgcacttttcccccagtccccactttatggtgcggtactcctcaatcctgtagaaaccctccattccaagcacagcagtcatctctcacagcatgggatgcctttcactctccattccatctcttttcatattgctcatccagcaggactctaattaatttctcctctgtccacgtggtcttcatgcttcaaccaacaggtcccactgcctagaaacttcccacataatcctttcctatgctgtcagttaattatcgactttcatactttgttactgaattgtcgaatgcgtgaagtcttgtcttatcagctatacgatgttcctaaaggtcaggaattgtgtcatcttttcttttcctctgtatgcattagtgctgaatgagtcggtaaatgcagaatatactcaagctgtggcttagacccattcagcctagtttagcatattcagtggattcctgcttactaaggagggtgatgggatgataggttgtacattgattagagaataacaacccaaataatcatgtgaaaatggaaaaaaaaaagcctaacatgtaataataatggtagtattttaagagaaaaactacgtaactttattcttgtgtgtgagccatgtcaaatgtccactctttaagagcatatttaggcataaagaagaagattatagaacatataagatcctattatgattatttgacttttaccagcatacttataagagcattgttaagaaattagagccatttgagagcaaagctgattatgtggagaaatcaggggagaaagctatttacattttaggacataataaggtaaaatatctgaaactttagctgtaaagaattacattcagtgaaagtaacaactccctttttataagaatttattgcactttcatgggctagaaagtgggtttgtggacttttctcccctatcttgaagaatacattcctccctccttcattcccatccaaatggaattgcccttccctatgagactatttcacccattcgggcccttaactgccccatttctgtgtgagcttgatttgttagttttctctggaattgtatgttttcagttgattcattcatctattcatcaaacatgaattgagttcttaagagtgacagacactattctccggatgttcttacggtgcatgggtttcactttccacttctatccctcacaaatactggttttcccttctacctgtggcctttgtgagtataggctcttccttatttccttgctgcctttctgtcttgtttaatggcctttcattttcacttcttttgtgtcttttctcttgaacttcatcctgtttaaacatcattcttgtgtgtgatgtaattaatttttaaccattatttgattcttccttccctcaacttggcatagatttccaggcatcccgccgtttctttttatccttttttcttctgttggcatgaagacatgatatgagttatatggcagtgcattctacctttcaggagagggtggagagggataagaattagtggctctgggacttatactgggcctaaacactacacagtgacaaaaagggaaaatgggactgtctgtgaggtttaggacaccttgtggtccttgaaagtccctttgtgagtgtctgcatgtgtgtgcatgtacagatgctgctgtgcataagagaatttacaacagaaacttaaaagacagatacattaatgcaaattatttctttgcagggaagaaaaaaaccaagatagtctttaagtgacatatagataacaatagcagtcacaccttaaatgtgtaaagtgccttgctgtttataaagcattttccctattcatatcttaccatcactttaattctatgaggaatttataggtatgagaatggagattgagataataagagacttgcagaaaatcacaaattttccttggtacaagagacagagcaggttcaaggcttcaacccaggttttttaattttttttttattgaaaaccctgtgctctttccactggagcttttttgataacaatgttttgttgtttttaagtccaagaaatatatcggggaatatgaatttatatctcaccaacacatttctatctgcataccacatacgtgtttcagttattcactgctgtgtaacaaccgccccaaaagaagtagctgaaaatgacaaagatttattctttgtcctgattctgtgtgttgactgagcagttcttctgtagccagctggcaggttgactgagactggatgtccctcccatgtttggaaactcagctgggatggctggaaagacccctctccctacatgatgtcagaagcaggagaggaagttgcaaagcctttggagaccaagagttggaagttacagaacacttctgccatgttctgttggtcaaaggaagtcccaggtcaagccctcattcaaaggtttggaaagtaggttccacttcttgatgagataagccacaaagaatttgtggccatttttaatccaccctaatctacatttaaccaagatagatgccctttagttttcattttctgattgcaggaatttggtggtgtgtttcagaaacgtgattcttttccaaaaactcatgcccttctggccctggaactctgggtcttcaggtgaaattcgggcagcattatagttaagccccctgtgtgcccagcagctctttttctgcttctttcttcacttgccatttggcagtccacccaggagcagacacgtgatttaagagcctctgagccaccgcttcagctttaatatcatttagccaaccattatttttaaccttccgcttcttgaagagtgctgtgaccacctaggttaaactaggttttctcccatcatacaaaagggaatgctactttgggataccagaaaatctgcctgataaaaccgggtccatttttaaaacaaaacaaagcttgcaaagatgttgaatagagattctcctctgtaatggttgagcttacctgagagaaatggattcaccagaggcagatgcatttgaaggatggatccagcctgggctatacatctgagagtccatgttctcctggtgtccaccagcccagacctcagcccaactgggctatttctcaggaagatagagagttctaagaccacagtgttttctctgcacttcctactccttgctctctccagtgtttggacctaattttacagactcttcactttgcctccgtaatttttcaccagtgtttcagatacaggcttacacggtagacattaactagttaaaaatctagacagtaatacctccaccttactcactttcactgtaagtcacgagttttttaaataccctacgccttttgataagtaactttgtacctttttattattgacaagtcacctattttaaatttatttttatgaaatttgtcccaaactttttgttctaaaagttctgttatcaatttgttttataaatatgccgttcttaaaagttattgagaaaagtccaatccagctattttaaggtagaaataaattaagtcattgtttataatgtccaaaaacttaaaatagagtttcttctgggttgtgtgcatttcagaaagccagattcccaagctccctcctggctcctgcctctctctgaccaagggcctgatactcttccagaacctatatctggaacatgtgtatctcttgtgttctgagacactagaccaaaaatcctattttatttttaaatcaatcttcagaagtatttttttgacttgtttttttttttttccttagcttcaaggtaattaaaaatgttagattatctgtcagctaatatgttgactaatatgtgacttctgttttcaccaaaaaatgtaatagaatatgttggacacatgaaattctaagtacaatttcactagaaatattgacaagccagaatcacagagctcaacacaggaggcaggctgtatcactctcctgtttcatagagggagcattgtggagctggaagggtcctagccggtgcacatcagcggaacaggtctgtctggcacttaccactgagctgcactgtcccttgtggccctgggctcactcaccaccaggccctctccagtcctgcctctcaggagccctaacattctgtgtcatgcactttgttattgtctgtaagcagacacatacctgtgagtaaaccattccgtagctaaagaatactcctctgcacatcacctggtgctgttcagaaagggcacgaatcatgtgtccagagctagaatccaggcccacttcggcatgagtttgggtgaggctctcacattgtctggctcggttttccagtcgaagaaaggaggggaggaaggatttgattgtctcaaaagtaacttctacctctaaattctttgactttccaaaagcctttagaagggaaggaacccaagccgctagcgacaggagactcctgggaaacaaaggtaaagaaaaattttaggaaatttcagagctcagaaaataatgggagagatatatggctcgcctagggataagaaaaggagaaagtccaggggaagttataaaagaattatgggttttttctttaaactttcttaaaaaaacaaaacaaaaaaaaaaccttagaaacagcaaaatgaaataaactactagagtaatgatttaagccagggtaatcagaactggttggattgtgaaagctgagtaacaattcagtaaaatagattacgtatttggtcagtggttagttgactattgttagttaaccttttttttttctttacatctataaatagatagtccctacgtagcagaagcagagaatatctggccaaaggctgactccgcaagataaggatttactctgttaaactgctttctaatagaatgtcgatatctctgcctgtcagcctgccttggtaaatgtgctggagagggccatgtgtgtatggttcctggtgcccacacaggctcacctgtgtgaaactgcatcagcccatacatggctacttgctggctcctggacccatatttgcacttgtttctccccttctgttgccacatcactttccctgaggtcggattgtgtgtgtgtcttctctgtcttcagctgctccgtattcatattgttcttttctgtgttttacatttaatcgtgcatacacacacagaataatattcatggacaagttttaggttctcttttcctaactttatgattggaccatttctttctgtctcttaaaatgaaaaaagatctactcaaagtgacttttttccttgtttgaacctcagctttatttctctcccataaaacattgaccttagaaggcaatttcccactcatatcctgtcctatcatcacagctccaaactctgtaactccaggaaaggaaataagataaaaggaaggatggtagtcccattgtgtctgaaaaatatgtcaaatatacagcccatgaccagagcgaaggtcatcaatgtcgtttgctttcactataacatctaaatatttgcaccaagctgcttcaatttgaaattgtgctctcaagaaaattcattttgttggtgctgtcttgcattatgataatagaatcttagcagattgctagcacactgtttcttgtgaatagatagagatgtttagaagaagttttctggggttccagaattcacagcctgaaattgactcatactggatgaggccagccgaatggaatctttggcaggttatcccttcccttcagaagcacttgagttaaatccaattaatctaaccacatagctacagtgagtgaaaacaaggtacagattttaaaatgctccaatcggttaaaacagttaaataattacatactcatcgaggacctcatggaaggcagaacactgggcttggtgtggggtatagtggtgaataaaatgtggcacatgctttaaagagtcttaacatcttacagatatgaccaatgccagtttcaaaaaggctcccaagttttggaaggtaataagaaggaaacacacaacatgcacacacacacacagtcatctgccctcaaggaaagaatcaattaatagacagtctttctaccaaacaatgaaaaccaaatttaagaaaaaccatacagtaatatgccagctttaaatccaaactgagaaatcaaggacctcaaaaagcacatatacatatggaacaacagatgacaattttttcttatccctcccttccctcctgaaaactcaataggacaggagggattttcttattcctctgttctggaacatctgtctgcttctgagaaatggaacgagcagcaggatcaagaatcctttagtgctctgtgtgctcaaatgcttatccttccgtggtagagctttccaaagtttgtcaactcttatctccagagctacagcccataactctgcggtttgaagcctttaggagggtgttgggaggtgggaggatcacgcaagagtcagaggctgtcaacacagtgcgcatcaacccaacctgacaaatatgtcaaagccagaaacttcctgagggtggcttggaactgtcagggtcatgttcagagctcagaaagcacttctttttttcttcttggagacagttttaagtttttttaggccatcaaataatatttcctgtagatccatgtgctttttaccattgtgctaggcaattaagttgcttatatcatgcctactcaagctaaccagttttaactatccctgcatatgcattttcaaagggactttatctaattaagagtgttgtaattcattatcatgtccatctgttctaagatagtgtctcagagaagatggcacttaacagtttgggttttttttttttaagattgatctgttagtagacaaatttccataattcagttcatttttgttgttgtcgttccctttaatttgaataatttctccagctgctttttgggagtaaataaaattaagttatataataagtaaaatatgcattagcacagcacagatttaaaacattcctgactcctgacatactattatggtagcattctctctgtttttaaacacatgcagaaaaaaatttggaagtgtatttgaagctcatctttctcaactaagaaaagaacatctattctgttgccctctgtcacagtaatttttggcccaaaagagcgagtcaactcatgactaaaaaagccagagtctatattaaactctgatgtttttaaaacaaaataattgtaggaattccatgttattattggacctatccccagattgaagaaaatatgctttcctagaagtaaagccattgcccattggaaatgaactgtctccctagtagagtgtttgatttgtcaataattctcttcagatgcgtgcgtgctgtgtttcctgtactagggccttaggctttttttatctcaccttaaatttgacctagtgtctagccttattttgtatttgtcttagtcccgaaaacaagcagggaaggctctcagtcagtggcttccagtttaatccgagtggtcatggatatcaccagacactgtatatgtggccctccgagtcggactgagagaaggtaacttaactgaattccgtaagcctttcagtaaagttgaaagcggaatccacagcgtgataatattgaaactcagaggtctctccataccctcttttgctatgtcatcatcatggcacatgcaaacagaacagctctgcaaaaatgctttgtgaaattacttgcatagctaataagcaagtctaaaatgtaaaagccctacctgtaatgaaaataccaaaagcaacccaaatcacggaatatattttactcttcatgtacacctttacattggatatggcttattgggttccccatcattgtagttgcaacagtttgcagataattcagggttatatttggtagacatttaattgctaattagaacccaggaggtagagacagctggtttctcttggccttggtcagtctgttgtgaatgtattatacagcaagtggtttgtaaattattctttcctgactttgcttttgattgaaaagaaaggaagttatatgtcatggctcttatgataatatgatcagggactttgatttccatagctagatcatgaagagttttaatgataattcctaagacattagattgtggattctttgagggcaaggacccaccctatatatttcattctcatcagtacctagcacgggtaagtaatgaatgcttttaactaaattagatagacaattagtctgcagcaaaagtcctagcatcaaaaccccatagtgttcttggattgttcagggagcagatattttgagcatttgtcatgtgccaggcattgggctacccagcaggaataaaatatagtcgctgatgtctaagagcatatattataaagggaaggcaaatatgtataagtcattgtagtttaaagtgttgtgtgctttggtagtagaagtgtgcaaaaaacacaaagttagcaaagcaaacacatgctaattcctatttggagaacggtcagatttgacttttgaactgagtctttaagaatgagtcagagttcacaagatggagaaagagagaagggcattctaggctgttgttgatttttcgacttgtaatgtgtcttgcagcttaaaacattaacactaatcccacctacctttatgattcaagaaaaagggaattcatgacaatgttgggttttcttgagataaccactccattgcaagactgcattacttgtttaaggtgttttgttactttcctgtttcttacaagtgaagacgcttcttagtatggtaggcaaggccccatattactcagccctgacctccctctctggccatgactcctgccagtacccccataataaccccagtcctcctctcagtacatagtgtacttctggtgggctaacctattagtttaaacttaacacactgtattctttcttgcctttgtaaatttagtgtgttctttcctctatctggaatgccttccctctgtgcccactcccccacatttgatggtcatttcacaaactgccactcacacccctcaccaccaccacacacaaacacacacacacacatacagcatcagctgtttatctttgtgctgctagttagagaaggcatcatggaagaagtgatcgtcaggaatgaaccgaggtctctgaggcatgatggggggcttcagggtagaagatgcagagtagctctgacttttctctagctgctcttaacagcttgagtatcagcacagaggaagtcaaagggttgaatcacagtttgcagttagtagttcttggggctgaattttaccccaagacatgttttctttaatgtgcccctttttttctatttttaaattagtcactgatatttaaaaactggcatacttcacgtaaaaatctggcttctcttgagtacatggaaggtatgccctcattgagtttaccctttggcatggaatgagtagtgatgccctgttagaggtcacagaccttcttgaggtgtctagagtccccctctactcttctaggattcctgcctgattcaggtttgccatctctgggattaagtaagttgggtttgggagacagatacagaaggaggataaagaggcaggaaaggtaaaggcgttaggaagatggtggttcaagtgaaacaccgtgggttttgggctccgttgttaaagaggtacagtcaggaggaggttcaggccgcagagaaaaggaaacgatctggggagtagatgtctcagtgactttgaagtgtcagtgtggtagagcatgggccagggagaactggaaggatggaccattgtgatcagcagataggatgtgtgacttcagagagttcagagagctgtggctgcaggactgagtcaccgaagtagagggggcaacaagggtcactggattccaaaagatcaagtgaggccagagtattgaaaatactttgtccacatagactctcaagcctctcagattataatcatataaaacagctaacaggtgttgtgtgcttctgtgttccaggcactatcctgggtgcttttcatcagttcgtttaatccacatagcagtcatatgatatgtgggtactttaatcatccccactgtacataggctacaattgaggcttagagagattacttaacttactcaaggtcacatagttcctaagcggccagaacttgaacctaagactgtgttgttgccaaagtgcattccccaaacctctgccctctaaagcgttggataggagacagagtcaccggaagggaaggtttgcatgagagaggaaagcaaccatgtgcaagtagccagtggtcaacttggagaatgctgacctcccttccatcccaggtgaataagtgagtaggatgtggggattctcagtctcactggagatggctataaggaaatagaatctttaggggagagccaggtaaatgttagaaacaaattcgagtggtgcattgtgtgatatgttcggaggatgggggagtttgtctgcagaggaaagtttggaggaagcaggggagtcagttggaagggatgagtcccagagcagtgctctctggggatgtgcattccttggaggatgagagacaatacggtctttcactttgcactgatgacaaggatgagaggctgggaattgactgcccaaaggaatccaagtggatgcatgcttaaagtcatctgtttcagcactagctcaggccccagatggttctggcggcctgaaggagtgttagcagccaggcaatggaggctttgctcagattttcaagtagaaggttagtccagacatcgttggtgtttgttctttgtgtgctctggggagaggatttaatagtcaacctcccattgtgttctcatttgtggttatatataaaagcttccctaaactaaattccctaaacttagggccagaaccctgtgtatccccagccgcaatccagcttagtacctgctgcatgtacacactcggtaaacagctacaaaatcattacgtgttcataaacaagctgattcattgttccaaagcatctattttctgaggcagttggaaattccactctgaagtgggaataacctatgttgctaaactaaaacttattctccacttcccagcccagttctcctttccacagcgtgatgtgccagtttcccttcctccttttccaaactagtccttcatgcagctctcactcccatcctgtcttactctctaaagccatcctaccagccgtgaaagcagatgccattgtcttcccctagacctacggaagtgaaggcagggagccttccgttcctgggacttggccagctctcgatgtgtgatatcggattgttgagctggactgagtggcccaggatttctgccagatcccagctgtaacatttcaacaggggcacgggccctgcgattactttcagctgtgtttctgctgtgtctgtctccacccccccaccacccaccgctggggttgagtcccttcaaaactaaccctgattttttttttttttagccactcacgtcaaggtagtaatttgtgaaagatgccgttgttttctccccaccacacctactttctgtggggcagagtcctagaagataattgttaaattcttataggaaccacgtagacttacaacttctgttctcctgcagcttataccactttcctttcaacttagcaccttaagataagcttccggagccacatgccagcctcgaggaggaagctaggaagagaagagcttaatggctgctttattattattaccagtagtaggaaggcaagggaatattttattttatttttatttattttataaattttttatttccataggtttttgggaaacaggtagtatttggttacataagttctttagcggtgatttgtgagattttggggcacccatcacctgaacagtatacactgaacccaaacctaattgtctttaacttataccttccctacatgtgagcatgtcctttgattcctccccccagaaaaaaacaaagcgtaaaacaacaacaacgaaaggcagagtgattttttctggtggtcttcaaagggaaagtgttgaagaaggtacagtttctgctcactgtacacaggggagggatggctgcggggggagagtgtgatccccagggcagggctgcacttgctgtggctacagcacatctgtcagtgttagggggtgtaaatgccaggaaatcacgcaggaataagcttgagacaggggagaaagggtgaaggagggttagttattcatacacagatagtagtaaatctcttatggtgaggcacgaggaaaactgtgagcctaaggaactttcatagggaggagtgctgttttccataagaagggttggaccctcagataggaaacctgtttctttttggatattttatttgcagcctttaaaaaaaaaaaaacttacacattcctggaaagagtaagaaatttaatcagtagaaagatagtacatcgaatttaattaaagttgcagctactttttatagaatagcactgtgttttatatgtcattataatttccattcccgacaagctatttcattaacacactgtgtagaatcctagtaacacaagggctttgccctttttgctcctcatttatccttgtttcctgactaaagggcgacctcccacccacctgtaagtagtttttaatttataggcggtcatgtctccacttttgaaggcctcaagcactcacttccggtgtgtagtagatccagtattgaaagaaatcttttccagaagacctcactgacttgttttcctctaggatacgggcagaggaagatcagagtctgctggggaagatgaggaatatgatggcttgctgcttccgagctgcctcctctgcagaaggagcctactatggggaatgttaggataacatcagcacccacaccaggaggatacctctggggtgacggggcgaggcagaggttgaggggcattcctgttctttgctgaaagggctgtgggaggggcaaacaggactcctagccctgtggcctcctccaggaatctcctgtaggttatcttcctttaaggtttttctggtcattgtagtaaaacaaactgttgacccttgcgcttagttatgtagggtctgaaacatgcctagtggtagggagacaacagcatctagcatgttgtttcttttccggccttgcttagagttctttagtagggaaaaaaaagttatataattattatgcccccacgaaaaacaaaacgtcaccagtgcaaaggccctatcttgagctgggcctgaaggttgaggtgcttggagaggaggaggatcaggggagtaagggacacaaggtgactgatgttcctgaaggacagggtgcaggtgagtgagaagaggatgagctgaggtcagtttgcagcagtgacgggaatgggaatggcagtgatagaatcaaaggattttatatttagagaagagtttattatgatccacctgtctcactttatggatgagaaaacagtctgcaagagtttaagtagcttgctagcagtcacacatttttcttctttgggtgacagtattggataaattggtaatatttctgttcttttcttccctcgtggtatctctcacttttaagcaatggtattcaggcaggaaggagtctttgtaagtgatctaaaacaagtactagtaatcattgttctcattataatgttaaaactagttgtacttgttttttgcttttttgtttttttttagtggaaagtacaaattaaactgtgaccacccaggctttgcgcatctaggcacaaagttcttggaaagtggattgcaaattcccatcagcagactctcctggagagcctattatatgggcagattctggagccgctccccaaacctgcagaaaaacaatgtttgagtgggtaccctggcatctgcattttaaacacattccatagtctttccttccacatactaattttgaaaagcactgtacctagaagcttgcagtctaaaatgtataaaaataaaaaatataaaacaatacatggtctaacccctgacttagtatccatgaaaaagtttatttcagattattggttgggtacctttatcatttttttactattatttataagacaagtaagacatgccccctgcactagaggaattcacaggagaaacagtctgattttgatttagtatgatgggccgatgcacttcaagagttactaccgttacgtactgttgcaagtcagaggagggaaaattaatcctgtttgttttttgaccagagaaggtcttacagggtagatggtcttaaggttgtggggaattcaccaggggcaagggagaggcagggatttgaggctgggtggacatgagctgtggctggagtgataaggggtggtggcaggtgattgagtgacatcagatcatcattgttgctggagtgtagggtgtgtgcaggaaccagtagaatatggaaactaataacaggtagaggcagacttaggagcaccttgcaagctatgcccaggagctcggactctgaccttctggcctgcctgggattgtctgtgaagtccaggaagcaaaggacatgaagggaaagcttaaatgtgtactcaccgcccttcagtcagcagaacctcctaagggggtgagtgccctctaggggtttccatgatttctgagttccattgtactcaggcactcaggtgcccactgagcttgaatccattacctacttgagaaaaaaaaaagacagctttaccaagtcccacctggctgcagctgtggttacattatgcaaaaatttattaatgtggtacctcgattgatcattatattaactctaaggattacattagaggctttatttttctggttacttgcaaatacaggttgcatcttctttgaagttaaaaagcccttagcccacatattgtatgattccatttatatgaactatccagaattggcaagtccatagagacagaacataaattagtggttgctaagggccggagatcaggggaaagggagtgactgctagtgagtacaggatttctttttgagatgatgaaaatgttctgaaattaggtactagtgatggttatacaaccttgtgagtataaaaccactgaattgtgtactttaaaagggtgaatacttatcgtaagtgaattatatctcaataaagctgttttgtttcattttttaaaaccttagcacttctgctcaaggtcatgcaaatagctctgcctggggtggcctttatgaattcacagtagagaaatctcagtgctctcctcactttcttttgtgtttttgttttgttgtgttactgttattcctgtcttgttcctctgcagttcacttccacttaagaaacatttatatgactagacatgataggtactagaagagcttatgttaaggtgagtcctcaagttaccacaaaatagagaaagagggtgctgtaagaaaagtgtggtgtttgggggttcagagaagaagctgttatccgaggttggcctagaaagacaactgggcataagggctggatgaggaatgtgcagaggccattagggcaggcagtgcagagacagcaaagtgcggacttatttggagaaaagagcatgaccgtagcaatggaaaatgaagggaaatactgggaaacagaattgagaaagggttatatggacttcagagtgttgaatgctaggctgagaaagtgatacataaaatgaggagtaatggaagataaattttgactgcagaagtttgggaactgagccttaggatgggtgtagcatggtttgggagagacagagacgtgggcagggggagattggactagaactggaaattggggagagggcttcagaaatgaggggtaagtgttgaaatcagctcactgcagcttttctcatgaaatgctgtttgctctgccccttttgtgttctcctttcctttgcttgctccttatccagagatggggataaagggagggaaagattagggaggacaaaaagaattaaaatgaagagaaagaatgtggtgaggacggtacaggttgcatgcgtcagttcttctgtagttcagcatttcctgttcatgactcagtagaggaaaatctagtctcttctagtggaaaacacagagaacaggaaaccctatttaaaatcaggtcacttgactaagctgtgtaactcctgttcccatcggtgaaagggaagaatacctcctgcagtgtgtgttaaccagagaatctagaataatcttactgaagaattttttaaaactacatgggactcatatcatttgtagatataacagacttcctgggcaaatatgggtcatgatggggtccccttttgttacctgacagagtgaatgtaaacatacctgttaaaagataactcatgtgagttgtattatgttgaaaataaggaattgctatttgaccatttcgaactgcaaaactggcagtttcagtaaggttttaacctaatagatagctacccaatagatatctgacctaagcccagatttttaccttttgtggttctttcatcagctctttcttgattaagatgctaatttcacgttcaggggaagctgtgaaaagtcaaaagatggcaacaggtagatcagaaggctttgcagggaaggaaacaaggagacaggagctggggtcacaccagctagcaaaaccaggatctttattatgcagtcagtttagttgtaaagattcagcataaaacattttcctttcctaggtgggttaataggtggttgggtgcaacttcagctcttctgtagcctgctggagacaacttgtaagggactttaaaaaaaaaataggaatatttaaatgttaggaagacgtaatgcatataatgtttactctttgggtgacaggtacactaaaagctcacacttcacctctatgcaatatatgtctataagaaacttgcacttgtactccctaaatgtattttttaaattgtaaattttttaaacaaatgttgggaaaataggtcaaacataaaaggggaaaaaagacttcatggcagacttagtcatggtgttcagtgtggtgtgactcctaacagcatagcagagaacccagcacgtaagtgcacgtgttcagtaaaggttgttcaagtgttgaaggacaacatctgaagaggtattttttggttgactgtacactctcaggtgtttagagtagaatgattccctggagcacgtgtgtaggcaagaatgtggaatcatagaagatttgtaagagaaggttaatcagctattcttgcgggatgctttcattgtaatcacatctacacattggggccagggtgtggcctgtcagtattctagccccatttatctataaactccagagagttttaagttgtacagagtgccaagtacaataaatgtaaacaatataatgttactgttatatcacagcagtatgattatgtgcttaccactgcaatggctagggatataagcgtgacaaagtatgggatgaccttatcaggcactaaaagcccagctcacatttactcagcgctagaaaatgattgtcctgcaggaatatagcgtatgaattgagagctccaagctctactcacacaaaacaggcaaacctttacttgaaaccactggtagaaatacaattgcagcaaaacctgaatgacctaacaccctcttctcccaggaatccaatagaactgccaccccacatggaagaatcctcaaggagcctaccttggggtgatagtggggtgtttaaagccacctttccagtggctttaatagtccttgatgcaaatcataacctaaagtaatttcttttctagttccatggttaactataaatgtaattaaatctctgggcctcattattgaagtacttgtggactataagcatattttaatttattaaagatccaaagaacaataagtgaacaaaccaattacttaaataagaaggggggacaaaagcacaattaatgaatgtattgatagttttccctgctgggaacattacctttcctgatcttgacctctaccgtatgtaaatacccacatacttcctgccaggatgtctttttttaggatgtcttccttttactcctgtcaacctgggaactcccgccgtcatcttctccaccctctgacccatacatctctccccaggggagtcccagggcagaaatctagcggctctttcctcatcttacattcacatgctgacacccagctgccctaagtttcctgtgtcctgcctctctttcattgtagcagatgcaacattttgtctcctcttatttcacctgcccgtatttgccaggcttctgcgtttagcaatttttgcagcagcatcgaagttaggggtgagagccagcacagccagcttgcagctcatggaacacccccattcatgcgtgcagagagatcgatgctcaggtgggagcttaagatccaaaaaattaagactttcagcttccaagatagctgtcataaagttcacttactacagcttaggccctctctttataaagagctcctcagtcttcagtccgtttcttttattgtgcacagtcataaattaaatattgctcaagatgagagtggacttaagacaatcacactgacaagaaaatactaaaaagctaataacttaatcattgaaccaggagtcagaaaatctctgaaaaaccctaaacatcagttgcagcaaaggagcaacatgaggccatttagcacgggaacactcactctgtattagcctgtgcaagcatcgattcacagaagagcataacagatacatatgaagatgtccctgagtcagccagaaaatgtttgttacgctcaataccagtctggttaagtaagaaatgaggtaatgcattttagaaatatttctgtcaaaatggttaaagttaaaaattggggtgtacataaaggagacaagccttagttatttgaaagcaaattatggtagaacccctcctgccttcccatttcccagtgacaccagataaaggaggcagtgtcgtatagaccaggtactttgccacagccactgccactttgtttgtggtctcccgacttctatgttgttgtttattcatggggttttccttcccttttctttggtttcagatgcgagtgtctctctggcttatgtggtttccccgtgtgtgaggtgggatccactccccgcatagtctctcgtggcgatgggacacctggaaagtgctgtgatgtctttgaatgtgttaatggtacgtggggtttctcttgttctcagagagtgtacatttgtgcagaggaggaggagggagggttcaacttagctgcttctgccttttacaaagcagggattaccttcaggggcttgctgaagggcactcaaaaaggtttgcttaagatccaccgtgcagtaaagaaagttaggttaggaactatcattccacccatcagaaggaggattctggaaatgtaatagcagattgcatgtagctgtcatactcagctgtgttacagaatttccaaaacttagggatttcaggaaaaggatcctggagcctgtgagagttttcctgctgtcactcagtaactggtcccatggctgtcgggaggtgacctggctaaaactgcattgggcctgccacacttgggaacaagaaaaacatggctcatcttgtttagcattttcctacttagaacatctttgcacctgatcttagccaaaaggctgagaggcggtggggaagacatctttaatcagtggttggtcactgatagcggcctgctgtaggcttgacccacgtggccctgaaaaaggattcttgggtcacgagattccttctgacagaatctgcctctccctttcactttatatgggaggatttggtgtttggtggcttgatgttgattgagtttaggtgctagaaggaaggggaacctgcaacatgcttctctaccagaatattcattaacaaaaaataaaataaacaagttacatgtcaataaccattcagagcattatttagtcaatacttgtatacacaggaagatggagatggatttggacaaatacaacaaaattacacatagaaatattcatatcaaatacttcctgtaggaattcagatgtcataaggtctcctgccctcccaaggcaagaaaggttatgttgcagttgagtcctatttggttgcatcctgtgatttttaggcccgtggccaagttgttttttattgtttatttttgctttgaagaaacacttgcagtatggctttatggttaagaaagaacacagactagaattaataacctcagtttgaaaattgggtcctccactcactagctgagttaactttgaggaagcttcttggtttccctgggcctcagtttctacatctctaaaatggactgaataacagtaaattaaacaaggtattataggtgaactaccttgaattttgcctcagatgtaaataatctttagtattcttttttttttttttgagacagagtctcgccctgtcgcccaggctggagtgcagtggcgcaatctcggctcactgcaagctctgcctcccaggttcacgccattctcctacctcagcctcccaagtagctgggactacaggcgcccgccaccacacgcggctaatttttttgtatttttagtagagacagggtttcactgtgttaaccaggatggtcttgatctcctgccctcgtgatccacccgcctcggcctcccaaggtactgggattacacgtgtgagccactgcttccggccaataatcttctgtgtgcacactttctattcacatccagaggcacagttctggacattggggatgggggatagagatggtaaggttgaacttcctgacttacagaccttataaatacaagcatacaggaaaggggaacagaaaaagttctgtgcacttaaatcacctctcggtgcttctccccactctggtcattatttagccagtaatcacatccattaaacacaagcaaatggccaagcagaccttttttctggaggtgctacagtttgatttatgataggtgagattctgtgaatacttgtaccactggagacagaaatagtcactgcttccctgggttcccagcatctcagatatgcttcatccagtgctcatcacttggaaaagacttaacgctcatgcctgtctctcactccaaaatgtgaactgctggaggacaggagtctgtcacattcatccttgtgtctgtagttgttagcctattatctgcctcacagaggacacccagattttgttgcatgagccagtgaatgatctaattcgtatcatcttagttccctctagaggtgtctgttaaatgtcagcccataaatgggttactttgtaggaatcctccatctatttactgccctacactttaatcttaagtcatttgtcccctgaaaatatcatctctagtagaaagatttgctggtgtttcctatgggtgaggaaccggagtgcccttcttctctccttgcttcttggttctagatacccatgggtcattcctttcttatcagaacatagactttatgtcttgctccagtctgatgtgtctcaaactactaatagccgtacctccaccttagcaaccttgggatcagtctgcagggcctgtcctcatttattgccacttattatagagccctgacttctggaataggatttgccatctgtcctgagaagatgttgagtggacaaaacacagtcactacatctctggtcgttgcttctttcttgccaccataaacttgttgagtgatctttgctttcttcctaatcctgtggaactgtgtctattgatatatcagtcattcacctgtagaggagactaggaactaatactgtgaagattcataatcctacagaatattgttaagaacattgtctcaaagcctgcattttacttcttttgatatatacattcatactcatacacacacatatatattgatagatgaatgtgtctgtgtatgtatatataaatatacttaccacctagtgtcctggaaaaatctgttgttgtaaggtcaccattagaagatactacatatcaaagattcattatcatcacttagaaaagcagaggtctattttatatgtataaaaccactcgcttatacacagaggatctgaggaaactttacagtgagaacagattctataagatagtgataaaatatttatgagaaaggagactcacagccatagaattgtaagtaaaagttgaaagtgaaaaatcaaacagaaagcacccacgggtatacagtccatcagtgcctatgcagttgtgggagttaaatgttaaattaggcccccagttttctggccatcaaagtgaaaaaggagatagggtcaaatacgctgttcttattttcaaagaggaaaaaacctgctggatgggacaactgtctctctaatagagatttttcatatggaaaggaatggatttcatcccactgaatgatgaagttgatcatgtgcttaattgcgttaacaccacaaatgcagaaactggtttcctgggattgttctcaataaaaagcaaaggcaaaatattaaaatacaactcagttccaaaaggtcagattgacacagctagaccgtaggtgcttggaacattgtttctcaattttgcaaactgcccaaccatggtgaggtagatccaaagaccccagttcagaagactgtgggtagaatgttaacatgactgaccccacatgcagaaatggattatgcactgccgcactcacttcctatgctgccatccatgtgatccatatgcttatgtttttttctttttaaaatcaactttaaagtgaaaacatacaattttaaaatacacagaactcgaaaactcgtgagttttgaaaacactagcctgatgagtagatgcagagagagcatcctccataaatattactttgtttttgtagtttgattttattttgttgtggcggagggatgggagagttgcagaccagttcatgacagtttgtaactgcattctctgacaagcgccgaaaggagaacttatgaggctttggctgaacaagatccttgttatttagaaaccaaaggaacaggtggtatgattatgtttcttttatgtgaacttagaagtcatcaaaatcatcacctagaaatatgacctccaaagcagtgttgtaacagccctccaccttcgtcaagaacccactgtatgtctgctcctgcccacaaacaaatgtcccatcagccgtcagctggagctggacaatggcctctactgttagatgggtggatgctctccacttaacacagtaccccctgctgtcttacacatggcccacctctcgttcctggaggcatttgggtttgaaatcctaggtgtagagtgtgcaagtgattatttggtttcttagatacgagcatttgtccaacgtatatacacaaacatctagataaaatggaatatcttggttggaaagtcgtagccaaaagctgactctgtctgtatgacctacttataaaacgttccccaagtgagtaaatgaattagtctatagtattgttattggatagaagccagttgaaactaccagaaatatttttagccttacggtatttaatactgaaccatttgttctgacagcatagttagcagggccagatatatattgaggctagcccccattcacagctctaaacaagtcatcagcacaaaagaggaagagtaccctcttcccagtggtgccaagagtggtgggtggatggggtggggatgggagcattacttgtgtatggcacaactagccaaaagcaacttcagggggttatgaagtaagttcagagaaaggggatctgaatacaacttagcgtgtgtttttagcctgttttgtgccatttgaaatacttctgttttggagcactgtccctgtagcactctgcttctcacagcagtattaaaatgcagcactaacagtgaggagcctggatgaaggtcatgttgcccacccagtaattagttcctgttttattcaggcatatacgaaaggctaataaaaactggaagtaatcttatgttggccctgacagaattttctctaagacagtaacatgtgaaatcaccatttaaaggggagccgtacccagcatcagcttgctcctcatgtaaaattttggcctagaaaattcagacctgcaggctgttaattttcaaaaaaaaacactagtacagaaaacattaagaacccactgtctatatagcaattatgctcataatgtttctaaggacgtaatgtcttctactgatagaataatggagatattctggcactttgagagcaatactccactcagtatgtgtttattgagcacccctcgtgttcctggggccttgttaagctaattttgttaaagagtgatacacattgttgtaatcctttctaagggttgttctcttccccttttcctgaaataggatatgcttggtgtcctccagcacacacacacacttcccctcttctccctgtggaataagccaattgaaactagcaaacatatttttagtcttatagtatttaataccgagccattaattatgagagtatagttagcaagaccagatatttattgaggctagtccacattcacaactttaagaacatgtcatcagtataattaataaagggaaaacttaaggatttaaaaacacacagaactcaagaactcctgagttttgaaaacactagcctgaatgaacagatggagagaacatcctccatgaatagtccttctcttttcactttggttttaatttgttttggtggagggatgggacaagctgcatgtcgaagctgcagagagttatctagaagatttagctatgaaaagtgatgaaggtggctacactaaacaacagatattcagtgtagaggaagcagccttctatggaaagaagatgccacctgggactttcataacaagagagaagcagtcaatgcctggcttcaaagaataggctgattcttattaggggctaatgcagctgataactttaagctaaaccccacggctgttaagaattatgctaaatctactctgcctgtgctttataaatggaacaacaaagcctggatgacagcatggtttattgattattttaagcccaccattgagacctactactcagaaaaagagatttcttccaaaatattactgctcattgacaatgcacctggtctcccaagagctctgatggaggtgtacaagattagtgttgttttcgtgcctaacacaacatccattctgcagcccatggaccaaggagtcatttcaactttcaagtcttgttaattaagaaaaacatttcataagattagctgctgtagatagtcattcctctgatggatcagaactaaatcaattgaaaaccttctgcaaaggattcactcaccattctagatgccattaagaacacaggtgattcaggggaaggtgtcagaatattaacatggagtttggaagaagttgattccaaccctcatgaatgactttgaggagctgaagacctcagtggaagaagtaactgcagatgtagtagaaggagcaagagaactagaattaaatgtggaacctgcagaatgtgactgaattgctgcaatctcatgataaaactggaaaggatgaggagtttcttcttatcgatgagcaaagaaagtagtttcttgagatagaatctactcctggtgaggatgctgtgacaacatcttcaccagataaaacgacaaccagggatttagactattacataaatttagttgataaagcaacagcagggttttagaggattgactccagttttgaaacaagttctactgtaagtaaaatgctatcaaacagcatcacatgctacaaagaaatctttcatgaaaggaagagttagtcaatgtggcaaacttcattattgtgttatttaaagaaattgccacagccaccccaaccttcagcaaccaccatccttatcagtcagcagccatcagcatcaaggcaataccctccaccagcagaaagattactatttactgaaggctcagatgatcgttagcagtttttagcaataaagtattttaaattaaggaatgtatattgttttttagacataatgctattgtatacttaatagactatagcaggggtgtccaatcttttggcttccctgggccacattggaagaagaagattgtcttgggccacatgtaaaatacactaacactaatgatagctgattagcttaaacacacacacacacacacacacacacacacacaccatcttacaatgttttaagaaagtttgcattcaaagccatcctaggcctcatgtggcccgcaggctgcaggttagacaagtatggactacagtacagtgtaaacataacttttaaatgcactgggaagccaaaaagtttgtgtgacttgcttgagctggtctggaactgaacccacaatatctttgaggtgtatctatcaccatccaccaatcagtgtagtttggtaggcagtagcatgtactaatagtctatattacaaaattctcttttaggagttctgaagtatattcaagaaggaagggaagatcccagaacttagaaacttaaagtttaattttgcagacgcaaaacacatacaaaaaatcactaaaaaggcacttctgtgcttcatattgagaagtacaaattacacagtaaattatttcttcataacacttttccacatccacttaaatcatccttttgtggagattgtggcaatctccacactgttctgagattcacatctacccctgataggtgaagaagtaattggtcattgctcctcaaaaaccacaggtagcctttttatcatatacttttcttaagagcctctataaatctctttgaacatcaaacagatttcattgtgttgtgtgacttttttcacccttaaagattgattgtgtttccaggctgtgtttttaggattctccatctttctcacttccactcccttgatccttgtgcttttgctagtgaaacctaagtgccacagttctctcgtcagtcccatcccctcctgcttaagcttctgcacaccctaccataaaaacaagtccacttgaagcagctttattcataaccagaacctgccctccacacttcctcagatcatgcaccagggttgtggcttcacccagatggtagctgtggttgatcaactcaaccaaataattagtattgattggtttattttttttagtttccatggatgttcattttgttagagtacagtattttgcctcgctctacagcctgcaaatttaatgtataaaagtactccgttttctatactttttggaacttatagtgtagctgcacaattcctttcaatcccaactcagattagtttgttagctaaaagtatatagaagaattctgagccatggtaagatgattcttttttaacattaattttctgaaaaaatgttgtatccatgtagcactaaggaaggagtttaaacattcacatgtagtacgtgtgcacacataaaatcactgcctcattcatgtgactttaagcaaatcacgtcatctctttaagtttcatcttcattatcgaaaaaactggtactaataatactcgttctgtcttcttagcggggttgttataaaataaatataaagtaattgtccttgagtacaatgcaaatgcaaatatcctccaaatgcggtgaaagtattttagacatgcaaggggacatattaaatgatttggggatggacagaagagcccttgaaagatggggatatcatcatccagctttcaccggcagattgagcagggctcatcacctcaggagaactttcttcagcttgggagtactttttttaaaaatagctttaggagacaccatgcaatttaccaacttaagttgtgcaattctgttgttttcagtgtatgctcagagttctgcaatcatcaacacaatcagtttcagaacattttcatcaagccatcagaaaactcctgaactgattgcagtcactgcccattttccccctaagctctcagatctaggcaaccactaatctactttctatctctatggacgtgcctatgatgggtgtttcatataagtagagttatataatattaataccttgtcttttgtgactggcttctttcacttagcataatattttcaagtgtcattcatgttatattgcatatcagaacttcatttctttttatggccacgtaatattttattgtatagatatactactttttgtttatatatcagttaatggatatttaggttcgttctttcttggctcttgggctgctaggaacatttgtttatagtgcttttttgtgggtatatattttcatttctcttgggtatatacctaggagtagagttgcttgatgatatgataactcaaattaaggaactcacaaactgttttccaaagcagctgtgcttttacatcctcactaaaaatctatgagaattccagtttctccacatcctcatcagtgctcgttactattttttaattatatccatcatagtgggtgtgaaatggtgttcattgcagcttagatttgaattccccgagtgactaatgattcgagcatcttttcatgtgtttattgtccatttctgtcttatttgaagaagtgtctgttcaaaggtttgcccgttttgattagattatttttatcgtttaattatgggagttctcggtaccagtttttttaaatcagatatatgattgcaaatactttctcccaatctgtagggttgtctttttacctttttgatggtgtccttttaagtcccaaaattgatgaagtccagtttatctgttttgttcctttgttgcttatgctttgaatgtcacatctaagaaaccactccctaatcaaaggccacaaagattaactcttatgcttccttctaagagcactgtaggtgtagctgttgtatttagatcataactctatgattcattttgagttaatttttgtatatggtgtgaggcatagggttttcttctttattcttttgcatgtagataatgcaaaagactttcaacctcaggcctggcatggtggctcacacctgtcatcctagcactttgggaggccaaggtggttggatcacttgaggtcagaggagttcaagaccagcctggccaacatggtctttactaaaaatacaaaaattagctgggcatggtgtcatgcacctgtagtcccagatacttgggaggctgaggcaggagaatcacttgaacccaggaggtaaaggttgcagtgagctcagatgacgccactccactccagcctgggtgacagagtgagactctatatcaaaaaaaaaaaaaaaaaaagactttgaaccccactgagtcttggccatcttgtcaaaatacctgtaaatgtgatagtttattcctgaactctcaattccattgaactatatatctatccctgtggcagtaccacatagtcttgattactatagcattgtattatgttttgaaattaggaagtaggagttctctaactttgttctcccttttaagattgttttggcaattctgggtcccttgcattttcatatgaattttatgatcagcttatcaatttctacaaaagagccagctaggagtttgatagagattgcattgaacatgtagatcaatttggggaatatttccatttaaacaatgttgtctttcaatccatgaacacgggatgtcccgtttacttaggcctttttagttttttgaaaatgttttgttattttcaaaatacaagtttgtacttatgttattacatttattcctaagtattgtatactttttgatgctattgtgattggaattgttttcttcattttctgattgttcattgctagggtatacaaacacaatttggggagttgcaattgtactctgcaaccttgttgaacttgtttatacattctgatagttttttagtggatcccttaaaactgtttacatacaagatcatgtcatctgcaattagagatagttttacttcttcctttccaatctggatgcttttaatttatttatttttcctaattgctctggctagaattttcattactatgtcgaattgaagtggtgagaacacacctcattgtcttgttcctgatcttagggggaaagcacttggacttttgccattaagtatgaggttagctgtaggacttttgaggatgccatttatcaagttgaggaagttccgttctattcctagttggttgagcatttttatcatgaaagaatattagattctgtcagatgccaaaaactgtgtctatcgaatgatcatgttgctttttttccttattgtgtgacatatcgtattaacattaatattttggatgttaaaccaaccttgcattcttggaataagtctcacttggtcatggtgtataattttgtttatatgttgctggatgtggtctgctagtaattttttttaagatttttgtgtctacatttataatatactgatctgtagttgtgttttcttgtcttggtgggagttattttaaatcaactaaaattaaagaatgaatgtagggagagtgtttcaaggcagagaaaaatttaaaaatcattgatatcgtgatgagacttctaaatatgggactatgagtcctcagcagaacataaccctgaagcacaatggaaggagcacaaggtttcagttgaagagctactgttttggcttctgtcgtttgctgtgtgactttgagtaaactacctaggatttcctcacttttaaactcaggataataatacctatgtcagaccttcattatagggattaagtgaggtgatacatatagagagtattttgttaaaggccaaacactattaaaattatacgtgtttataccatgtacagagaaaaagaatttaagagagagcactgggggaacagaacatcaccacttcaaaaaagaccataataaaatttttgaagcagaacaaaacctaatgtggaggcaggatcattcatttgaggtagacaatgatttaaccaaacaaatagaatcactttaaagcacataccagatatgtgagtgtcatggtcataaagtttagctttgtctgggatggaaggaagtcagtgtagattttcctagggggaatttctgttccttggtgtaaactggataacagtgtgttttattttattttgttttgcttcactttattgttttctgttacatgaacttacattgagttgagtaaatttccatcaacttataacctcctattagaaattttctagaggctgtttgaaaaacatcaaaggacacaactaaaaaatgactacaaatatgccttgtttgttttaactcttttcagatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaaggtaagaaaaggtgctaattacagattaacaggagcatacatggtatagagttctaaaatcaaaatcgtcctaattcagtctcatccaaaagtaaaggaatattgaagttccttttttagccttttttaagacaccatggtctgtcttttagcatgttaaagccaggtagagtgtgtggaaacacttccctaagggaagctatgcctgggtgtagacaatgggtcacctctttccacaggcaacgtgagatgtcccagagttgttttccgttcctcccctgcagttctagcaattcctcagcaagtcctagggcaaagctttatcttcaccctggcattagagctcaccacctcctcacctcagattgctcagttaggataatgtgggcctcaccctgacagtctcagcctgccggcccagagaggaactaactctgccactgtcgtaatacccaggaccctccagggagatcagggacctgctactgcttctctgaaaatatgtggtggttcacatggggtcgtggtatcaggtcaccacctggtgacaccaactcaaggcccagccaggtgtcaggtgtgactctcaggaatctgctttgtctggattccccttttctctccaagaagtaatatgttcatgttccttcaacaggctgcatcttcccatcactgatgttcataaacaataagcatttcaaaacagttgctctgaatatcactccctgcaacccacacattttacagattaggatgttgaagttcagaagagaaaagtcacttgcctgtaaagtcactttacactgcagccagtaacaataaccccgtgcctgactgtgtctatagtgttcttctgacaacacaacactgtttccccagaaaggaaggtcttgtgagccttcctgtcctaaccaggccccagatcttcaatctgaagtcgcatgtgttaatcttatgcctgatctctgcacacaaagtgggagggcacagtgtcatgccactttccatacttcctcattttcataaaattttctccttttgatatttgagcaatatttacaacataatattgaagatctgaaaatgtttaaagtataaaaattgcattcctaacatagttcataacagtgagttcttttccctactagaggttattttacccaacataggagaaaagtagtttattttttaggtgatgttgacaattaaaaagaattacttcaaatttttaacctttctaattgttttgttccctacctgcccccagtctgcaatagttctgaaactgtgcagcagttgatgctgtaaaaatgtagatacgaacctctgtgtagtcatcatactgagttgtctgggcatggatccagttatgtctcacttcctggaattcagatccaggctcaacgtagaaaaatatgtattctaatactttttacacaggaatttaaaaaatcttctcttgctcaggtccattggccgcctccctctctggcagactgccttcctaacgctgtgatggcattattttaaatgctgaccttctaactgactttattataatgtcccactatgtccttagaataatgatgaccaaactctatgaactgtctggattcctctctcagcacagcagtagttgtttgttgaagccagttttttatgtatttctgagaaagaaaattgagtaatttatctggttgctctcaatagagggataagagagggtttcatatgcagtatttatatacttgtcagtaacctcagaaacttttttttttttacagtagctttggctacttctgtctcccacctggggctgcagcttagcttcccaacttatgggagaaaaaatggcctaagttcacagcgctcctccaaggcacagtgacccatggtatgtctagactagccttgtcatgaacaagtccacagcaagaccactgttgcccacatggtcgtgcaggtacatgagatagagttttagaagtaacaatatcactctgacttagggcattgttgcttccgctttacagttagggaagttgaggtttgataaacatttatgtctacaactgcgaagacattgtcagagcctaaaatggagtcatgttttctaattaccaacccacagctcttgccacaaagctttccaactttacagagtgataacacctgcacattggtttttagactacagatcctcttctctgggactgctgtgtcaggatgagtagacataaattcagtgtgacagcttcttttgcatgcacccccagagactcctcatgcaaccctgcgcttctgttgatcacagtgggaatagaactgctgatgactagaacccagggaaaaaatgtctctgggtactgacagagataagatttagaagatgctcagtctaactctgaactcatgttctcatttagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaaggtaaatcttgcagatgctaatgagtccctggtgaatgtcttctgttggagaagcttctaccagcgtacgttcttgtttgtttatttccttgggcataatgtctgcttcacgctgttaccagttgccaacaaatttatcaaacagctcaaactgatgatttgaggaaaggttgcacatgtgaaatgagaatagtgtggtcgttattttgccattgcaaatatgcgcgtctgaatactttacagtataagaatatgtacattttaattaagttcactttgaacctaattaacacccaaaggtcagcctaacaaaatgaaattgaaaatgagaccgatgagtcaatcttagcacctttgacttgtgatgcttccatatgcccaagcgtcctggcaactagaagaaaagactggaaccatgaaagccaatttccactgcctagtgccgtcaccgagtatctgttctacttctcatataccaatggctgtggctttgcaattcctctagtgctgttatttatgtcgtggttacctgcatttgctatctctcttcttgttcagtggagggaagcctgaggcatcctggactagtttttctgtcccgactcctattccagctcatttcctccatcctgggaagattctctgcatacttaactcatgtcagtctttaatcttgtgtccatgtgtgttagtgcagacaagggcttgaatatttgtacagacatttctaatagagggtatccagcattaagaagtacatttgcatagtaaaatgaactaatgtggatcaaaaattaatccatgttgaagatggatctttctagaatttctaaaaacagatattgaaaaatggacttatctttccagaaagtcagttaagtagactaagtcttttaagtgcgaagaaatcttgtgcttccaccgaaatgttaataaactcagactccagagtttgcctgactagcttcatcagcctctgaggggctagacttattaaagaccttaaaaatcatataaaagtttaagcttgaggcctctctttctgttgacatcaccgattcccttgtcattactgtactcagagtgcagctgccacactccagaactttacagcttccagatgaccagttttgtggaagtcacccacccctgcatgtatatatactcctcccattccctaaaggcagcatttcagtgctgaaaaaaaaagagcatgtagaaatacatatgatggttgtatagtcggccttacaggaaagggtgccttactgaagcagatgaagataagaatgtcagtccctaagaattagggacaatctgttgccaacttgaaatatttaattacgaatatttgggacacacggtaaggaatatgaaaagcataaattcataatccagtaaacattagccttttaacctcatgggtcttatgtcataaattcaaaataaaactttaaaaacttgttgaataaaagagcctttcctctggaagtaaatgaaaggaaggctgatccttttgcacccaccttttgcatttatcagcatatccatcatgaagagtggagaaggaaggcagttggtgaacaggtagatatatatataactcatttattaccattttcttagcacacattgatgtttgggtaaggagtgaaacttagtgtggtcacttagaatttggtctctgcaacatctgcatagagttgtaatctaatcatctactgtttgagaaaagagttacagttttggtgagccattaatttgaaaaaattaagaacctcctggaattcagatacagcattggacacaaagataagtaagagataacctttaactttgaagagcctatttaggctgagttttgaattaaaccagaagaaagggaatgtccccgttgaggtatggtggggtaagtgcatcacatttgtacccaatttcatttaaccttcagagcaacactgctgaagcctttattatcccattttggagatgaagacattcaggtttaaggcgatttagatcatttcccccaagggtatagttgccattgtgtggctgagtgaagatcaacggaagtttgtcagattcggctccatttgtgcttgcttcccctgccccacacagcatcccagcctaactcatgccctgcttctagtgtcctcacccatctctactcacctctggcttttggctctgttgaggagtgagggcagtcagcggaggcaagggaggaaatcattttgcagtttgaaaactactccaggtattttgaatgtgatcgtccacctactgtctcctcgcagtttgaagacctcaggggaaagatgcctttgagatgcatccctgagttcacttctagagcctcaggtctgggcagccccctccacctcaacagagctcagcatccttgtcatttcagcggtaaagttctgctggccttttttcctctctgtctctttcatgctctggctctgatctctcatcaaacgtttcagaagattccattttctggttctcagaaataatttatcttgcttttcttgtttttgtttttaacttagttgagtagtgagtttcatatgaatgtatttactctccaataatgctttcattttaagatgtattaataataagaacacagattattttagtataggattaaaaaacagtgcacagcttaagataatgatactaaagggttatttatggctactaataataaacttacaaaataacacaaggtgaatggatcttactgcttagtttatagggtccaagaaagtctctgggatcatttgaagacattttttctcagcagtcattcaatatcatacttaaatataatttcaaatgatttcagagtagcaaaaggattgtatgaaataagaaaaagtgcaaggtgttaatgtgcaataaataagcaatcacccagaaatagttagaggaaaaccagaaacactggtatttacttagtttatacacacaataaattcctctgtgcacagttgcgtaaccagtgttggcccttaccctattagctacagtctctaggtacatcgtcagagtatgaaattagatgaaaggaccccacacaaggattgtggttttagattctaagtaaactaacagcatcactaaatatggcgtgttaggacctccagggaggaagaaccttattgtggctgttgttactggagacacataccttccaaatgacaagataatgtgtcttttggttactcctggaggactagggacatgaacctgggggcccttaaagactaggctgttacttgacagctaacttgattcacaagtacctaagtgctttttaaattggcacttaagtactctcatgatgaattcttagcaagttattgtcaacacccaattcaggtatacagataagcctttccagtctgttaactgattatattctcacattttgctttgttgacttttctctacatctcttgtttatcgatctcattatttttattttctgacccctgtgaagagctagggtggaaacgtgtggaatagcatataaagttttcagttgaatggcatacatagacgacacagccttaatctccttaaaaactaaaaacaaaaaagagattggacggcagaattaggtcttcatctgcagggccactgttatttgtaacccttaatgacagtggctaacatttcatacaattgttatgtgtcaggtttaagtgctttaagaggagcaactaatttgagatcctcacagcatcccttcggtatgggtgctgtcatcccagtttaccatcagagaacacaaagttcggaggccatgtaatttgcccagggtcatacagctcataagtgacagcacagtgtgtccccaggaccagaccctggaccctgaatggacagtgcctctgcgctgcagtgcattataccctgaaagaggctccatccccctgtaaagaaagaatttggcatattcttttgaatccctaaaacaacatgtgatgtgtaagtagatgctcaaaatttttaaatgagtaaataataagtgaggacagtgaggaggaaagaaagactggagcaggaagtcccaaccagacccttcatacagatcttctttttagttgagtgagggagcagaccctgatacagggttaccttaaccagagcgtcaaaagctgatggccattgggacccctgatctactagttgaaggaagaataatgtcagcatgcttatcactgaaaacacattttgagaacataagtaagagtgttatggaagtgtgtgacatgaggtgggcctacatgtctacaggccagttggaccagtttcctgcattgacggttcacccttctgatgggcactcagctctgggctccatccctgtgtcagcctcatgggccttccaagactgatgtgtattctgtggtttattctgtcccagttcagcccctgaagtccagaatcacagagtttaactggggcttcccagaccctctaaggctaatgcttgctgccacgttaatgtactgtttttaagacgccttgtgcatggtgtaggtgccactgcatttcagttacttacacgggcaaggattttttttacattgtcattagatattgagaattatttgctgattttttttttcaataatagcaagtataaatgctgccaaagctgattcttaatgtcagagggatcctgaggagaggttgccatttccattagaaatctattttgtgattgaaggtaagataaggtatcggggagggaagttttggctacatgacatctataacatccccgtgattactcaataagaaaaattcaagagatgtggacaggtgtgtggccagcttagctgtgacacctgatgcaagagattagagcttcctggggactttgaagtcttgatgtcagacctgatctgccttctcatcttgggctgcggctggaccctgcccaggtggccactgtgatctgagtgttcttcaggcctccttaggtgcaccatctcctgcacggaggagctgatgattttgatgaccttagggattttgaagccaacaccagagtatcacttttcaagaactaggaacaacttaggtaatattttaaaaggtagcattcagaattatactcaggttgccagtaaaaaaattccgtgctagcggttgggcaaatgggtagtttcccctctactatttctgtctgtctgaaaacaaagcaaaatccatgttctatctctaacaggaagtcaaagagttatttgtagattgttaaagctggatgagaggtatatcagagtccatagtattcagtattttttaagttttcttcttaataaaaagttaaaattgctatttgcagacatattatcagatacccagctgagtttcaggcctaataattctgctaacctggacttaactcttgaagtagaggatagaggaataagagattcactgtgcatggattccttctaattctgggtttaggatggaatgtggttgaaccaaaaaatccactatctttcttcctgccacctggctttcttggatctcttacttagggaatcctggtcctacttgggacagtgttgaagactggatgtcaggcacgtcttgacctatgtggatttagtaagccacttcagtctcagctcacccaatactgtaagttgtgctcctctaaaaggctggagttctgtgagctgtcaaatatattgtcgtcttcttcatcaatcccaaatttatggaagcactatattctctccctgaaggctgatgatatagcttgaatcaagctgcccttctaatgagatttccactgggctgccagaaaagtctgtaccaggcacatatctgggtgggaattctttgaaacaagaaaaaatgtttccagccctgcccataatgcttcctcactgaacagtatctcaaatgattaagctactgcttttgtggcacggagtcaaacatagtttggctgaccccaagaggcagtgaagtcaaagatgccatagggtcacatgttattaacattctggtacataacagggatcaaaactcagtttatgggtggtattgcttcagtgccatatacgatgctattattagtaagccaagaataataaaatattcgtaatagcctaaagactgttaggcatgtgttttatcctttaactctaaacgtcctggaaactagttccataaatggaaattaaaatataacacagtctattttttgcttgtccaaataaggtcatatgttgggtaacaaatgcgtagcaaatgactgtttcttaacctaggtctttaacataaacatcagaaatttttcaatgttgaatattgtcatattttgatttttctctgatcatttaaaatgtctttacatatttgcaataaaactagaatataggtaaagtaaatgcaaaagacactcacatccagccttaatatatcactttcaagattttgtgatttttcacagctatatagaaatatgtacattatatgagtggctttctttacatgttagatccaccacttacattaatagttaaacaagtgtagaaataaatgttgtagaagtagtttaatagagaagaaatgtttattcttacttatacctaggagttctgctgctggttctccaagtccagcatgtctttgcttgtgtcggtaatgccttgctctttgtacttgattttgagtaagactgtcatactgaaccaagttttacgagtaaaaatgaagattggtcttatactcttaatttgctagatgaccaaactgatcaatgccttaaatgttcagaattgttgagagctaattctgaaacacatgattagaaattcctctgcccctgagtttacagagctcagctgttaagtatttccctgttgaagtggcgtgcaagggggtgggttgctctttatttcctctgctgtctacttcccatacctaaaagggtattattgctgggagtctcataattttcctactaagacaataattgcatctaatagatcagacttgggcctgctaattttcatctaatcaacagaggcaggaaaacatagtctggaatgctaactatgtgaatgaaaaatatttagtcattcttgaaatgataggaatgtttttccaacaagcttaaataaacacaatctcttttgagactgtgctaaactttttttggatgagacaactcttaggcaaccaaacagaagttaatgaaggttattaagagacatgcccttcagaaaaggcctgcagactttaaaaagaaaagattccatcttctttatgctgcaaccattgataaatagcagaattggtttactttttagcttttgtctacccagtagaatttaacattttaattagtaatcatactgcccaatgttcaacagataccattttacctaacatggctatatgagaccatcttattttaaaatcctcatcttcatctcctactgtttgcctcagttccaaggaattcattggactcaacactcctgtatttatagcacctgattacacttttcctatgaagcatgtttgtttattcccaccaacacaaggtcccgccagataataaaattatttttaaacatactaaaatgtacatattcaagtgaagtgtttttcctttcacaagttatatgggaaaaatgtatacttactccagggatacagtcattcagaatatttttggtgcctctcttttgaaactgactttagagatcatagcacatccttttgaatatccttagctttgtaaacccttgactttgaaggtttattagactctaggaaatagccaaagtcatttatgttgaagtctggtttaaaaaaaaaaaaaaaggtggccgatctagctgagtaaaactgtttagaggaagcaaaaagtgacagtaaaataaaggcactttgtcttctatgacatagtaatttgctctgaaagcaactatgaagaggtttcaaacagaattttaacatgaacagcattttggcataagaatatagcctctaaaagtgagtacttttatcaataacacttatttgtaagtataactcctggtgtgtttataaaaaaaatcaattcacctactacatagtatttttatgacttctagggattagaggcatgtatttaaatggtcatatactgtattacaacgtttttctgaaattgcaggtgttctattccaacatttttttcaaatacattagactaaaataatttgcctacagaaacaggtcaaaataggttgcgattctaatataatttatttttagtattttagttatccaattccacttctagttataccatactgtttcctggtatagtcttaagtatatcctataaaaacagaatgatttcacattgcttaatatatgagggttagcactgaagatagtgaaaaatccagtgagtcactgttaaacccccattagaacttttctgtgttgtatctatctgattattgaagatacagtgtcacacaagcatataaaccatctgttgcaatactattttaaaatcgtaggacaggttcaaagaggggaaatgtccattaaagaacgcctcttgcgcatgtgtgggtctccccatcacaggtggctgatgaggtggcaggagcagcatcatacccacctatcagcctcttaatttgagagccccaaatactcccctgcatgagctcccagaatgcagattgggaaatctgttgccaggggactcagcaaagccagatcttggtccaggggtcataccatcagtttaatctaaatttgatgtgctttgagcaatacgggacatgtaacatgtttctgaaatttgccagaaagcatgcattttgttttataaatattttgagtttaagttgatcagcagtttgaccaaatttttatttaccatttatatctacagaatacctgtttacacctcagtggagtttaactttcgcatctgagagattagctggatttatctggtttgtttgaaacagcctagttcaggtatatggaccatttgagatcacagaatttaatgctagctgccagtaaaaagatgcagtcccaggctccagctcttactttgcagcagcctagtgaaacacaactaagaatcctcaagatcctaaggccaagtacttgatccttgtggaccctgcaaatcatgtaactttcacattggctgccggagcaaaccgagagttgatttgcaagccaccgctcgaccagcaccagaactcaaagcatgcgttctgtgtgcttacctcatccctgactgcagcttattcttttctagctaaaatttacctggatccccatttccttactttaaaaaagtattcattcatgatataatttgagactgccttggatctattacataatctaatgaggtatatttatgtgcttctttatgtataatcagtgcctaccatttgcccgtgcctgtgcctttgtgccttgcatggtggttgaacccccttagtttgcctatcagtaggaagacaggagatcatgttgtttttcaccttaatggacagctattgccctgcatgtcagctcacttttaaaacaattcaaggagtctctatttgttagggaagctgtaatatgtttggagataataagctatccacttgggatggcctcgggccttgcatacggagagggtcggcaagctcagatcttttcaaagccataaatctctcatcctttctgggaatcaagtttttaaaagattccatggagattttatgttagacgaattccacagggggtgtgtcccatagtcctgtgacagagatactaagaacatgactcattgcatgaggagcccctacaattcttgttatgaaagtactggttgaattttctcttactgttgacatatgtttgagatccctgacttcctaacactgagatctgctcgttaaagacagtttttagaaataggtcttctgtgtctttcaacttgagagtggcaagaaacactggcaaagataaaaagtagtataaatgattctgtgatgagtttgcccttgtccctaaagatctagcaaggcccccatcatgagagaggaagaacaggggccaggcacacagagtcattgtttcgacccacattggattagctgattactaagagatttctgttctcttggagacatcatagacatagtcaaaatgtagaacaatgatatcagactgctactcagcaaatgtgaaaggcgtcactggctggtcactaacgtgctccaaagcttaccagaccatatgaaaagatagcacagacccacccaccgtctcagatgcttttcacgttatcagtggagacaaaaaatgatgcttaagttacaacaggcagggttcagaatgctgaaccaattgccatactatttatcagctgtgcatttgaggtctgtgaaagggctaagaattcattaattagccattacctgagaccagttatagctctgagcagacaagatcagcatgacatcaataattacaacaagaagtaatgttgctgtcacccttacagtatagtcttttcttgacaagcttgtttgagcattattggaatattgtgaggtagaaataatgagtattcccattttctggaagcccagagaggtccatcataacatgttagcctaatgagagagcagggactcaagctatgttttctgactccaaatccatgaccttggcattgcttcccagtagacccccattgtgagaagacgggatgagaaaaataagatgatgaatgtcaaagtacttgatcattgtggcttagattcaaaggccagtccactcctggctccatccccattgctgagacccggttactgttattctgaactctgtggcccagcctttgatcccgggttcttctgatgagcctctgactggaattttgaccttgctgtttgacttctgggagagctggatccgttttctgcttctacttgtttattcctgcatcctcccacctagggacattactcaacccaagagccccgacccactctcccatcctgtcaggcttgacctctgcccattcttgtgcatatccatccaaattctaggccccaggccctaaccattggcacttaagtccccactgagtaactgagctgctcagcctccatcagtctgccaggcaccaggataccatcatcagcacgtgtgcattctgctatgcactcttccttttctttctctgattcttgtcagtctctaattaagccggttgtcaatttgccaagcagtcagcaaaagtgcccataacttcacgcagtagaagatgagctcctgagttgaatgactgcctagctgttttcaggattattttaataacactttttatttggcattatcaaggagtagggtagttccagaagtgaattctccagataattaaaatttgggatgtcagatcttacattaagaattttataggaggccttctataatgctttgtgtacttttctgccttcttaagccaaagatacagatcatatgatcgtattttaacccatctcaggaaaccgagtgtcatcactgagtaatctcattttggacggcttggatttggggatttgcactccattttcaccattattaagtgtgtcaggtttacaacagccttaagatctggctttctgcttcagtggagctcatttattgtgtacctcctatgtgcaaaagactgccacagtggtgtggaccctaaggaacttactgtctaatcttctaaaagttagaaaattagagatacagcctcttaggacaattttgaatgggagctcttctttgccaaataatgttacactgactttaggtgcttagatgtctttcgttttcccgttttgttcattcattgagcagttctatagaccaaactgtactaggtgctgaggttataaacaatgaatgaagtattgtccctaacgtgcagacccttcctccctggttttcaaccatttgccagaagggtaggttccagttaccaaaagtctgaccgcctgacccatcctccaagttgaaaatagctacttaaatgtgcacacacacaaacccgcatacctattaatgtaacacattatttccacttaaagctaccaaaatataattcctatgaacattagcaataaaaagaataagaataaaatgtaagacaagtataaaagatctagattcttagaatccagtgataattttgtgagctatctcaagctggattcctggaaaaagataccccactctataaaaaaaaattttaatttgtcttttgtggtcttttaataatctcaataatgctaccatcttttcctattaaatatgtttttggtaaaggaagaaaaatattaatatgtctaacagccaagattccttgggaaaagcatacaaaattaataaataggtctaaaataaatacatggttgcttccttttccgatcacaaaataatacaaatcttgggaacatttgcacactgttcattttaaaataaaataaactgctctgagataagtacttcagaaattacaaggatgtaggtgttgttatgagaagtgtacaaagggaaaaaggataaccaaatgtgtagcggctaaaagaatttgaaaactccaaccgtaagagacttttttccatgacttaatgaggctttcttaagtacacattcagatgctacggaaattcccacttccagattagggaatttttgtatcttcaattttttttttttcttattgtctgctttagtagagttttccctctagcttcatttgggaaaatttcatcttcactgtactttccttcccaagatgcaattatgttgacaatttagtgatttatttgaaaggtgttctgaccagttatgggtcacatttgaaaagcatctgtgttaacagcttgacatatgaaaatacagcaaaacagacaagctttgatgctgtcttggccagccttatctccagttttatggccctggctaggagacctgatatatttagccattgaactgccatgtcaagtcagtgacattttggaattttcctactcattggatattcacgttgcttaaccacgttcagccccctccaaccccccaatccctgcccaaaatagaaaaataaaactaccttaagaaagagcgcctgaagtaagtctgaaaagaaagcataattgttcatttttgtctctcataatcaaataagcaggcttgggaatttacaaagaagagctatgtaaaatctgcaaagcattattaaagcctgaaagaagaggtaataagagaaacgagagacagataggaattgttagcttcatttatcttaatacttccacctgagtattttttcacttgtaaagaaatgtaagaatgtgtgtgtctttaaaaagtactttttctgtaatcccagcactttaggaggctgaggtaggaagattgcttgaggtcaggagttcgagaccagactgggcaacatagtgagacctcatctcgaaagaagaagaagaaaaataaataaaaaggaaaaaaaaaagcattgttttctagaaatttgcctacaaagaggtttttccagaaagacttttcttagtgtgtgggtgtgtgtgcatatgaatgcataggaacagagggtgctggcagacagctgctttccacagccaggcctgcagtttaccagaggacagcacagtgaggcagcagtcctagagaccatcagaatctggaaacagagttaattaccctcctgacaagacagtactacacacagacccaacagggatggctgtgtatgccttccacagttgtacatttacagagtcacccacccatactcaagaactgctaattggttgtcagctttcccagggctgctaatcagaaagagtgcttcacacatttctcaaaggagataattaatattatttctgagggagaaccagctcatagtaatctatctaagaaccttgtatggattaattcaaaaccagcagttcagtggagtaatacagattagacagcaatttaaaagcatccattaatattgtcatttaggctacatatacctgaaatataaaaattattgtattgtttcagaagtgaatatatataattatacatttaaaaataactgaggatcaaagtatgttcatttttattgttctcccagagttgttgaactatataatgtgagggtaagactgatctacaaactttataccagcatcttaaaaggctgaatttgagtttcagcttcttacttccttggccagtttttggagaatttctcataaaataaactaacaaaaggcaagaaagtagagagcttagatttgtttgcttaacacatttataacacctgaataaccgaatatgtatttatggtttagtaccgtggccttgaagttagattcatgattttcattttaactttatatttttaatcaaattaattgtgatcccagtagcttaatttcgccattgagtagataaaattgctcctaggaaatatgtgagcatcaatataaaataccgatggtgtttttcaataacagtgtctgaagctctctaatttgtaaaaaatactaacattttcctggaaataattttactgacaagacatctgttaggctttttaggttatgaaagaagtaaccctaaatttttaataaatgtaaaataaagaatcaacatgtgtttgtgtatgttattgcacgttagaagatattttctttcaaaattttgttttctaagacttgggataagaattggtggctgagcatctgcactcctgacacaatcccaagggttctttaaaaatagctcttctggacagtgtaaggtgcttggagggtctctaaaaatcgttcaagaaaacaacaggtagaggagaggaaagtttcccactcagatgctgagtagaaaacagcaaaccaatgtagacataacaaacacccatttttgttctttattgcttctaggctcagaatattttagaattcttctccacaaggaagctgttggagggttccctttagaaatagttgtagccaaagacagtgaattcctgctgtttcaagccttcttcctttggaggacattaaggtatttctttgattcctcagctgattcaatacaagatgagatagaatttcaaggtgatcctataaacagtacttcactgaatttcccctctccaaaaccccacctctgtgcaaggatttcctcattctcctaaatgaggaaatctaagaacatttctctcctttgaaagaggcctactaacacatttctaccaagctagtttaacgggggacagttttctttgctccaagcagcaagtatcatgtacagggatgcatcagtgccgccagaaatcttagcaggacctctgttcaattgaactttgtttacgaaacacgccaaagataggggatcaccatcatcctagaaaggcttgtattctccgacacacagtttcagtgccataccccctgtaacataggagcacagaaatgtaggatttaaatgagaatcttctggtcttcagaccaaaatccgacaggcaatttccgtattcaaagcactgttgcatagactagagaaaagtctgggataataacaattcctgatgagcaaatttcagaatgctctaacttttagacaagcagaatgtatatttcacatactttgctcacactccctcaagcctctttatttatttatttatttatttttttttttttttttggatgagaaacagtcatactgagatactatgattctagattctttaaaatcacctcttctcccaccaggaactctcttggataaaagctatgttaagaatctgaccagctcttggtcattattctttaagaactataaatataatattgatttgaaatgctttaattgagaacagtgtcaaatatgtctcactttggagctaattatttagcataagaaattgaatctcagttgtctcatggcacttgtttccaaaaaattgccctgacattagtaataggatcagttctgagattatataataatatgttggactggaagcaaactctcaaatatgtttaacaataatgtgagatttttttctagataattcataaataggtagatagtctatatacttaccggtcatatttttgtcgtaatgttgttctcatggaaatctaactactctggctatggtctcacatgataggaaaccaagcactaaaatgttgggagaatgacgaaaggcagtacactataatggatgacttcaattgaaatgccaggagacaactagttgcctgcaaatgtgtacaactcaacagttactccaattacatagggtattagcagtaaggacccaagacacatgtgttaccacccggaaaaaaactttaaaatttgttccagtttgtgtctgagtaggaaaatgagatgtatttgttaaatgtaataaaatgagatgccaagtgttaaaatgtcttcttaagaaaacctagatttctagctatatttaacatatcacaatgactattgttgtgttcaccctaatctattgaggggaaattgaatagttctaatgtaaattgaaagttttcatgaataaaagattttgttgtgtttttctgtgtttaatgttaaatattgagggtataaaaatttgaaatggctgtacttccctgtttctttcatctaatataggtcataagtgaatgggaaaatactaatttcagaggcacaaaatgattttttgcttcttgcatgctacagcgttgaggcttggaaggtatcccatgggacttgttttacctgaaatatttaacacacacattgtaagaccagcacatactgaacggccctttatgcaattttatttgttcaagtgaacaaaacctgttatgctgaatattttaggaaaacatattgaacatatttcctctcctggagaaatgtgtgttagatgtacatctgtgactgtgtacctaactgttgaagccatttggatagattggcttctgtgactgatacggggctgcccaagtcagcattgtggttctgatcctcaaataacccagtccatttgttcctttcactttctagccacagatcacaaccttaatcgcatgttaatctaatatattttttaaaaaacagcacatacatcactattgagagcaaatatcatttagaggtagaagatcatctttgtaaaagttggacgatggattctctaagcaaatccctaaaattcactgctgctaaaattccatactaccctatgatatgatgattatacatttttcaaggtcagtttaatcttcagtatatacttttccatagtatgttttctgaaggcaaaattttctcataaatttcacatattaaatgtcagtaaagaatagaagattttggtatgtgtagatatgcttaagacatttctttacccataagctgtccaggaaagcagtgtgcctagagttcagaattcttccctcaactttggcctaatcgctctagaacatagaagtcctttctcactgggataacctgtggtgggtttacttaaacctgatacttgccttctacgctctctcatatttgtggttagagtaattttgacaaaacattggcagtcttgggactgaagactggaatagaatcattatttggggtagctaagaaaagtagtgataaaagaaagactaataggtttgagaactaaagatgtttgcagtaaattttaagagaatggaggggagcagcaatacgctaactcaggatgtcttaaaacaactaaactttagttattttttgatgtttacagttatctgtcaggaagaataccttggttattgaaggaaattagaaactacatcagtgaaaagtttatataaaaattttagtaagatgctgttctttgtaataagaatagagaatgtgctatactcacttgatacatatttttactgggagaatgctgatctaagcatctctttagtaagtcatcgttgcctgctacctgtgaagagttgaatcactgtccccttttagtagatggataaaaatttagaactcttgatctcagcagtggcagctaaaacacttattttgatctctcttccctggtaacaggagatgaaacttgagaaaacagtgtggactaatggatagagtgttggacaggaggttgggaacctctgttctgttctattcccagcctgctactgggttactatgtaaacttagataagccagttaccctctctgcacctcatattttccatctgcgaaaatgtaggtagagacattctatactcagctctttcacaaagatattgtgagcaacagcttactttgaagacgttagtatatttttgttgaaaagatgttgcataagtatgtcagtgcctctgttccctttggcaacaccgttcccacaacctggcattatataaactgtcccttattgatgcattgagaaacaggtaccattacagcagattttgtgttgcacagaagctgagagtgtgactggagtcagactgcctgggtttgaatcttgggtccaccacaaactaatgctgtaaccatgggcaggtcagtgtgctagatttcctcatctgtaaattgaggataataatagcacccacctcattggaatatggtaaagctggaaggcatttatgaacagcactttaaaccttatataaatacataatatgctttatgtaagtatatgtagttaccgttattacccaaagcaattcttcattaatatggtaaagcgtcacctctggtcttgctttgtttagtgcccttattcccagcatggctgctcactctttgtcctgaatgtgtgtatctccctctgctcccacaagtctctgggccctgaggataagtgtgtagttatctgtcgtatcatctaccataagtgagggagtgccacataaaagataaaagaaatccaggtgttttaagctagtctcaaaaactgatttattaatttggaaaaaaaatagtaaccgatttcagaagtattacagaatgggactgagataattgatagttgacagctgtatcctgattattataaaaaataaaccggaaaacatcaggaagaaatagaagagcagttaacaatttaaacagagttcatgttaacctctctcgtctgcttccagtagtggtgaccatcagagaagaattgtgtgaaggtaccaaaaactgcatgaattgctcaaacgcaaagaagcagagtgttcacattttcaaaaatctgaacacaaatatatctgtttcaggggttaaagatattactggagcataaaagtttacgatttgatgacaattactgatttgatttttgtaacattatggtgtggaatttcaaaaattgaatagcatctaaaaggtaatcatatgtttcattggttatttttttctctatttattattagaaccaaccatcatcacagttgatccacctgcatgtggggagttatcaaactgcactctgacagggaaggactgcattaatggtttcaaacgcgatcacaatggttgtcggacctgtcagtgcataaacagtgagtagacagaagactgtatgttttttctgaggcctaatatgatattgtcaaagcatattatgtaattgaatatctttttcacttctgttcagacattcccttgacaacctgaaaaaaaggggaaaaaagttatttttaacacaaacaaatacatagtcatttgggagaaaggagctgctgctttattgtgtttttttctctgtttccttgatggccagttgcatcaggagtgcaacctggagtggctttggagtgcatccttccagccacccagaacgctctccctttagtacacttgccaggtcatccagtgacaaggaggtcacccacgcatacagtgtcacattccgcatatgacagccataatccttagactgtgcttcactttgttgaccccagctttgcctccatgcagattccaatcatgtatccaggccctgccctctagagtatagaagagtatattgtatttcttccagaaaaaaataaaataatacacacacaccccacccccatatatgttaaaaccatttcgaattcccctaattcttctgccggaataaacatcctcattctccttgaccattcttcaggtgacagttcctagaactttgttgatctttaccatcatttgacacacaatatgtcattgtctttacataaaatatggcccacaatcaagatactccagaatgggcaggcatggtggctcacgcttataatttcagcactctgggaggctaaggcaggcagatcactggagctcaggagttcaagaccagcctggacgacatggcgagatcccagcctctaccaaaaatacaaaaaaaaatagctaagcatggtggtatgcgccagtggtcccagctactcgggaggctgaggtgggaggatcgcttgagcctggtggggcaaaggtcacagtgagctgagagcgcattactgcactccagcctggatgacagcaaaagacactgtctcagaaaaaggtactccacaatttggtctgctgaatacagtgctactgtgtggcctaagtttgcattagctccttgaattgcacttcgttggctgatattgaggttataagtagctaaaaacactaggaacttttttacatcacctgctgttaggtggttctcatctgttctgtaatagaacgtttgattttttttttaaacgatataaatacccggccaaatataacaagaaattatccgaatcattttaaaccattttctaactagttgggatatttttgaatctcaataatgtgatcttatactttatgcctcccagcttatattaaataagcacaacttatatatccttatctaaatcactgaattaaaataaactgcacagaaccaaggacaaagacctgcagaatgatgctgaacatagctgcttacagtagtcctaagcatttataccttgagtagagttatttagctgacaacatatatctccacaagaaatcttgaaagacacttcgcccgtatcttgtctgaagtcaaaatatattgcaaaatacatcagagcattcctttgctggaaaccctatttttaaaatgagctgaagttataggggcctggcttatttttccagaatctgtactggctcctggtagtcagtgctttattcccctaaatgtcacaaatcatatatttaacaattatttctgaagaattttcagttgtgaatgtcaatttatgtagtttttagaacactttgtcccttttgaattgacatttggcctattttcttaaatctctttccattctcttcgatctctctcacacacagtactggttctgtaataagcgggctttctgtgggcctgtggttgtaattaccatggctcagagacttggacttaacgtagacagatgctcactttctgatttatcagttatctcaggctttaacataccacttaaccttaatcatttgtcactattttaaaaatatttttgaagaagatacaaaataggagttaagccattctgcttcctcagttacatgtgaccatcacactatctacagtggcgttagtgctaaaactgagtttataaaacgcctgttggccaggcgtggtggctcacacctataatcccagcactttgggaggctaaggtggatggattgcttgacctcaggagttcgaaaccagcctgggcaacatggcaaaaccccatctctacaaaaaaaaatacaaaagctagccaggcatgatagcaagggcctgtagttccagctactcaagagtctaaggtggggcgatctcttgagctcgggaagtcgaggccgcagctagctgtgattgtgccactgcactccagcctgggtgacagagcaagaccctttttcaaaaaactaacaaacaaaaaaaaaactcttgttgagcttgtagttactaccatctttaaatttcctataagcctctacccatttgggggtattctgacttcctacacttgattctgttcggggaagggtcagtccctgttgccttttatacctccctttagaaagccaagttcactagagttgccttggcagcccaagttttctcaaatggccaaccttgttttttgaacaagataattagtaattgtcatgaagtgtttatattttaatccttctaatgcctcttacattaagaaagctacatctttcttaacatgggatcatatatattaatacattttttctgagtttctaaaaagtctaaaaatacagatttcattgtgtccagtcacctcacctacacttgcgcctgggttttgctattgtgaaatcttggccacccggtcatgcttatctaagacttcggtcacttcacacggaatctttcatcattaagttcaaagaagcagtttccctcaactgcctttgaaggaagagtcaaaatatgtcccttggcaaatagtcactggcaaatagtcatttggcaagttgagactataaggaggatgcatatttaccctatctttaggttagtgttttgtttggcattttaaaaggatcatcagcatgtgctacctgagtgcacctctgtttcattcacacttaggaagaaataggtacaggaggagaccattgcattttgtatcaataaatttattatttgcaaattgtacccatttatacagatagctggccttccttccttccttttttcacctaatataaacagagcacctgccacattctaggtagtattctaggtattaaggccacaaagatgactaaaatgcaagaccttccctaaggaaaaaagtcttctgtagcataaacactcatgaaatatcactactttaagccaaaagctataacgtacaaatgtaaattattttaagaggaagctttggtccttcagcagaacccaggcttatgttcacaccagagtagagaaagaactgcccgtctcccagggctctacttggtgctcagcagatactggctgagtgaataaaaaggaaaccttcaggatcagagatgcctttggatatcattcttgcctgagatctccctttgaggtcttgctattctaataatatatccatcttattttggattcttcttaaagttagtcttgtcatctcgctcactgccccactgtatacctaaagacttacttcaacactgattggaatttttcaggttgtcctatacagaagtctagacatacagcattctgctgtcacctcccccattcgtattagcaatccaggttatttggcaactttggaagccacacctttgggatgtcagtcaaatcaaaccaaatttccaggtcctgggttttgtcagattcttgcgatcgtatgcaactctcctctcaggctctgcacagcagcttttgtgttgcacagaagctgagagtgtgactggagtcagactgcctgggtttgaatcttgggtccaccacaaattatgctgacttccacatgggtaataaaggcaagttgctttacttctttgggactctgtgtccacatatgtaaagggcaaataatagtacctaactaatgggttattttgaggactaaataaatgaatgaatgcaaagctaactctggctggcatatggccgttgcttactctgcactgtaactattttatagcatcttcttctgagtcggcccaagctagccaacatggaaagcccccagcgtccccgcccccctttgttcccaccccatcagcctgcctccagttcttcctgccctctaaggacactcacaccaacagctttccttttactttttcatttcattgtaaccctcaaatattatctttctcctccttggttttagagaagggagtttcttatagccaactatggaataataggttgttttttttctattgcagctgctttatataggtatttattttgtcccaaattcacccttacattatttttctgcatcccatcaaaacctttttcacatacagtagtcctaagcatttatacctgttttctcttaaggattaggcctagtttccattagcttctagattttttttttatacagggtcttgctttgttacccagattggaattcagtggtgcaaacacagctcactgcagcctcaacctcccaggctcaagcgatcctcccacctgagcctcccaagtaactgggactacaggcactgccaccacacccagctcattttttttgtatttttttgtagagacaaggttttgccacattgtccaggcaggtcacgaactcctggcgtcaagcaatctgcccgactcgatctcctaaagtgctgagattacaggtgtgaggcaccgtacctggcccttcaagatttcttaaaacaaggccagcaccccacaagtatttcttctgtcttcgttgatttgttgttcttcattcactcattattttattcatctagcatttgttgagtgcctactatatcctaaagaagattaaaaatagtccttacccttgactcacattggtaatttgttggtaatattagtcatatgttaatatgttgtaaagagacaacataatctagcatattttaggcagtcacattaggattgaaatcaaaaccctatagaaacatgtgcttcaaaagtatgtggcaagtatatgatacagaattctttcatttgaacataacgtaatttgccgttttaatcggtaacaaataacattcttgtaacactaagaaaagtagtactccaggacatacagaaagtttacattatccctgactcagttcctcaaaaacttgtttagaataaaaaatgtttttaaaagtatgatagcaacaaagtttaaaactaaaatgattttaaaatgatataaagcaactagtaacctaacactttgtagatacaagcttttaacaacattgctctttaaccagtgtcttttgctaatagacgtaatatacctgcttactacataaactctgtatgaaaggcatctgcatgaattaagtagcatcagtcttttggcatcttagtgtacacatctttaaatcaagtggatttgatcagattatttgtaagttctcttccaattttaacattctttaattgtagacattaatagtgctttttctagaaactgatgcagacttgtagaattctgcatcagtcagcagagaggaaagagccttcatatttttcatgaaatatgtatctgaatcaaacatcacaagaaggttgcagcatcaaatatagggaggcaggctccttgttttatttcactgtaattctaaactaacacctatcagggtcaaaattgggaccaccatttgtaatgttgcatttctttacttagtagtcttgggaacttcatggccatcctgaactgataataggtttgtaggaattgccagcatctaagagtttaaaatacactaagtcctcacttaacatcctctgtagattcttggaaactatgactttacgtgaaatgacatgtaacaaaaccagttttaccagaggctaattgatataaacaagagttaagttcctaccatatatttctggtcacgaaaacatcaccaaacttctaaataaagacctaaaacatttctaatagtaacaattaaagtaagcatgagttatatatacatttaagaaaggttaacaaaaaacaagtacaatgatgattccccatttttaatgaatcagtgagtgatagtggttgtagtggtgctgtgttgaatcaacgaataaatgtttgcaaagcaaacattgtaaggagcacctccttctgccatgcagttcaaacacataccatacccagtgtggcaggctcactgaacgctgttgtcctgcagtgtttattgttgtacgtttgtgtgattatcacctgctttaacagatttgtattttataagaatttgtatttattcactcatttattttccaacttgcttattccagtccagggttgagggtggccacagcccatcccagcagctctgcaagctgcaaggtaggaatcgaccttgaacaggacaccatcccattgcagggtgcacacacacacacacacacacacactctctctctctctctctctctctcacacacacacacacacacacacacacacacacactcagattaggaccatgtagataccccagttcacctaacgtgcacatctttgggatgtgagagtacccagagaaaacccacacagcatgagagaacatgcagtctccacacagagagtggccccaaccgagaactggtttttattcccctcctaaaagttatgacacaatgatgttgaacaaaaccattgctgtttgaggacctgctgtactacagcaaagaagtatgcagtactcctctaggggacaccatccacagtgtgttctccatggaggttacgttgtatttatatataatgaatggcgcccccgacagctgtgtcacgttttgagcataggagcaaacattcctttttttccagaatgaacagagttttactacatagttgctatcgaccggccatgctgtacaggccctgtactttgccattgttcatcactttctcttcaatcgtaacttctccccatgtattagaaagcaattttagatcacggtaaagtcatgacgctgaaaaattaggaacataaagccacctttttctgcgtggttgcctcaagtgatgtactaaagctttacaaacaaacatataaacccctacccttctatgaatactgtttttctactctttatttatgtttttatttatttattttttttttagacacaggttctcaccctgtcacccaggctggtgtgcagtggtgcagtcacagctctcactgcagcctcgacctcctgggttcaagtaatcctcttgcctcagcctcccaagtagctgggattacattcactcaccaccacacccagctaatgttttattttctggcagaggcaaggtctcactatgttgcacaggctggtctcaaactcttggcctcaagcaattctcccacctcagcttcccaaagtgctgggattacaggttccagccagccgcagtcagtctcctctttatttaaatgtttgctatgatgatgcatttctcttaagaaaacttcataattgacatatgtggatttaggactaccttccagtttttaatgttgtctatttctgaactagaagatggtattttgagatgttttggcaagtgctagtatttcaggaaaatttcaatgttatcagagtaagttattttcatgctgtcatttctctgataatatagcagtcttgatgacagtggaggagtaggtaacaagaacattgattgatgcatttagttagcaaatgttgttgaatacccactctgtaccaaataccatggttgtccctatacagtgtgtgcctaaagatactagggcctgggcctagagctccctctattgggaagctgaatgtagatgggccagagcataacatgcaggagaatggtcccaattcagggcagcactagagcatcccactcctaggaggcatagccagtctccttctaatgaatgtcctgtatttttatttaaatgtaccagcctttgtttgaaattccattccattgcaaagcagaggtagattacagactagtttttatcacattgtttaaacttgaatggagacacaacagttttctttaaaggtgaagcacattcaagatcaaggtctgtggaaaaactccttctttattgcaggaccagaaaaataaaggcaccaaggtgctcaggctccaaaattgcagggaatttaatcccaagggatgttgactgactctgggaggttttcagggtgtttttaattcatctgtttcccaacataattcatttgtagccatgacctaagcattcttgtgacagaaaaatgggttcacaattgacatctgtgttagagaaacatgactaataaagtcttcttttttcaccattcccttaataatggggaatgaaaaattatgacctttcaagtcatataattacaaatttctaaatgaaccatttagaatttctcttttaaggatgcaaattagtaatcagttgctttacagtgtaatacaggcacatgaggttatatttatatgtgtaataaaaggtttatgataatgacagagtagaaaattacaccataaatcacattttccttcttaaaagatagcaaattaaatatgcaaatattgccaactgagattcacaaaagatgctatcttgaaatatttatgtaaaacacggacccatttcacctattcattgtagttaagttttaattttagattataatataagtgtgttttgaggggacagatgcgttctgtttttcccagtgacttctgtgttattacaatattcatgcttaaaggacggccagataaaataaaaatttgttcatcattccaataattagactctgcttcccatttcaccagtccatgtagaacaatattcaaacattgctgtactttggccatcaccatattaacttcccttctttaaatttgattgtctttcaaattctatatttaattcacacaggtctcaacttgcttgctttatataattaagcatgctttttttctttttaaccttaaacatttctatttcccttttctctcgtaagccctatataaccttttaaaatcattttagaagacttctattaggctaataacttcagtaatgttgctagtcaccattgctactttcctttttgctcttctaaaatagtattgtaactgactagcagaggacagttaaacatcactccagattctgctaacgggatactttgaacacttcaaatagtggttacttaaaccttaatatgagtattttttcaacacacacattttttagcctgtgaactaaaaagcctattatgtaagtatatccaaatacaggggtatttgtcagcacatagagaaaaaacatatctaaatgtaacactgaatattttaattactatcattttgtaaaagatgtacttttttgaaagtaatagtaagaaatcccttatgctgcatacaatatgcagtattatatgatagcatctaacacccataaaagtagttgtcatgtggatatttaaaaacatgcgttatgggatgggcgcagtgactcacacctgtaaccccagcacttgggaagctgacactggcggatcacttgaggtcaggagttcaagaagaacctggcaacatttagtagagaaggcgaaaccgcatctctactaaaaatacaaaaattagctgggcgtggtggtgcatgcctgtaatcacagatgcttgggaggctgaggtgggagaatcacttgaacccaggagacagaagttgcagtgagccgaaatcacgccactgtactccagtctaaatgacagagcgagagattctgtctccaacaaaagaaaaaaggacatgcattattatggacatgcaatagaaataaaacatataatgaaaattggactgtaaatttctaattcccacataatgtaaatggtcatcagtggtttgaagtgatttataaagttcatggaaaaatgatctcagtcattaattgtaatagttatcagcctgctgttcactcagagcctaccagatttgagtacactttagaaatctatgcatttcaaagttggactttattttgtttattattaccaaaacatggagtcatgtgataaccatgaaatagcacagtctatgctttttaatgataaccagtgccatggtagagctgagaaattgagatctgtggaagagtggaggattcagggaccgtatttcagcatcgaagtgttctgctctgttcatctttggaagaaacatgccgtctctgtgtcttcacagccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgtacgtatttgttaattcagaaaagctattatgaagtgcaacttggtgaaatgtttctacacattttgttttatatgttgtttgtgaattaatctatggtatattgagcccagaatgtctatacttgttttgttaggtgattcagaaagcagggagaaggttgtatctccaaaaaaaaagaatcaagttttacttttactttttatggacatgggccagacacaccctttgtgcctgttatatgagactttcccatagcagagtcctttagacactgctggcaagattaggagatggaattgtgaggtcccagtgttggaagtgctacaactcttcacacctgtcccaaggtctatttgtgatcatttatttaacacatactttaagatcaattgaagaccgaccccccactcacttgaaatacagtgcatccttagctgccatgcctaggtgtctcaccttggaactagtcagcgtttcgtatttttttctttatctagcgttagatttttatgaattttcttggagctaagggccattacttttattttttaatatactttattgagtcaaaccccatgagaatctagattattccagggggggaaatagacacttcatatttgtttctttcgtgtctgtataagcacctatatttgcctttatatcaggttgatgcctttagaaaaatcaccttaatttatatttttccctttgctgtctttctttcatttcaatctgtctttccaatttgatatgtttatgtagtgctagattccttttcttttttttttttttttttttcaggcagggtagtgctctgccacccaggccgtagtgcagtggcacaagcatggctcactgcagcctcaacctcccaggctgtcagtcctcccacctcagcctcagcctcagcctcagcctcccgagtagctgggactagaggcatgcgccaccatgcccaactaatttttgtattttttggagagatggggtttcaccatgtttcccaggctgatctggaactcctggctcaagcgatcagcctaccttggccttccaaagtgctgggattacaggcatgagccactgtgcctggcctagtgctagtaattataagggacttagacctatcatctctttcccatcttctgtcagtcatctttttcattcttcatttaaaaattctaggtttgggaggggtcgtctttataattttcattggataattaaattggaaacattgttccgtaaaattccccaaataaaataatgaatcatcatcattcttaatcctaaaataagaatatgatgtcaataagagtattatgtcttagcctaactgctcatataaaatgaagtagttgtatcacaatagtaggtagcttcaaccacttgctacagtatcatgacagttcagaatcaaggctgtgttcaaatccaaccgtcatgttggagaaaaatctcttaggagattgtagatttcactttgtattcctgtcagcacattcagggaggacccagttggacaccttggacaactgaatattatactggctagaacacatgtgttaaggacacacaccaaaagagaattcttggccagacaccacgtgggagtgtcaggatgaaggcagcagttggtgccccttttatgtacctgctgactaaagaattactttctgcatgcagcagatacttccagaagggagggagggagggagggacggatggatcgtaggtgggtgggtgggtggatggatggagaaacaaatgagtacacagataaaccaacaaaatctccttcactttcctattcatggagttgcacattcatctttttattgtggtgtaccactctccctaattaaatcaacagtcatgtcattgagattctgagagccacatcctagaagcacgtaagtgcttgggcaactctctgccttggtcatgagtaagtggtggtaatggccacagggagctaattacccatcactccaggaatctttgagagcaaaagtcaagtcattctgtttaatagcaatatcactttattgacccttggtctgagtgcttgggcatcatttgagactttgtgattttctgacctctgacaaaattttaattacccaggaagaataagcacggctgtgacatctgtcgctgtaagaaatgtccagagctctcatgcagtaagatctgccccttgggtttccagcaggacagtcacggctgtcttatctgcaagtgcagaggtaagtgtgtacacacggcccttccccctcaaagcagccaggggcaccgaaacaaggaacataaggacaccctgtaatgaaatggtttcggtggttgctgcctattctaacacaaatgtcagtctctgtgggaccgtcccacaggactcccttttcctttcatttttatgaagtaaaagctcagaatagaatgtaaagtaagtatatgatggacaagcacattgactaaattaatcacttcctagctctttttacttctatcaggaactttagcctaaagcacaattatctgaacctctatagagcttctctctgttcaggagtaagattaataaaactgcaacagtaaatagccccatttcaaagttctagagggtgggtatagctcagaagttagctgctgtatttccagataacagttttccatgagaatttagcctttggctgaataagcacatgccagcccacagctgtgaataagcacagagcctggatatccctgctgcctgaggcttctccagggagcttcctgaagccactgagcatgcaccctgaccgccgtttctgcctttaccccagctccagccctgctgcctatccctttttatgttgtacttgtcagcatgatgcacagattaaactataaaagattcctaaactttgttttacgatttttcaaaactggacagttaccaccttaatggtgtttctaaggggttggagtaaacaaaaatctagtcactgctttaattgttctgctgaacaaaactctgttatttgcaaggggcccaggatgtccccattggatgaagcttctagagcgatttttctgaatacattcaacatatttgtaaaatttgttataaaatcagtgcttgtttattgtataaaatatgagaaagtacagtggaaggaataaaaaatcagcgatcatcccacgaattggagagaaactatttgccggtttttttctctcttttcttttttcaagattgagaacatactgacttaaattcttttcatgaacatgtcccatgtcacaaactgtcctgtgttagacgtaattgttggtggctggggtccagtccatgtacagactctgtaggctgtttctcctgtgcagtagccacttctttaccaggctgccttttgtctgtccagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcaggtaaaagctggctgccatctgtgtgctccataagcaaatgacttctgccttgcagggccctagacacatttgtaactctggggaggttggaggggacaacccctggaacacttttcagcactgtgtggtttttgtcaaccaccaccacagaatcatccaggcactatcagtgaagaaccaaagaccagagaaaattctatcattgtagaaatggctctcctcctttttgaatgattgactcagttatgtaaggtctttggactacatttttgtaaaggtttgtgggctgatgttcttacattccagctctccattttattgatagcatattaagtctgaatgtcctcattaatatgaggggattggtactagttttatcccataaaaccttatcacatttaaagtaatgtttgagagggagaaactttttgaagtctgtggctattgctcttttttaaattaatagacatgtggcactcttgccaaatggagagatttagagtgaccacacgtccaaaacatttaaaatcataatcatggtaatcaggataagttactagaaaaccagaacagatttgtaattcaagggagtctgaattatgattgtcaataacagtaattataaccataaacttcatctagtacgttttatccaaagagctcaacacagtcttatatctattatttccctctctgtgcaggccactttgagttagggaaaaacacattgaggcagtttctcatttggaaaacagacacagaaagattgactgtcttaccaagagtaaaatagtatgtccaccaaaaggcctgggagaaatgaagtctctcaaatcttgtatcagatttctttcaaagttaagtctactgtcagattttggaggatgattgtttttcctctggtcagtccaggtcctgtatctccctgtgcgtgagtccacctgtgcaaaaggtgtagccgggagcctgaggcctggtccttgtgcaacaagactagcctgggagggaaactgaccttgttcgccatggttggggagcaggggagagggacacttgaagtccctttcagctctgagattctgcacagctcaatagctacagtatcagagtgacaggcagctcccataccttgtagaaaacgagattacaatgcagaagagatgactctttttattttgttttgtttccctgtagttcagttagaggtgctccatgtcagaactctttccttttttccgatattttgctagttaagtgtgaaaaactgctagagtcccctgcataagaaggtaaatgaggactttaatatgatagaactctgtgttgactctttggggagggaaaaatcatgtgtttgcatgaagacccctgctttaattataggtgtgaatgcatagaggagggatttgtacctgggtctttgctaaacatgtcctcaatgaagaattctaacagctagattggtagaaatgcaaagacattaagaatggataattgacctgagaactgaaaatcagtagaaccagaaagatctttctctattacagagtcatggaaagttcttacgtaagcacacgtgaagttgttgttgataccttactgtgggtgtgtcaacatctggatatacgtgtatgaaaacacatttctgtagatggatgtgtagaggtaaatgttttctgcaaatctttagcatgttgccacataagcctccttctgattagagactccagagctgttgcattcacggactcctactttaaagaatatttttctcccctcttcattccaagatcagctgtttttcttcttgggatacatgagtatctcccgaactcttctaatgaatatttactaaatgatagtgtctctcagattttctgtcttccatacactctacatttgagtttctcttttgtctccatgtctctggcccctcttgtgttttgccttgaggcatatcgtacggcaaaaaggtgagccagaaagcatacctgcaaacacgcacgtcagatttcttctgaccacttccgtacatgtcagcatttaacaaggcagtaattgtcagtcctctctaagccctttttgaaagcaataagggaggcttttgctatattcatttatcgatactctttgggactttttgtttctctgtaaaccacagatgcacatttaccatcttgttcagcacagttttcattgtaattctcttcctctctgttgttcttatactggaaagttggttacagttgcttgtgaatgtaagcattgattgatgagtatcagttttctgtgatactgtccctgggtctaagttccagccttttgtaattcccttgagataaagctgtattagaagttgttaccctcttaactggaaatcagcccacatcacttaatttcattagtattgttgactctcatgctaaccaccactttgaaagtcatagccccaattcactcctaagaagatttcagctctgagcatctctgcatatatgggcccattctggggcgtgacttccactgagctccaagcatgagctagccgtgatgtctccagactctttctcggcgggattcaacactgtcaacacattcctgaagtgcttgttgcatttggattacgtgactatggttaatgtcttcatacttctcatttccccagcaaaacttcagggcaactcccagcccctcttcagacattttcaacattaaattccctctctatcagtgtcatctctccaagagaccaaaactacctctcctctggggaaagaaatgatagttatcaccagcctgccagcatttacctctcttcatgatgatattgccaagcacatgtttagtctcaggtgagggttttcagactgttgattctacaggagcattcctgctcagtttgctggcagctggcttagattggggtgtggcctgctcgacagcaggacatatttccaagcataaaagtactcaggatcccagaaataataaagcagatagggcatcgatcatttggaagttttatttaatctggagacatatccatgatccaaacaaccatagacttgggttgcagtttccctcgtctctccctgagctctcagtttcctcatgtataaaataaggtgactgtaaggaataaatgaaataacacatgtgaagtgcttagcatggaaataactgaaccgtaccaagtattctgtaaatgagagatctgaatccgagacagttcctacacattcacagaaatgccagaagaggcccctgttctcatctctagagtgggagtcccctccctgtaatttaatgatcttattgaattctcttattactgttgacagacttaaaccacttgaacctcacgtcctaatattagctcttttgccattgtcttctgtttccatgcatggaatattttcttcactattctcttaataagaatagagcgagatgctcttcacagttcatctcttctatcccttaaagcaaacagcaccaggctttcaagagttggaaagattgcagatgaataatgtgttctgattttgtgtcatttcccagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacaggtaagcgacaccatgccttgtgggtgcttggtggggaaggatgcagctctgggtgttgtcattctgtgggacccacagggcaggatcagccccatatgggagtgtgccaaacccagtatcccatcaggaacagctggcagcctgcttcctgcatgtattctctttatcaaccacctatttatgcagtcagcatgcctcacacctgagatgactgtgaaacaaaaaaggagactgttgctcttgccaatttttttccttaaccctgcatctcaaactcgaggcgtatacctaagtagagaaagtcccaccgcaccaaattaaccaaaagattctgttactgtgaaaagtcatctttatgtaacaaatgagaagaatagttatttataaataatgtaaacaaaattctttgtaaataaaattctttgaaatataagggtggcgaagagactttgaaatatgcataatgccaccccctccaagttgggatgattagtaagttaatgccaaaaagcattaagtgactagcactgcacatgtataaggagtgctattattttctactttttatttctcagataatctgaccttagcaggtaaatgtatggccatgaaacttgttagaaggaaatttgtcaagatgttaatcataagttactggttttatataactttagtagtacttttaattaatactagatgtgactttttcaaaagatatttaaatataaaattatcaagttgacaggactagttttgttttgttgttgttgcttcttattcccatatttcaacttaaatcaataaccatttactttctaaacatattcttagagcatttctgctcagcaaaacataaacccttgtattttattacttcttttttttaacattggattatctagtcagctggccagaatctgttgttccgtcattatgtgcagcatcatcagtgtctaaattttttataagtttatgttgatggcatttttggaattgatcagatgaacttatagggatagccacattactggctgttgtcatcatgcacggcagcccaagtattaccattttagtacagaactgttaatctgagaagcttaattagcactacagcttttctagtataagaaatagttcatatgtgttacatttttaggatatgcatgacctatgatttcctaatttgttgtcatcacaattcactcagattcaaaccctactgatgttttttgttaatatatagcagtgactttacttacatcaccttggtagaaactacttagagtgatcttttccttggtgataatgaatttatgtacttttagctatttagtttacaaatatttgtagaatgcctgaattgaactatggggattccaaggttaatgaaaacagacatgattcctgtcctggagcaatagccgaaaagccaaacaatccaatattccacgttaagtcaataatgataaagtaagaggtgtgccttgaaagggaggattcaagaacataggcaatccgggaaactaaagcagcaaatacccctggtgctatttgtgttatgagtgatgaacttagggattgactaagggagtggcactgggggaggaaatgcctccaggaccactagctgaaattcattgatgggacaccttactgaactcagaggttccacccataaagagaaggagagctatgtggaggtgggaacctctgagtatgctaacatgggtggcatgtgcagaggcccatgggttctagccaagcaaggcagtggtagtcctgcattcctttccatctttccaaagaacaggcaacccctcatgtgcctggctttgacttctcattcattaacttaggcctggatttttttctttacctctaactaaaggatgtttctggactttttcattcatcgttgtattgagatacaaaaaaataaaaagccttaaaactcaaattatcagtttcttcccatcacagtaattctcaacagtggcattgataagtggcatattacacatgtagaaaaatatcatctctaatcttaggacacttgcattctaaaatggcccaaaagtcatagctccacagtgggataacagcttccaaagggtcgaatccctcatgatgcttccatctgtagggtgccttgtcatttcctctcttcagctttccctcttctctggcctggtttaaagcaaggtctggtgaggaaatgaggaaagattgcacatcactgcaagtgaagctacttcaccagcatacaaaagggagagggtaaaatagcacttgtttctttccataagtttaaaattttctttcctttatttttagagttggaaaaaagcatggcagagaagagcgagggaggtagaaaataaaaagaaaaaaggaaacactgaaaacagtgaaaacactggtaaagatcaaataaaggagtaaacgtttggaaacagaagtgtaaagaaaagggtctagagcaggaaaaatgagaaaagaggcccaaagaagggagatgctgtgggtaagattccaaatgacattgtcggtcagggttgggccaggagcctcctgcctggtggaaggaaacctgcagactctacctcggctccagccctcacaccgtcactgccagcgtatcctgatgtcctctgggttatttccaggcctcagtgagagccctgcagattccaggctgttcgtttcactgtcattccatagcttcagcacggctgtcccttcttcttcttttcagtttttagacagaggttgggcaatgcttgcatgagctaagttaacgtaagtcacaaaaacctcatggagatttgcagggcctagtgtgaacaagagggtgttgtccttatttctagccaaagcaaaagttagcactggtcagtctcttagagaagaaattatccctcgacgtagataaccacgaaaaggtcattgagaaagtcatcccatcttactatctctaacctatgtgggtgggatctgtggaatcatatctgtaataggacctagagtaccatggagccgtggaaccaatggctgttcttcaacttatgcctgctgcctttgggactagtcataggagatacagttactcagtttaaaggagagggtatgggccaatcccattatgctggctttcctgtccctcagagaaggtccacaatgaagtaactgccttggtcctcaaaaaggcccttcttgtcacatcctgcttactggctgtggggtatattcatgaggtggatagaaggaaaaagtggcatgtagagcttctggatcatatggcaactacatgtctcagttgtttctggttcttgactaaaaataacagagctcatgaagttggttctgggaagaacatacgacaactcttttgattgtgtatgcattgagaaaatgtggccctcttagagctttgctaggtagggctgtcgtggctgtgtctagactcttgagtggtgaagttgattagaagtgctctcttatcagttggactatgacatttctaaactggaaacgcacccacttacattttcctttctgatatctcaatcatattgctgcttgaagttacaattttcattgattttagtggaaaccgatgcccaaagtgctatctggattttctggtgacattttctgttgcaagttgtaactagatctggggacttccaggtctcagtctttagatagcaaagacacagatgatttgcacatgatttctctgtggttgcatccttatgagtgatttagatttcttatctttcagtcattaatgtgaattcctgaacattggaatgttgcatttaggtggtttttggtagtctggtacaatgagaatttgtctgaatattgattggtcaaaattgcatgtggccacaagtaagagaaaatccagctacaatttgtaagtaaatagaggtctattttacatatatgacaagacatttggaggcagatgtttatcagcattgattcagtggctcagtggggtcaaggcctttctcttctgataggggtgtcacagccgtgatcaacgcactcctatcaaggcaggaataatgtggaaggatgatggcagaacatatctacccttctttgaagaaagtgaaagctttcccagaaatcccttcgttagccattaggtcccattagctacggctagatgatggggccaccctagtttcaagggagcctaggaaagcagggaacagaattgtcccatttacttacatgcattgtaatccaagtcctgggacttccccaaagaaaaccaggatttcattaaggaagaaagagcggatgttatataaacaactaacagaataactgtaacatctcttttttgatctttgttattttgtttaaaaatttaagacccttcccgaatcatactttctgatttgttactgcgtcatgtatttaaggaggcaccgaaagccatcatgactgggtgtgctttgaaacacactatgttgcatagttgctggccaacagcatcttctttgctgacctatatgttcatttttccagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcataggtaagaccaaggaaaaaaaaatccctcatctctaccagttgtcactaaatctgtattgacagccatttgctagatcaattaatatttttgaaactggttttttccctgcttgacatgtcacacagacccagtgtagcaacactgagcagaagaaagatatggaagatgtactcccaagaggaggtgctgtaagaataaataaatgaggccaggagtggtggctcacgcctgcaatcccagcactttgggaggccgaggcagacggatcacttgaggtcaggagttcaagaccagcctggccaacatgatgaaaccccgtctctaccaaaaatacagaaattagctgtgtgtggtggcacacacctgtaatcccagctactccggaggctgaggcaggagaatcacttgaacacgggaggcggaggttacagtgagccaagattgtgccactgcactccagcctgggtgacagagcaagactccatctcaaaaaaaaaaaaaagaagaagaagaagaaggagaaagaaatgttctctgagaatgtcatactgttacagcactgtcgtgttctatcggggtccttggccagttcagggttttcaatttcagaactctgtttctccagcctattttttacagtggttttttttttctttttttagacagattctcactctgtcacccaggctggagtgcagtggtgcaatctcagcttgctgcaacctccgcctcctgggttcaagtaattctcctgcctcagcctccctagtagctggaattacaggtgcctgccacctcgcctagctaatttttgtattttagtagagatggggacagtggtgtttttttccagatagaaacaccaagtctcatattagagcccacttagtgtataaagcttgctgctgccttgagatcaactaaatatgaaatattaatttaatctcccagttgttcctgtcttctggcacttaatggattctgtttcaaccacgtggttgtccctgtcagtggcctaggcacacagagtgaggcctgagtaactctagagccctcaccttcttgtgacccgtggtggtgatgcatctttgtgagcagaggatctatgtatattagcacctaacatctggagcaaaactagtcctatggacataagccagatgctgttccgaggtccaaaaggtgagacagctggcagttctatcaaggacagcccgtgttccctgggctttcaccctcttttaacgcttttgtgtccagtaaagctcaaagtcaaatgaaagacaatgacacgtcttaatcagatagtgcacctataatcagagtagcagatgaaaaagtttacagtctgtactaattgcacatttattgttggggattttccatgttttctaaacacaagtcattgcatatatctggagtgatagatggggaataaaggagatctggctacacagttttgtggcatttctgatagataagctgaggaatggtggccataactcaagctcatgaggacatctccctgtccttgtcttgtgacttctggccactagacagggccactctgagtcttttactctgcgtgttggtatatgagatggaaatgcctgttcttaggaattttacacagattttcttactgtaatggtcaaagagtaataaaagttctgttttaaaagctagatggccaaagagtaataaaagttctgttttaaaagctagattctctcttttaatagggttaccatccatataatttattcttcaaaccacgatgcttttgagagtgaaaagggggctgttaataattctgatgggacaatagtcatacatagatcaggagtgtcccaagcaaactggatatgtggtagccctgcattttagcaccggcttctctgtactctacccctaagctttctagctcctaagtggagcgaaaaatgtatcaaggcatatatccaatttagtgctacttaccttttcgaagagctgaccaaaattcacgcaacaaaatgacactgcctttggtgagatctaaatgaaagctataactaagctactctttcaggctgggtaaggggaaagtatagccaatatccccatagttatatatcaaaacttttttttttaactttttaagttcagaggtacaagtgcagtaaagctttaatactaaaggaaatagttcacaagtcaaccagggatacttatgtcatacttgggaaaccagggcccaggaggtctgagaattgcatgttaccttcagaggaaaaatctaacagcagatctctcgtgtgttgaaaattctcagattgttttgtgtaaatttattgttgttttgctacttaattgttaaatttgtaattagtaaattattcgactagtaaatttgttttcatgtgatagtagataatcatctctcacaaaaccaatttaacaaattcaaaattatgaagagaaacctgcaaatcgtagtattctgtagtctttctttttattttttatttttttgccttcatactttctattccaattcctgcatctagattatacattcttcattggtgtagaaaaaaaggaccagtttggctcaaatttgtgattttgattttaagttggactgcagcacttttgctaaattgtggttcatatgagctcgtaatggtatagtggacattttgattctgatctgtctccctccacaacttccctccccctcccaaactgatgcacgtataattttatcatataaacccatgacttagcttcaggggaccatgttgggaagacttaacatttgatgaactgtaaccgtgtaccttattcactcgttcatcttaataatttatatgtgttgtattattgaaatagtcattaagccctcttctgtctgcatcatatttactttgcaagtagcgttgttagataggccttcatcctttcttatctagccctgctatatctaaacatacgaagtcaagttcatgactatgatatagggatttcctgtctgactctccggtttgcgtttgggcttgttctcttatcaactaagaagtcctgacttccagtcagcttggtccctatataagggtgccaagcctggccagcacaagcacacccaaaggcagttgccagctgtgcttcattggcagagcctttatcaccatccagaggtcactgagcaaaggaaaaacatggaaacacaccatcaggcggcatgtcttaaagcacccaattgtttttccagtgggcaccaaagaccagtgctcgcattgtttcctggtttaggctttctcagttttaactcagattatcatctattctcaggatcttgtgtatctcactgttagaatgtacagactatctcaccccagcccacagtgctgacctcaccttggctgtagggctcttccatggatgaatgttctccctaattagtcaaatacagatctctaaaaacctcaaactcacaattaagggacctcttttattagtggtcaaaaaaaaagtatgcatgtgaagtatccttttttcctactgtaagaaaaatgaaaagtggtgattctaccaaaaatagttttctgattacaagtatttgtgttccttgtgtcaaattgtcaagtcactaatgagcaatgataatgcttctcttttgatgttcgagggcctcatattatgtgtgctaatttaataggatatgtaatatagacataattaataggattgatgattaattttgaaaagtgaacagctttgtctagtttcttataatatccatcattagggaattcattgttctactagaaagaaactaagtagtaattacccattcactttaatggaacatcttctgattccctaatttttttttgtactctggttttctaagtaaatacattcaaacttagattttattttcataagctgactataatgaagggttaaaggatgaagaacaagaatcaaaagttgacaagtatgacgcaggtggagataaaaggtctggtgggaattctgatgggtgaaaagagatttcatatgtggttccttgtaaacagcaaatgcctctgttatgacctacttagccatgcaagagtgtactcgtttctaaagcatcccatggccatttcactgatgacatgctacatgcctttctcaaaccttgccagagcaaaaattatttcagtgctttcagtgaagtctttatttcatgacttcaaggaggatagcagagaagtaaattagcagccctcataccacaccactcatatgcctgtggggatactcatatccccatatgagccctgaccacatcaaccttgctctaatgttcgtgttggtgatgcttctgcccatactgagtgccagactctggcagcttctggaggggggaccgtgagtctttcagtggatcctccctgtgtccaggggtcagtcattcctggtcagatattaaaaagaaaaagtactactttgatcgtaacgtctatcttaggttaatttccaggattttcaagcccacttcattgctgcatcatacctgttgactttggaagtcaagatgctcaggtatgtcccccagttaagccactctaggtgatcaggactgacgttgaataaatagctcatgtgttggctaagtcttaagtgttagtatgtagaacattgttttgaaaattatgacttggcaagtatttgttagtaactacgtgttattttagaagatatttcaaggtcagatttttaaagtcatttgttggctagaaattcttgagtcagtgtatctttctcacttcagaaattgtggatgattgtttgtgtttattatatataatataaatatttacttatacattatataaaataaatacaagtatatatgtggctcataacttccatgtgaactaagttaaaatgttctgattacatgccttctaatcagcgagtatcattgaagtgtttttaagtgtcatatatctttaaggatctgtgaaaatgagttctattataggtagatggtacactaaaaatttcttacaggttgtattaatacctctgtttgattagaagttagctatttttatatttatatatttactaatattcgaagtgggactttgccatggagctggcttagcttgtgttgtgactgtatttcttctcaactggctgtgatactgtcactgtatagtgatcttctccatagtgatcttcaactcgcaaatgattaaataatatttaaccttaatagggaaatgtctataccttatatcaagtcaatacattattccttttgcttagatttctgtttatttaaacataactctactaaactggtatcttagagatatatagcatctctttggaacatctgttggtcattgtgtatttaattcagcccaagaatcaattatagtaaatatttaattcaggcatctttaagctatacaacccatgaaacttaatgttacgcatttcgaaaccataatgatatgatggtgcccaccttcattggaacatttttcaccgctgcttctccagtgtattttcttaaaattaaaagcttctgcacattggaaagagaacttcccttggagccagagcattataatcacagctctgtcacattctagctttatgtctcggtgatatgatgtaaccctagttcagtttcctcatctataagatggcaataataatattgtcctgtgcttcacaaaagtgccaagaatattaaatgacataatgtacatatgcaaaaatactttataaacagtaaacacaatttaagtgtatattgattcagtagaattgctgctctcgtaacacagattgcagctgatctgagtaacattatcaaatagattctagtgtctcactgttaaatgtagcgtctggctttctacaagagaaatgcctggatataacatctcagtgatgagcttttcgaggccgagaatatcttagataatgctttggcagtgtacctcatcctgcctgctcccatcttaaaaagcccatgtcactttggtcactccatcgtaacccaggtagaaacagtgtgctttctgtagctcagctgtgttgtgacagggccttgcccacaaaccacactgttctttcatacctctagacattatcagaagtgagaaaatagggctcatttattttggtttatgttgagaggctagtcccatttgaagagtctgaacttactgtgcatgatccactgtgattcctgggaacagagtacgtggcatttatcatcagggcgcaccctcatagggagatgtatacctcctgcacattcttcagtgctgtcagttactgtggacctacacggaggcccaggttgtcacagttagtgctaaaaagattgaaacaaaagatgagaggtgtgatttgaaagaaggggaaacaggatgattttctgtgtattgtttagagagtataaaaatgaaaacattctggttgtcgtgcaccatgctaactttggaactggtctaaagttatcacaacaaaaataagcagtgtttgatttcagtttgtttgggtcttaccctatgccctaggaagcaactgatcttgctgcttccataagcagctttctcttctcacttcagtatcctttccaggcccccggctgtgtaaacagaaattcaagttgttctggttaacttgggaaaaacccctaagctgcatagtctttaggtgtgctccgctccagccccacgttcttaatttaaagagctctgctgcacggaagttaggctgctgcactgctatttccagagagatccaacagtatctgcctttctcttatttcggtccaggaggccaaacctgattttgtaccctctagtggtcaaggatatgggggaagaccccatcacaagagggcccacctgataagaaccctctggagactgctggcagagtcttcttaacaggacttggactgtgaccagataaaacatcttctataggtgcagaaactggccaatctggaaggtccaatggcttctacgttaaggttttcttaacaagatggtataccccgacttttacatggattgcttcttttaagtcctaaaagaagttgtatttcttcctccttatttgggccaccttgatctttagttgtttctgcctgccttttaaaatgacatttttatatttccaaaatgatttatgtgaataatgtccatgtacctgtagatgcatcttggattgtaggccctactatgacatgagaccacatttaaagttgaaaataaaatgtttccttcaacaactatccatgaagtgcttaatcaacccataacaaatgcttaacacaaggagtaagctctattactgagaaattgtgtcctctgcatgcagtggttctcagccaaaagtgactgtgtttactagtttggtgagatttctttttgtagaactagggcttggaagcctgagcaatcacctatttctttctagtatgttgaagaaatctgataggctcttttaacctttataaattacttgcacttcctaccctaagaaataaatgaaataaaataaaacaaaaatggaattctaagaaaagccttaaactgtggccaaatctgctttcacagcaattaagattgaggcagtatggagaggtaggagtcagccgacatgacagcatgtacctcatttttttaaaagaaagatggattaagatcagatttttttttattggaagctaaaagttataaagtaaaatacccaaagatttaattaaatcagtaagcatttgttgcatttttaaccagaattctttaatcatttcctgacagaatgactgtgtattagatctctgcctcattgaaattgtctaggccccctgcatctgttttgagcaagacttcagttgagttccatcttttcattcttttacagtctgtaaaggcctggtgagtcagcgcattgaaaatcagtcatcatcttctgtctatgagttcttagtggcccgtacattattttctcagatccctgcatcattacaatttccatgtgtttaagtctcttctttatgttttttaaaaaaacaagtgaagccagtttctcaaacaggaggtgctcacattctatttattctccaagtgtggagtttgtgcccagcatgtgaccgacaatacagaatgaaaagcacatgacaagccagggatttcagtgtcttgttagaaagtgaaatgaaagtggtattttattcctttgtggcttagagagtgctgtaatgcattgttacaggtataaactaacatttttagaagtacttcccctattcttgcccaggtcagctatgtcattggtaatacttggctgccttttctaccgctcccctttctaaatctcatgttacccatagtatacatgggccctttgtatgcctgcctaaatgacttcactgaagttttctgtaaatccctcaaacctcaaacttaagaacccaaactgtaatatcatgttattagcaggaccagctgtctgcgcgtcttttccagacactgggctcatccatttggatatggactcccacaaagctgacgagaccctctgggtgcaggagcgtctcctgaggaccaaggccttgaatgccttgttcacttctgcatccccaacacttaggatgacactcggggggccttgatctcaatgtgtgggaagaacaaatgcccccgttatagtactgtgttggcttgttttgcagtgagacttattctgagattaagagctgcatttagcttcttggccaccaggatcccagagtaaattacttttcaggactctaaatagtacgcaggagatttgaaagaactgatgcaatttctaaagcagcctgacttcctcccaggaggttactcccacaccaagcctctgacttcatgaccaccagatttagaaattgaagtatctatgtaagaagttgcctcctaggcagaaatcaagaaatccaactataacataggttagagtccattttggtttttatatccttccacagaggaaagaggaggaagaatctggagatgcgtttttggtttttggttttttgtttttttttttttccagaggctcatgtatatcctacatcatggtcagtttcagagcagggctgtgccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgtctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaagtgttaaacagagatgttcctaaggaggaccaggaatcctaaattacctaaataacccacttggttatctccactccttgatagcactgtgtgaggtatgatgcagtcaggtaaaggacaatttatctttgaagacaaagataaattcgagtccccattttcaagagtcagtgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtggaattgaaacaataccctgacccattgggcaatggagatcaaatggcattgatgcaggtaacatgcttaacacagggcctggtatgtagtgggcattcagtaagtggaagttacgattattattaggtatcaaagaacaaaacttaattgtcagaataagcaaaccagttggaataataaacgtagcctttagagttaaatggcacaaccctgatagccacacataaactgttttggttatttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcctataattccagcattttgggagactaaggcaggtagctagcttgaggccaggagttcaagaccagcctggccaacacaatgagaccccatctccacaaaaaaaaaaaaaaaaaaccctaaaaattatccaggcataatggtgcatactagtagtcctaactactcaggaggttaaagtaggaggatcacttgagcccagaagttcaaagagctatgattgcaccactacactccagcctgggcaacagagtgagaccctgtctcttgagaaaaagaaaaaagttattggttttcccattgcctccaaggcattcagagtggttgttctttctcataatatcattttataaatattcttttagacagtgatctcatacagttactgaaagagtatttacataaaccctgtatgctgtagctcagcatttgatctttgatatttcttctgtggttttgatacatcagttgaaattattctacataggtcagtatcattcagaaaacaccacacatcatagccaggtgctttaggtccacgctcagtctaagttcttcccatcattattctcgtgtgtggagagaggaagggaaggaaagaaggaatgaaggagagagggaaggaaagagggtgggagggaaagggaaggaaggagagagggggaaggaaggaaggaaggaaaggagggagggagggtgaaaaggagagaaggaaggacagagggagaaggaaggaaggtgagggagtgggaaggagagaggggaaaggaaggaaggagggagggaaggaggggaaaggagggaagaatgagggagagggcaggaagggggaagaaggaaggaaggaaggagggagtgggaaggaaggagggagaaaaggatgggaaagataaggaaggaaggagggtggggaaggagggagggggaaggaggaaagaaaggatggaggggacaggaaggagggatgagaaaggaaggagggagggggaaggaaagaaggagaaaaggagggagggaggaggagggaaggaaagagggagggaaggggaaggaagggagggagggggaaggaaggaagggaaaaatacagacaggaaggaaggggacaggaagggagggagagagggaggggagggacaggaaggaaaatataggcaggaaggaagggaaggacagggagggagagagggatagggaagggagggagaggaaggaagggagagagggagggacaggaaggaagggaggaaggaagggagagacaggaagagggagggagggacaggaaggaaggaaggaaaatacagacaggaagggaaaggaagggaaggaaggaaggaaatacaggaaggaaaaggaagacaggaagaaggaaaaggaagacaggaagaaggaaaaggaagatggaaggaaggaaggaaagaaaaaaaaaagaatatagacagtatagaccactgcttggccttgagtcagaagagttatggacaagatggaatgaggagttttacctcctgtctggtttctttgtacggtaacactgttactcaaattttattcagtgatattgcattgtatgggccaaggttcatgtaaaatataatcagtgatactgctctatcaaacattgcttcttttcataaagaattctcagcaaaacagactctaaatttgatggccaaaactaatgtcctcaatgcagtgtccaggctcagtctaagttcttcccatcattattctcatgtgtatggagagaggaaggaaagaaggaatgaaggagagagggaaggagggagggagggagggagggaaggggaaggaaggagagagggggaaggaaggaggacaggagggagggagggagggtaaaaaggagggaaggaaggatggagggagaaggaaggaaggtgagggagggggaagagagaggggaaaggaagttcagagtactacttaaattaggcatcattggatgattctgttcagccaatttgacacgtgcattttggataccttagtgaagtcgcctcttttaaggattccatattaatcaagaacttctatcatgagtttcttttgaaagcctccaaatgagtttttagcctaataactagtgtgccagaaaatttctgtggagcatctacaaacatagggaagtgcattttttaatagatactgaaaaattgatttctgattacaactagaactttccatgattacttaatgccccttgttgaaccttagacagcagtaatgagaaaaatgatagaagttgttgacaacataagagatgatgcatttaacactcgatctcagtttcttccttggacttgtttctaacaccctcccaatggattgagatttgtatctgtggagtaaaaattttacaatattaggccattattagtgccatttataaaggtgcatatgcttgagtattgtctgccctccttatccataaccacagattgaaaatatttttaaaaacatacaaatttcaaaatatagtataacaactatttacatagcatttacatcgtgttaggtattgcaagtaatctagagatggcctaaagtatacagggggatgtgagtaggtatatacaaatactacgctgttttatattagggacttggcacatgagcgtctttggattttggtatccatggggtcctagaaccagtctcccaagggacaattgtaattggtaagaagaaaatgtagagaccacagatctgtgagcatttctgtctgtgaccttcctctggaaaagctcagtctgaagcacaaactgggtcttcatagagaggcacttccagctgcctcagagcactcgctgcaaagcttcgggctgctcagagaaaatggctcctgatgccattatgggcttctcatcgtgccctgagatgtgctgggttctgtttcttgtgtctattcaatgaattctgacccttcaagagcttcccagatgctttccaggaagaaccctgggccctggggacgactgccttcctaaggaactttccttctagatatctgcctttgtagtttttcatgtttaagtgacaagtagtgagtggcgctgcttgtagaatctgaacacaaaatgtccccggattagtaggtgtcatccagttatcagtctcgtgctcacacccccgccaccgggtttcgatttgcccatctctgctttgctgctggatctgctggtccttggggcctcactctgaaccacattcttgtgtgctagagggaaatttctgtgtgtgaaatgtggccactagggagtcagtaagttcaggtacaccaggaaaaggcgttgagtcccagagaaaggaaccttcaaggagaagcttggaagagggaggaaatgagtgtgacaagggaccatgggaagaaggagcagaatgtttaaactgaaatccctgtatatactgtacagacaaatagctctttttttctcaaaaaccagttttctgggggaaaaaaatggattgccatgaaatgaagctgtttttaaagtagaaatgtccttgtaggtgagagaaatctacgcagcatccctggaaaatgaaggaagtggttatctcggtgctgactcccactcaagggttgcagaggaaacctgctagttccttgtgatgttgccattatcactccttaccattcccctgtattgtttacaaaacaggaacttcttgaatccatctctgtaaataaactcagctggactttttatcaatctctttatctctttctagatgacagtctaaggacacttatctaacaggtaccattccctgccggttgtggtagtgaccaccctgtgctagcctcagtggccacaagatgagagccctgagggtcctcctaaggaaatgaaagactagggaaacaaaagtttcaccaagttccagaagtcctaaagcatactgtgattatacaaagctatcccttgatctctcacgtctaataagatcgtgtgcgttgtcacatcagcgactccatcatgtgctgttcttttcactagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccaggtatctaagccaccatccttccatttgtcaagctgtaatgttgatttaagatgaaatcgaagcagagctcgacctgccccttctttcattcgttcacacggcccaagtagcgtgtcaggcccagttagcgcctccacccaaagaccctatgggtaacttggaaaactatgaccatcccgatgaggggcagattttggttccatgccagaattcctcgggttcttttcttctcatttgcattctctaaactttagtataaccaacctgttaatgacacctgccctattagactagcacagttttagtgcagtgttggactagcctagagaagatggtccaagatgggacccagaagggaagatgcttaaaagccattacactgtgaaaatatattagaaccaaagtggaagacctgcatttaaagaatatagttctggttcattctttttttacttcatcagttccagccagtacccataccatccacgcagccttctcccaagccctcagctgaactgcccatctctttccacacttaacgcaaccactgagtgtaccccagctggctgttgtgaatccccatgcctacatctttccccacgccccactctttgtgtctgctgcattatccctctcatagtttcaaacctaagtccttctcagctgcccagagcctcacctagcccttctcctagtttccatgcctgcatctcctgccaaacaattcctctttcccctgcgtctaatcccagaaatgtaagacctgagccctctccctggggactgacccctagacacacagatttcccggtggtatagaccacacagacccaagtgaaggctcactctaagatctcattgaggtcctcagcgagtcaggagcttttctgtcttacctcgattctcatgttttctcgcagcattatattagagaaccttgttgtattcaatacagggagctgggaaccatgccaattcacaagtgcatctgtactatgcagttgtaagatagggcagttgttaaacccaaagagtttaagtgagctctgcacatgttggccttttgtttaggcgttgtgcagactagccccaattgagcatttctaaaaatgtccatttatctcctaaaaaggataggatgttctgcaaggtaagggggtggaaccatttttcagagccttcagttgggttctctttatagttttccatatacacacttgctgtgtatatggaaaaagcaagtcttaagtgctttaaatgagaataagaaaaaatatatggttttccactggaattattttatctagtgtatattcacctatgtttcacaaatttcataccagtttccccagtaatatgcttttaatgatataaatgatgaaacttgaccttatttatttcacgaagagtcatttaatgccttttatgtgccaagcactgttctaggcactggggacacagcagtgaaccaaatagcagtgcacacggagcttacgttgtagtagggagaagccaggcagctaacaggtaaacagtaactaggtagccaccaagatggggatccggctctggagaaaggcatagcaagacagagaggctggggagaagtggggcaggcaggttgttttgtattatgtagaatggtcagggagcaccttaccaacaagatgagatttaatgaagagacccagaattgcagttctcatggggaacaggcagaacctctgggtatagccagcgccaaggccctggagtgggaacgtgctgtgcgtgttcaaggtagagcagtgttcaaggtgcatgttcaggaggagctgtgtggaggtaactcagtgagcatggaggaggtaagaggtggggcagagaggcagccacggccagacacaaagggtctcgcagatgagtgcaagattgtattgagtgagatgaaaccttggaaggtttggagcagggagcgacaggatctgacttacctttgaatgggatttctctggtgctgggttgaacatagactgtggggcatggaggtcaatagtgaaagcagagagaccaacttggagacttttttaagaatccgggcgagagatgacagtgacttggacagggtggtagccgtggaggtggggagaagtgggcaggttctgactatgccatatgagtcgcatcagtaggatttcaatgtatgcggggagtgagtggaagaggagccaaggatgactacgacattttggtttggggcatttttagcttgaaatagtcattcagcatcaaagtggagctaatgaatagacaaatatctaatctgggcttcaggaaagaaactgaaagtagatctacaaatttgaaagtttagccataggtggtttctagtctcaaggtttttaagccttgagactagatgagagcaccgaagggtaagaataaatagaaaagaaaagagagcgcaggaccgagccctgagaccttctgacttttggagactgagcaggtgcagagggcctagcaaaagaaatagagaaggagcaccaggaataaaggaagaagccaagagggtcagtgacatggaagccaggtggagaaagggtttctggtaggaaagagtaaactgctcaatcaagcgccactgttagccacgtaagatgcgatgtgggaacagacttgtgcacttagcactgctgtaatgaacttcacagaagtacagtggtggaggcaaagtctaatcagagtgatttcaagaaagaatgggagaggtgaattcaattcacctctcccattgcgagttatggttatgcaactctcatgcagaccataagtgccaagttcatgaataagacagactgtgaagttgagggtccttggagggtttcacagagaaaggacatgagctagattttaaaggacagatgtgctgtcttcattggagtgaagaggataacccaaccaagacctgagatgggaaaagtcaaggccggtgcctctaaggtcaaggccagtgcctctggagcagtgagttttagtagcagtaggtaaggacagaaacagtagctttggcaaggatttttcaggccttaattatcaaatgaagagtgtagattttgttctttatagggaatggggaggcttatttttgagcagctgaatgacatgttcacaaagatgttttggggtaacctttgtgtaacagggtggtgtgcaggaaggactaaagcagagagagaccagaggccaggacagctgtaacaggcactgcaaatgtcctcggtgtgataacaaggacccaaattcaggtagtggtggtagaaatagaggtcaattcattctccttggtttgtgagtttgataagagagagtacagatattgctaacatccttgttcatcattagagatttctccagtgacttctcagttaagatttactattgggttgaaatttaatttctgttaactctcctttctgcatctgctgtattcctgatgaaacatttttctatctttaagcaaatactgcaatcagttgagcttttgccaccttctgtttgatccagtatgggctgccaggaaggctgtattcctgtcccattcttgcatcggttcattgtgtgatcttagtcaagactcaccaccaaagtttcacgcttccatttctcatctggatagcacatgccacctcccagaaatgctgtgaggattataccatctcagaaatgatggtgtgggagcacttcccggtctgtccagcaaacaagaaccttgcttcttcctttagacatagcaactaacattctgaatatcctctttctttacaaaacagtttcacctttaccatctttggatatgagtacagaacctatgagctgttaggtgattagcacctgtctctttacagaagaaactgaggctcaggaaaggtaagagggttatccgaagtcatggagctggttagcagaggatgagacccctgctcctaaattgacctcaggttccatctcccaaaaaaatgctgacctcagcttgtaagcaccaagcacctcgccccgtattccagaagaggacattttaaggaaggcaactcttagagatgaccagatgcctctgaaagtaaaatatatccccagtaaattatcttgagttcctccaaagcgcaggtcaagtatgagcacaggagcgattgtgaccgtgtgcccgtgatcttcgtggtagggctggatgtagctttgtgtaaatctccctggcactgtccatctgtaatgccaacagctgtaaagggctcttctagtaaataccagaagggttatattttagagtcttgggttgaaggcggtctttggccatagaaggcggcctgggtctaggcgtggaaacaaatagcattcccacttctttttgtttcaacaagcagttttttaactgaaagaattgttctttttggcaaaactgctcagaggcagcttcccttttatgttcaaattaaagggaaatgactctcttcccttggacttgaggactgtgaactggagctgtgcgtgttctgtgataaagaaggaggtgtgggtggattttaatcagagctgaactgagtggtggagtgagctaatacacaggacaggttatgagctgctggaagtaagaagtggctgtcaggcatcactcatcaggagagacccatgggggccaggattggtctcactcaaaactgtatgcccaaaaccagtgcctgccatgtaggaagtgctcaggaaatatttgttgaacaaatggtaatacaattaatcactgaagaagacatcctccttcaccatagacagatccttctaactttccctgctgtttccaagtagagcccctgtgggaagaggactcactgtcatgcctcagcttggtggagtttcaccggaaatctacccatatgcagggtcaaggcaaaagaattccaaagttacgtctctccctctcactcaggaaaaaacctgaggtggaactgaatcaatcccagctctggggcctctgcagaaacttttactacttagccattgacatttacaggtttgttggaattggtgtcgcatttgccctttacactgaggcctcagaaaccagtggcagttcggcccctattgtcataggaaggctcagtgtgaagccctggactaggcaggggaggggcagaagggtgtgtgtggcactgaaaggtgtcaagtaaatggcgacatggcttttctgcccatattcacccaggaaattcataccacacatgagagtttttcagtgggtgcattaaataccatccccctgcacacacctcccggaatcacctagtccagacctaccgaatcaggacctgtgagagtcagcacattttctaagctctttgggtaattctgatatgatttttaaaaatttgagagtcactggtttgtgctcaggcccctgcacctgcaaatggtaatgttttcagtaacttctatttttaattctcgagtttgcagggatgcactgaacctgtagaaactataattgttcccagttctttttatgtttaaaggttttataatataactaagaaagcagaagactattcttggaggcaacaagataacttgggctttggaatcacagaactgcatttgaatcccagctctaccacttactagatgcatgattttgagcgatttaacttaacctctctgggtttctttccctggctgggtacccagttaactcatgggggaagcttagcaagtactctcttctctatcactttcctcttctctcaaagtcatcttaaggtttacttctcaaaagcctgttaactttgagacagaaaacaatcactctgagcagaggggattattaatcctattttaatttatatacttatactgtatattttatgttggtctaaattaggctatggtgagtatttaggatcctacgtgttgagtaattgctttataaaaaaatcagtgaataatatggcaggatctgcccgaaaggaaatacgtgcatgacacaaacttttattgtcacattttgaaaacaggttctgaagaattaattgctttaaaatgtggggctagttgtcgttagctggatgaagtataaatacaaagaaatatttgtaggagctgagaaaagttctgattttttttttttttaaaaagacctgatatttgagataaataatattcttctgtttgttttatgttgtagtataatacctatctgatcaaactggataatgtaaatatatttactgaagatcagcttctaatctaaatggttccagtggtaacataatggacatctgagacttatactcatgaggtctacctacagtccattcccatttaggggaagagaaaggagaggaaatggccaagaagtccataagaagtggacagtgctttaactttttcaagttttgctaacatattttatgtaagttattcaatacccccatattaaagagcagcagctattaaacaccaacatttattagctgctggaaagtaataaataacttcagctagtccccttcagtttccataaaattataaaaccaacaccatttgacgtgaaaaagcagtttttgaccctggtggagtagagaattctttcatcttttaaatgttataagacatgtttctcctcactgcaaagctcgtgattctctagcatgagtgatgaatgatgtaaatggcagaaactgcatctttcatgtcccaggaaatgtggtcttgaattgagtgcaccatttggattgagaatacaaaagccaacaatacagcagcttcatcatctcttaggaaaaatgttcccttcttttagaaatgtatgtcccagaaccaaccaatatacccattgagaagacaaaccatcgaggagaggttgacctggaggttcccctgtggcccacgcctagtgaaaatgatatcgtccatctccctagaggtaagcattgaaggcagctgagatctgctagttttctatgtggtctacttaggtgttttctaatttttaaaatttcctatgagtaacttttaaaatgacttgctgaagtaaattcaaataactattcccgggcagacctgcttggctgaaacatatttacaccacacattgataaaataagtcagcaggtaactggattaaatgcctccttcctggccctctgtgctcagagactttgtgatgacggaaataaatggaaataaatatgttcctagtcataagagcctggtatctggaacttctaagccatctctcaaacgtatgtatatataaactttgtaaggagagtaatcatgaattagtcactgtctcttgtagattccgcactgagcatttgtacattaggttaccctctacttctgggcagttttcacttcatgtgagctaaacttatcacctatgttgatttttctagtcaccaggtttactccatgcctttttatcttgctctatcctttcagtctgtgcgtaataaagatgttattttgtctcccaatagctgtcactatttccttttctataaaagtagacctcttcttgatcagtagtataaacttgctcttagccgtgactcagtactgcctcctgtgtcctccaaccatattttccaaatcattgctatataacttatatttcttttggaagaagcaatattcattgcttgagagagattaattgtctgttactctagatattctaaacgttatgcttggatcaaaccagatgaccagaaagtcaaattcctggacctagtgtttttggctctctgtataattgttctgagtgtgctttagcattatgcttacattcattcagtcagtaaatattagtgcctgctgtatgccagaccctgttctagaggctagacttcaacatactgtaagtacgactattcttatgactgaagacctgtgcattgcatagtatctatgttataaagcccctaaagagaaattttctcatgcatcaatagcaagaaaatgtatgcttctcctaggcaactgatttgttttaacctaaaagacattgtgaatcgtattaaagactgatagttgtttccgtttttggctttggctgctacaaagctcaaagctaactttgatggcttggttttagcacagaaacagaactggaagactgaattttgtaaacagacctcacttgcagcttcatttttctttcaccaagaccttccttaatttatatcttattcttcttgtatgacacatattcctaaaactgctttctatttgatttggaatatgggaaagtaaaattcattcttttattcattgtatatttaaaatctgaattcatcaataaaatgttactctttgacatttttcttgatgctggaaaatatgtttctataaagttttattgccatctgcactggctaaaatgattaggaatgttttctacctcccattcctccctgctcccaccacccctccagaacacacacagaagcatatcatttaaaatctgagttttaaaccacagtgttacataccacaaagctctgtcacttcatgagctgaatttccagaacaatttaagagtaactccttttgatactgtgtgtcatgtgtctttaactaaattgatttttaatgcatttagaaaacctgactacaatgatttatttgaaacaaaacagaatataaaaataaggaaactttagggagtgccccctattggtatgtgtttaaccttatttttgtctgcaacattcattgtaagagagatattttaaaagaacataaaggtcatcattcataagtgcaaaactaaatgtagtcacctatgcaatataattcattaaggcagaaaaatgatctaataggcctaagcaagattttcaacaagtttatgaaaagtaagacaatattgcttagagttcagtgaaccagagtatcaaccaaaagaccaacttcctgattgattagttttaatctaattagtcttagctattaacactaattaattaatagtaaaagaacatactttgttctagtctcctgtttgccaataaatcagctaatgtttctccttcgaaatctgagaagaccatgtatgttaacagtaatcaaaatattttcatggtctaattcactttttcaaaatctacctaagcaccttcttatttccttgattagctagagccggcatcatcttacccaattattaagattctcactctgatttttttttttttttttttttttttttaacattcatccctaagcgctctgctctctactaagagctctttggatcaacattagattttaatcacatttttagcctcaaaaaactgggaagcaataaaaccaagttgctgatctctatttgcaatgtcattaaaataatccttaacaattctggtttaggtaataaatgcttataattttttttctcctagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaaggtactgtcttgcaaaagttagtctcttgaatgatgaatctaggaaaacttacactcatattgaaattgcttgaaaccttgtgtcttaaccagtgaagtttttactttgctcttcatagcctcaaatccataccaggctatagtatgaatcaaatacatagtacttgcccagggctggactgatcacaaggtgaattatccattatccattggttaatgaagcctaaccttacatggatccagttttctcgatgtactctgaagttttcaaatgaacaaatactcctggatttattcctaaatcattgtttatattagacattaaaacgtgatcacctggcatttcttagtcatcagtcaacttagaattgggagagaaaaaaagtcccaaagggatggagataatactcaggagagggctggaagatcatgagggtatacaaaaggcaaaaggaacaggtcagtgcaccaaaggcaagcaccaagtggaaaggtcgcaaaagatgaagaggtggtggaaagtaatagtagacaaggtagggagaggcagatttcacactaagggagaaaagatgtatgtttgttttcagtacaaacataaagggcctctaaatctgcctattttgaaagacaagaaaaaactgtattaattaagggaaataaatcataatcccttccaactctaattctaccttttgccttgagttggtttattttaatcataaaccttaagaattggaaacagcctgaacaattatgtaatgtaatttaccatctggttaacccttccatgtaaaaattctgtcctgcggttatcctgcctccgatttttctttgaacaaatgtacattgggcacagcctctgtgctgggtcaggatacagttgccagtgtccaaagctgggaaacagacccgctcataaagtgtatggagtgactagcaacacacaggctggcccagcctatgatagtgttgtacagtctgagtggttagaagtcatccctttgtttttaaaatctgcctaccttccactcattcttcagcccccttgaaacacaaggtctgcacttcaaggatttgaaatcatttcaccagtcttttttttttttttttcagttccttcatctccctatttgacagtttcttgacatttcaccttaaaatacagtttgtcagtgtccctcataaaagtatagttggtactagaacaagatgtgataatctgcatacaggctatcaatcaatgaattgtgaaactgttatctcacctgagttaggtactaaatttctgttcatttgagataatgtaaagcaactaattttttgtggttttattcctcctctcattaaatagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgtttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcacacagtgtaacttgcaaaaagattccatctctgagatccgaaagacttttaaggttatcagtccaatgaacccctggtgtaacaagaagtcccgtgcttttgtcattaggcgggtctttcccaaggtatccttgcaaaaagaaaagtgtctcccagagtacagagaatagcgatgctgtttttagggagacaagaaacctacctgctgtcagaaacgtgctcatagctggtatcaaaattaacttgctacgcacaggaggactgtggtgggaaatcctacagtggttcgatgctgaagaagaaagactttaccgagcacgatcaggggaagcctaactgcaaagagactttttgagctgacaggaaaaaataaataggtatattttcatacattttagaagcatcaatttaagaatgagctataaacagaccaatgttgaatctcctttaaaaaaatatatccccctaaggactttctactatatcatataccctttaaagctacatttcttcagtacaaggcgtcatttttacaaattcaaattaatttaaattattaatattactgtgtaagtacatgtatctggggaaagggccagtaagttccaaataagaacattaataaaacaaggaaaccatctcgagtttctcatacccctagagatgatggctgaaatgccaagcaggcattaaacttcaaaccgcgcccctgcctttgcagtcatggtgtctcagttgctgagtggagtgaggaatatgttagccctgtttgttttgctcacaggtgtttaagtggaattgtgaaagccgcctgtagcaggtcctatatagactcttaattcattcatgtcgtctatgggaggggtctgcatggctgtttttgaaatgtctcacagccccagaaaaagagcaggacttacttctgtcattccacagcagctcagcatactctaataaacgtcctcctcttccccttcgtagcattctgggactaatcagggtttcatctgctcacatattgtagcgatgggttctgtgtggaattaagggaaagaatctagcactgtaaggaaaaaaaaaatacaacacaaaactcccaaatataaggctctcaaacatgtatttttacttcttaaaaaatttattaaatgccattgatttgactggaaccagcaaaagtgctcatgatattgatgaatccataagtagctgtatctagaattcatacttaagaaaaacacacaggcatgaataaaataggacacagtaatgagaatgggcagttctgcagtgtacactttctcaagcacctcagaggacacacacttaaagtacaattcttcacagacacatgaagcagaacatttgaaaatcaaaacttaaatacaagattctaaaagtgaatggcaatttaatggttaaaatttgaccagtggtgaaacaagcagcaagctacaaaatccatcaccaccaacagtttcaatgttagcactaagtattaaaccaaagtaatgcatattctggttttgcttcttcaagaacagcccgtttattctgtttcaatctctctgaacaatactggtaggtaatagttacactgacaattctcacaaaaaaacagtgttggttcttgccatcactgaatttatagtataaatctcccaaggctttaatctagttcatcagtgcagtttagataagaaagccataaaaacaaatgggcatactgtcagttaatgagaaatacaactgcacatgcacaattaatattactctctcttaatctactaagagaacagtttattagtagatttaacaaaaaccatctctagaattcaaaatagtgcccatatttccgttggttctataatataaagaattagtgtagtcaagatctgttaatactgaatcaaacccaagttcaaatgtgctgagtttccaatagcaagaagggtaatggtagccagctctcagaataatgctgtcggaaatctagctt

SEQ ID NO: 12782 - DNA, 16742 bp, Human
ctcgctttgtccagatcctccattctcttctctacacccacacccacatccaggtggaatatgggggcccgcatgcaaatgaaagacgagatccaaaagggctggtaaatgcatttcataaaaatcccaaatccatcttccccaggagctcaggcagggccagccgcgcaggctgtgtacgtgtttgtgtgtacgtgtttttcggtgtgtgtttcagtcccagtgtgttggcgcgtgttcgagtacagatacaccgggggtgtttgggtacccgcacatggctgcgggtggggcgcagtggagaggaagcccacacatgcgtgtgctgagatatggccgcatccttgtgctcccccagcccagacgcaggggagaccagcaccgagacacccgagctcgggagcccttcagcggcggccgggcggagcttggctccacgtggggctggagagcacgcaagcctggagtctcggcgctcgcttctcggctgccgccggcttttgtagaaccgagtggccggatggcagctcgcggggaggctcggccacccgcccggctcgcccggggcggggagaagaaggagagctggagagagaaccggccgcggcggtcggagaggcgagcggagtgcaagagaggcgagcgcccctgcccggcgcccgggcgcgctctccgccttccccgcccggctcgcctgctcgctggctccctccctctctccctcccccttcctccttggccctgcctcctccctcgatccccggctggatgactgaggcatttcagacgtgggctgaaccagagcgagcgagcgagctcaggggctgcagcgatctctcgataagccacctagaggcgactctgtgcgcgcgcgctccccagtggctcccgcccgccctctgatcatgttgacatattcacaggacaggcagtagtaccgatgcggcgctgcgacgttacagtttccgacaccttctttttataactcagctctatcccccagcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggtaagcagtgggggcctcctcccctaagctgttggagagttttttcctccctttatttctctgctcccagaacagtcggttggtcggttattacggcttggacgaaaagttagttcccctagaaatgtatgcacagacttccaggccctgccccggtggcaggaaatttcagcttacctgggcatctgcatgggtcttgcatttggtctgcatcctgggttccctcccgaacagacagaatttttcagtggagcacagacatccctgcagggagcaggaaagaaaaaaaaaaaaggcactctactgcaagaaactcactcttcaaaccctcctggaacatccttatttctttgttgatgttgtgttgtctgttttattttgttctcagagagaaaaacttaaagccctttccttttgtgtgggtattgggaggcctgacaccattccccggccctttctgccctccagtctagcctctgggtctaaaggggcctgctgctgccctggtcagagagaaatcgaagggcattttggtttgtttgcccacactacttcacgtgtctgtaacccaagggcgagttcagcaggcaattttgcataatttaagattatgtttgcagacttaaggagccagtgaggagacacacaccttttttttaatgtgtgaatattatcaaccatattttacataatgtttaaaggtccttgcctgaccaaaacctgcctggaagagaagatcctgtaatagtcatttaaaatcactgattttttttttgtaatagcattgaagcctgtaaaggcataaagttgatacaaaaataaaatccccttcatgatatcttaagcgttctgtctccttccaagctaaatgaggccaaagtttggcataaaatcctcctcaaactcacaagacatttagtcagttttccagcaaagtgcttccttgcttccttttaagtcaagactacagaatgccaacccttctgtgaaattaacagcaatgtggtggcacagtcttgcggttttggactggcctaagaagtgggggaatgtgttagcagctccacgggcagatcggttatcaggcccaggagtgcaccgaagtctgcaaaattcgttctgggaactcactgaagtccagtttcacttcgcccacagcgggattgctattctgcagcagggaggggtgcaacttgacgttcatttccttgataagtttaacattttctcatcaatgggtggtggaaaattctagtcttaactgaccgcgctttacaaaaatcttaccccaacctgtttagacctagatacccacagaaaaagacatgggcaagaatttgctctcaggagggcaatctgtaaagtcaagcaaggacaaaaaaaatattgaagaaattgttagacaatgtagagaattgcagtgccacaatgcatttgttttgaaccttgggacgtctaaatatggcgaaactgagaatatttaatacgttagttgtggaagaaaacgattttgcaaccagttgcctcactctgaaacatgtaagcttatcagtcacaatataaagtcttagacttggtttcaatattatgtgatacataggaaatcaaacccaagattacgggtggtttatctttctttttcttttctattctttcgttttataggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttgtaagtttcattgctctcttcagtaaaattttctcctccttcactcagtcaaaggcagtgcttcccatttcatgagtttcagcccagacttctcctttgcttctccctaagcatagcaaacttgtcctcgtctggaaaaaggattcggggtgtttctctccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatgaggcttagatcttcagaaaaaaatggtttgtgtgttgggagtgtatatatggattcagtgacagtgcttagaaacttagaaaactttcattgcttgtagatatcaggcaaaggaccttttgcgccttttcctacccctccccaacatttcaataaaataaacagcgtgataagcaaggagtaagcagaaagattaggcccaggaagacgcgaatggcgcggaaatatcttcagcgggcaggaattgcatttgaagcccttgatttgattaaggcataaatattcctctctagagttcagcctttcagggctttaagtggattgggctcgtcaattagtgggcgcttaaagtactgaatcattttgtaaattaaaatgcatgtttttctctatcttttaagactttggccttcccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatcgctgtgactgcataccagaatgataaggtaaactcaaggggctttcctttttaatggtgatattttgccttccccttaaaagctgctttaagtcaggatgagaaagttacaagagagtggagacgagagtcttgagttgtcttttgtgatttgtggagcatttggggggaaaggacaatgacacctcgaggagacagaaaaacaccttgactaggtaggaacaatgctgagcaaaaaaacgccatactaattttgccacagagaaactcctagaactgctgtcattgatgccacccactcctccccccctcttgggctttgtcctgtctgttttaaggttcatcttcttccccttggggaagaaggatcaagaagtcacattcaaaaggaaccagctaaaaatttaaggcaaaagccatttgggatcctgggaggagaatcctagtagagaccagcttttctcccctagccagaaatcctgagtagctggtctggtttttattaccttttatgctgctgtgttatgatgtgtgtgtgtgtgtgcatgtgtgtgcatgcatgcgtgtggttggaaaaacctaccctgatcacagggtcatattaatcgagttgtctgaggcttttgagttggggtggccaaagtcaccacttcatttgaattccccccctcccccaggcctgaatctggaggttagaaggatccccaaaagggaaagcacctgatatctagagctatggtggcctgaaggtcatgggcacagaaaaagtgacccttactgctgattcaccagttcccagattggctgttagcagttatggggtgggaggagggactgaagacccctgctctgcaatcctggacttcaaagagagtccattttacctgacaacacacttcattttgaactcactgtcattgtcactgtccttgggtcctctgtggacttcatgatggggatgttccagctaaatttctttagtgtgaataccaaaacatgatcttctctccctgtgaaacctgaagtcttcaatagagcaatttattccaagaacatgaatccaaccaagggtccccctttccacctctgagtaactctgtgtatataacttcttcttcccaccaaggggaagggatttgaaagattacacactatagcatttttctcaaagtgcaaaatgcatgtgccctctagacccagaatcctgtgaaatgaagttgttaatgtaataataaaatgtagcatttttgatcagacaaaaaggccatgggccttctccacctaatggccatggcagagcatataaatgaaaacagatgtttccagtggtcattcagtactgtaactgtcaatattgtaatttcctcaaaccaccccccaggcaaagaaaaaaaaaattaaactcactcccgcactcactcccgcacaagggtagtgaaaccccataaatcatttattggattcatggaaaaggagtgtgtgtgtgtgtgtgtgtgtgtgtgtgtgtgtgtgaagggagtatgctataatttatgattaattgcactgtataaaaatcaaaatgaaagcataattttaagatctacaggttttccctcttgatgactttgacaacacttccatgtctaaacccaaactgttggctgcccaaagaaaagaatttctttgaataatttcatccccaaatccctggtttggcctcatataggagatacaagccctgccacagtttccttattatctcctttccctggcatatctatatgacttctgttggcagtcacatctctagacttgttgagttgggaaaaacaccctcaaaacattctagaaaatgagaacaatgtctctgtcttgcttgtgtctcttccaatagataacccagttaaaaatagacaacaacccttttgcaaaaggtttccgggacactggaaatggccgaagagaaaaaaggtgagttgaaacaattatttattagatagtttagaaaaatccctttttttaggatccaactctgaagtgttagaagtgagatgcaggcacttatcctaagagcgggtggaaatcattcactttccccactgctacatgcttgccgctatcagtatacccaggacaagtacttttcctacctccttacctttaaggaaattaactaggctacaccatacttatctctggaagagaagcatcagggataatagattatacagggatgcctattaattcctaattaatttaagttcatcctaggcaggtcccagaaagaaccatgccattgagaaaatacttgggaatttttgcaatcctgtcttccaaataccatcagacagagctggggacttcggaaagatgtatggctctctccctccttcgtggggacatgtatcattttgcattacgtagacagctggagagtatatgaaagagggtctcccctcccccaccccctttcaaagaatttctaaaatccagaaaatcacccccaaatttttaacctatccccttggggcgggcattaaaaaataattgctaacagctaaatatatttttattccaattaatttgttagtaaaacgattacagtaaagtgcagcatgaaataaccacttcctcccaatcttagccaccatccaaaatttgggtatgctggggacagacagcgttgtgtttgcaggattggacacccggttctccctatataaggctggcagtccagctgtctctgactagatccagcctcttctcctgcttttaaataaaatttcacagcccaagcaaatgccttttcctaatgaaaccccatcttgaataaatgcaactgaagcctccttcctttctccctaaccctctgccacactcttcagcccagttagagggtcaaggacaaagcttgggtctatgtggctgccctggggcaagcagatttcagtgaattagcgttgtccctgggcagcaggcagggtgtgaggtatgtgtgtgccgctttggaaagggtaagggaaacaaagaggggaaatgtatgttacattctgtaacctgggtgtgggcttctgccacagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaaggtaaaccatgtcacctttgtgatcactggactccagtccctcgtggcctggaagagttgaagggggatggggcaccaaccagggcacttgccctttaaaagctagaagccttctaaacatccttaaacagaagccagagttcaaaaagggctatcaggtgtgtctccccttccccgctaaggcagtagaaggagagcacagaggcctttctcccagatccttatttggctggtggggaggggaggtgggtgtctgtttgcatactacctcttggcaagcagctttgaaaacttgcttgaagcgcttctctcttttctctctgtctctgtttctttctcctcccattctctccaaccaacagaggctccaactgctgacttttcactgtctttgaactctaggttacaatgtgttggactgggtgggggggaagcaagggactctgccacctggaaccgagaaggtggcctagaaaacatccagctataaagcaacaattgacctgggagaggaggtggagcactggggatctgcggtgggggtagagctgggggaggtgggtgaggagtggacaagatggctcaaatcccccctcagttacctgtgtttaaagagcaagcagtatttatttggaaagacacacacacacacacacacacacacacacacacacacacactctcaacgggaagaaacctgttttttagtgaaataaaatgcaagtcctttatgtcttcaatccatttaagctttaaacataaaataggatccctttttcttttcttctggtggaacacccacagagggtgtggtaaaagcgaaaaaagaatctatgatcgtccccgggctgtgagccatctgtccgacactcatctctctctgcagggactggggcaaatacaaacggttcaactgagtactggtgttgaaggacaggtgtccgttctgccattatcaattcagatgtcagggttcttgccaaacaaatccttccagagtaattcacaaatttgtggaaggtgctgctctctgtcattcactgattttttgatagtaattagaatatgttccagctgtgagttttaatgttactttttacttttaaaaagttaatttgcaatcgaatggggaaatgcatgtgaaatctgccactgtaggaactcaaaaaaagaagtaaaattcattaaaataagaagagctactgattaggggattgtccatctaagggaaagtttaaactctgggtaaatactttaaattcataatcgcttattgaattttccagcaatgttgttgggcacgattatccccattttgcagatgacaacactgaggtgcagagaggctaaggggctttccccgggattacacagccactaagccacgagctgggattccaacttgggaactggagttccgttggctcatactggagataacgcccttctgccttggttttttccttcgcctgtggtagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcaggtatggatccttcttcctgcctccaccagtctttccacctttcgtccagtttccctgtcctttgccagcagaccctcacccgatccctttggcctagtagctgtaataatttttactgagccattaccgggttcaaggcttagctcatggagttattatgacttcattctccccattcaccccaaaaatctttaaaatttttccgaagttaaaggctgtttccagcagagtagataggtagtaacaaagataacagctggacacagcacttactttcaggcattcttctaagtgcttgctctgtattgactcatttgacctaacccttcaggggtactattatcacctccactttacagatgaaggcgaagacgcccagagatgttgagtgacttgtccaaggtcacacagcgggtacatggtggagctgagactcaaccccaggctatctgactccagggcctctttgagggtttctgattttagcttcagagctgacatgtctcttaagtgtctcatagccaacccttccccaggaatgggactctaggcctggggaggggaagtgactacttcctgagtaggagttcagtcttgattcctccagcctttcctcccagttcgaagctcttctccccacccccaaccccaggcaggccagcctattcctcgaagggttaatggtttgtgcacacgtgggaaatgtcagaggacagggataagcagggactggggcaggcctggaggcctgtgtgtggctcagacagctgtgctggggggaggtctcaggcggctggaaacaccctgaactcgatgaaaaggttctatgaggttttgcatgctgttgccttttgttttgtctgagcacattcgtctggtctcccttccctgcgccaagaaaccagattggcctccccactccagggaggagggagctgaggaaaggcttggcttctggcatttctcaattcctcccatctcctctgctggcttctccgggagaccctgtcctaggtgggcaggtggttggtacaccaaggactacctgaacagacaaaaccttaagggcacctcaaggcatgatgcagagaactggcccaggccagggtgcctgcatcttaaatgctgcttctgccaattcccagcttagtgcactcctgaactcctgcggcctacctcggcttctcacctggaacaccagtgaatcatgctggacgatttctttgtctctgtttataacaaatgccctttttccctcccccagccccagtttccttttgcttaagatcttcactgtctgttttttttgttttgttttgttttgtttggagaaacttctaggattggggtgggaggatgggggttggggaagaagaaagatttaaaaaattattcctactaatttatgtcctccggcttccccttggttacctctgtggggtaaactgaatctgtatccccatttaacaggtgcaaggagatttcctgggggctgcacacactgtgtgcagcatattgcaggctttcactcatttaatatctacaaagtcctcaataagtatatgaattacttatgatttccctgttttttcttcctataaggaagctgaggcacaagttaatcaaagtctcttggcctagggtgacacagctaagatttgtacctagagatttctgagtgttgacttctctcctgcccccacctatctccccccccaaaaaaaaaaacacaacaacaacaacaacagaacataccagggattcatggcttgcccaatgttggagggggagaagagaggagagggatgagataagctcctcccacccggctgactcgctgtgtgtctcttttctcaccccagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttgggccttgtgttaaatgttttttctttgggaacctttcctgaagatggacagtcaggggagggtttagtatcttcttgttctgagtttacccccttcccttcgcctttaaataattaagaccgcccccagcgaaccaaaatgagatgtcactcaagttacaaagctaaaaacaaaagtcccttacttgagcgaagggagccacttcaatctgaaattacttttcctttaaattagggagcaaagcagggagacggaaaggggcctgatgagaatacagaaagaagggtaatttcagatacttttaagttttaatggaaaaagactgatgtgctccctaagtcaggttttcccacccgaatccgaccaaaagtaagctcggcaagtacgaatgtttttcgttttaagctcgccctcagttttgacatcaatctggcgaatccaagtcgaaaataccttcttgcaccagtgtgtttggctcggggaaaaggccagcagaatgccccagcagtccgagcgggcttggctaggcagcaaccctccaggttgtagaagtggacaagacgcaacgcctttccactcggcaaccccccacacagcctgcagtccctggtgcctcaaattgaacccggctggcccaaggcgcccctacgaggccccatccatcccgagttgtgcgtgcaaagcgcggccagctccgcgaaaacttagctgtgtcacgcgagggaggagggaaattatccccgaaaggggaaaggtaattccagggtgcacatttcaccccctccacggcaaaagtcacccaggaggctgacatcctcccctagtctccccttcaaacccgtctccaggctgttcggggagttgccttttgaagttcaatttatctttgaaacattcaataaaaaatgatgaggcactgtcagtcttttggtctcccgacccccagcctcgcctccgaggtgtgtgtctgttggggggcgggggcggcacgggaaggttcgagggttagtccttagcccttttcttgccctgggggccatgacgtgaagacccagctggagcctgcctggcggctgcctccctccccaccccccacccgccaccccctggagcccgccagcccggccccaagtccctgtcaccttcaggcctcttgaatgaccggagaggaggacgccccctcccttccctcatcctgtacttggaagggatcgaggtcgagaccttttggagagcggggcaaagccccttccatctctggccaggcacgtggggacccctacagcctcctctgcgatgtctccgggggtgggagggaagacagacaaccagagtatgttggtgcggagtcgcggggggggggagggtcggggtgcgctgcgggggtggcagggcctgagctgagacgggccctggggacctttgaggctggggctcccccgaggactgggagatttccagggcgcgctccttctgcgcagcggctacagcctgaagggggcagctctggatccagcgacaacgcgcggtgtccgcgcctctgagaaggtggtagttggctggttgcgctctcccgaattggggaaaaaagaactcagcctccaaaagggaagaaatgctttgcttttctcttctttctcagtccaaatttgcttacctcctcccttctctccccccgcccccg

SEQ ID NO: 12783 - DNA, 15564 bp, Human
aatggtttctttgtcctacggctcgcattgaacccggcccgacgccctgggtggtgatatcttctctgaaaccgggcccgcaaacccggagcaccccccctccccgctcttcggtgtggcttccgaacgcaatggcgccatttcatcgaggggaaggctgagcgcctttaatgaggtgcgcaggactctaaagatccaagctcacaaaacactccaaatccacctcgaaacgatatgaaaacagcccgagaagaaaaaaaaatagttaaccacttctacttcttgatagagaaagcacactaagaaaataaaagagttataaggaaaacgctgagaggaaggcgagccatgaaaatggcggccgccaaatccggttcccgggagagagggggaggggaagctccgcagcctcgctcacgaggacctgctgcccgccgaaacgctcgccgaggagacgccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacctccatcgcggactcagtcgcttcagcccgatttcccgcagccgagcgagatgagagagatctccgcggacgaacacgaaccggactcgtcctggcgctgtagtgagaactgccgctgctcgagaaacaactctgcgaggagcacctccgcacgggacccggcgctgctgctactgccgctagagccgctgccgccgcttttctagaaccttcccccccactaacgcgtcttccgctacgtcaggccgtcgcgtaaacgccctatccgccgccaatggcgggaaggctctacgccccaccttacgccaaatgcgtactcctcccacccttgcggccagagacagtacccgacgttacttccgtaaatgcgctcaatgaattgcggaaggctagagtcctgctagttactacctcttggaatagggtcccgccccctgccttggcgcaaggcaggtgagaaacgtcgcgcagtttgaaattaacgccgacgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccggcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacggtaagtgccgcggtcgtcggcgcctccgccctccccctagggccccaattcccagcgggcgcggcgcgcggcccctccccccgccgcgcgcgcgcccgctgccccgcccttcgtggccgcccggcgtgggcggtgccacccctccccccggcggccccgcgcgcagctcccggctccctcccccttcggatgtggcttgagctgtaggcgcggagggccggagacgctgcagacccgcgacccggagcagctcggaggcggtgaagtcggtggctttccttctctctagctctcgctcgctggtggtgcttcagatgccacacgcgtcccgggggcccggttctccgctcccctcccctccccttctcgccggaccccgcgccgggagctgcgggaaggagtggagggtcgggcggtggcctcgcggctggcctggcgcgcggccagcgccggtagttagtggggggactgctctgccctcgagggggtagggagctgtggcgacggttgccccatttcgagacaaagcgcatttccccctcccctcccccacccgcgttccggcggaggcgccccctcccccagccgccacgcggggctgggtcgagacttgggcctcccggagggcggcgcgtggtcccgcgtccgcgaggcctggcggcgcgcggccggctgtcccgaggctgcggcgaccgcccagttaacgtggccgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcctctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataaaaaatggcctccaacaaaactacattggtaagttaatgaaaacctaaaatatgtaaggatttaactcaagttttttttccccacagtataactttgcatctctgtggctgagaaatttacatccacatatttcccagctctcccagtgtaaattacaggggaaaattaagagaaaaacgaattcattacagggagatactggcttggcttaatagtgtcttaactagttcaaagaaggctaatctttgaaggacagtgcaatgtggattttgctgaggatttttatcttcaaatagaaatacacacatttttgcagcgttgaaaaatgttacataaaatggtaaagcccttgttggttggcataatttttcttaaatccccagaattctggagaagtattttcattaaagcccaatttaaagaacaaggtaccttgtgcacctaggttggagcaaaagtcattgaatctttcaaattactttggtcactttatcttgttttaacttactctaaaacatagaagaatattaagtttaattcattgcagtgttttgttttttaaacaaaatgatcgaaatcgcaaatatgagccagaagggagaaaaggctagattttttttttatcttattcagccatgtcatgttacaagtttttttaaaccctggaatattcacataaaaatcatgaaattcaaagttacagttttcacaatatttaacattgcattaatcttaaacacgtaaaggtgaatgttaatgtctcctaggtaaaataaagcatttgtttttggcttgtatgtgctctctctgggtttcacactaaaaagggcacgttagtgatttttaatttgtgccatcattagattctgcattaagtctgtttaccctgcattagattctgcattagattctgtttaccctggaaaacagaagttgtttttgcacgcaattgatagcctttggggtctgttattgtatttagtttattttgtgaaggatcacaggttggccactttaaaagttcttaactttccattttaaaaattcattagtgttgtgagatatgtgtgctgttaatttcacttaaataatgggaaatttattttgactcatccacttttggaaaaaagtgctgggttaaggcaaatatatactataaaagaaaatagtgagcatttgaaactagcttatgaatgccatagtagtgaatgaatactgtatggcattttgtctgcctttttttttttgtaaaccttagtgtgtatccttttcattttctgtatttattgttgactttattttgttagccttctccctttgtggcagtagctgttttgtttttcatgtagtataggtatctgatacacttctgtctattacagtttgtctttgctcctcccaccattattcctaccttcttgtactgtacagtggcagaaagctgtttgggcccagtactcaagtatcttgactaatgagaatcataacacctgacttagaaatggtatccaaaaacgtcaggtgtttgctgcatgtttttgtatttcaggggatttttattttgtgtgtgtgtatgtgttacctatatgcttgcatagcttgaaatgcccttttgcagtcttgaggcctttcttacatatctgtctgcacacttcatatgcctgcatagcttgaaatgtccttctgtagccttgaggtgttcttaacttttttctgcttgctgctttacttgtgggatggctttaatgattgagcaattaaggtttatcttttttaaatagtatttgggttttttgtttttgtgtttttttgagacagagtttttctcttgttgtccaggctagagtgcaatggcgtgatcttggctcaccgcaacttaagcctcctgggttcaagcagttctcctgcctcagcctcccaagtagctgggattacaggcatgcaccactatgcctggctaattttgtatttttagtagaaacggggtttctccatgttggtcaggctggtctcaaactcctgacctcagatgatctgcccacctcggcctcccaaagtgctgggattacaggcatgagccactgcccccggcaatagcatttgctttaagatgaaatgttaagatggattccttctcagcccataggatcttctgattaaccatttcagggttttttttcccccatttttaatcctctcataaaaattttccccatttttagtcctctcataggaaatcttgagccattggaaagagctggttcacgttggtttcctgcttctcttaaatagtgtcataccaaagaaaatgcctgtttaaagtgaatttggttaccagtatagactttctcttgagaaaccaggaaggaaggatttttttcaccttagggaattaaaataaatttgtaatgttggtctcttgaagtgatagctttatagttttgttctaagtggtaggaaatattatctacagagattatggaaaaataatcttgtcctttaattgaacctcctagtggtctctatagttgaccctgcagttggtatcaggattttgaaccatgttttcattctgcatttatcttttctctgtatcattgatgcttttgacattaatatttgaattgagaagggggctggggcttttaccatctgggggtggatacaaggtctgtcataggttcacctaagacctgtcactactacttgcttctctgtatcaccctttaggtacttcctgcatagttgtttgttgcagtgttgttaaaatgagtgaaaattagtaaacttggtcttttaagactacagggccgggcgcagtggctcacgcctgtaatgccagcactttgggaggcccaggctggtgaatcacttcaggtcaggagtttgagaccagcctggtcaacatggtgaaaccctgtttctaataaaaacacaaaaaaaattagcccggcatggtggcatccgcctataatcccagctactctggaggctgaggcatgagaactgcttgaacctggggaggcggaggttgcagtgagctgagatcacgccactgcactccagcctgggcgacaagagtgtgagaccctgtctcaaaaaaaaagactggaaaaaaataactgtttccagatagtgtttttttattgtattattttggtggtgggtcgtaagtttgaactaaatgaacaagataaagcattcttttattttattgtctgttgacttttaatctttccagaaggtgtctgccctgggatatagaagtaaaaatttatgtcgaatgtgataataatataagcaattgagccttgaaaatgtgctcaaaattcaagaggaatatttcttaatttctcttttgttttattttagcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagagtaagaaactttagtgcatctttactatatgtttaactgcagctaagtggttttagaatttgtttttaacctggctcttttacctgctttcctgtaggtgtctttaaatgtaaagacactttgaattttaggtgtctcatttgaggtctatttcaaaagaaccaagactttattgtacagttgaaggtgagcagactagagactagtttattaccctggggagtcaaatttataaaattatggagtgtagtttactatgtaatatattttaatgtggttagatattacactaattagaataatctgcattattttcctccacacagagggtgctaaaaacattgaagctttacaatatagactagtgggtctcatacaggattacatataatctaggctttatactaggtttattatatccttatacctaagaagtagaacctgggcatgttttaagctctctggttccttgtgttctttgatatggattgctctcattattcttgataatgttattcacaaaatgtgaataacttgaacatgcaacaattacatactttaacgcttggggtttgttgtgcttatctgctttgattcttcccccttacaccacaaagctccataggcagtgacaattaaaaatggataggtggagatcaatttcctgagcacgctggagatggagcatatgatagtcgaatgattgggcttcacctatctgttatctcctacttcccctgctcttcacatttaattcatagcagtttgggaattatgaattgaatgggagatttacgtttgcctgttttatccttcagtattcttagtttaaattaagtatgtgtcgtaagtcccttctttattaagcccatgaaacatgaaaaattatttttacccatcaaaacattaggaaatgaatgggctcctccctcttctcccaaaacttaaggccactagcatgattatagcgtacttcccatgtgcagtgtaacaggtaatgtaaaagacttttttttgttttgttttgagatggagtctcaccctgttgcccaggctggagtgcagtggcgtgatctcagctcactgcaacctctgccttccgagttgaggcgattttcctgcctcagcctcctgagtagctgggactacaggcgcctgccactatgcccggctaatttttgtattttagcagagaccgggtttcaccatgttggtcaggctgatcccaaactcctgacctcaagtgatccacctgccttggcctcccaaagtgctgggattacaggtgtgagccaccgtgccaggccaaagaagactttaatgaaaataatactacagagcagagacttttattgtcctctacccagtaatttgggtttactaatttggagtctcagggtagcaaattagaatatagggcctgggtgcagtggctcacacctgtaattccagcactttgggggtccaaggctggaggatcacttgacaccaggaattcaagaccagcctggccaacaaaatgagaccccttctctattaaaaaaaaaaaaaaagtgtgtgttttaagttagctgggcatggtggtgcatgcctgtagtcccagctacttgggctgaggtggaggatcgcttgagtcgggagttggaatcttcagtgagctatgattccactactgcactctcgtctgggcaacaaagcaagaccctgtctctggcggaggcaggctggggggtggggtaatgtagggaaggaggaaatgattagtatctgcagtacagaggactttttattcccccgggtgtctattaaaatagatctggataatggtgatgaatcatatttaattcaatcaccttttttttttttaataaactaaacacagtgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgtaagtataaaatattgcccaccagcttgtccttttgtaaaaggttgatggcttgatttcttttttgtttgtttgtttttttgagatggagtcttgctcttgtcgcccaggctggagtgcaatggcatgatcttggtcactgcaactgccgcctcctgggttcaagcgattctcctgcctgagcctcccaagtagctgggattataggtgcccaccaccacgcccagctaattttggtacttttagtagagatgggggttttgccatgttggccaggctggtcttgaactcctgacctcatgatcctcccgcctcggcctcccaaagtgttgggattgtaggcatgagccaccacgcctggccttttttttttttttttttttttttttttttttttcctgggagacagagtctccctctgtcacccaggctggagtgtagtggtgcagtttcggctcactgcaacctccgcctccagagtagctgggattacaagcgtgtaccaccacacccagctggtttttgtatatttagtagagacggggtttcaccatgttggccagactgatctcaaactcctgacatcaggtgatccacccgcctcggcctcccagagtgctgggattacaggcgtgaaccaccacaccaagcccacctttgacgacttgcttttttaaaattcagatacttttataaaaggcctcttaatcgtattttaaatattttaatacttaggacaataaggatgggcgtggtttagcctactttgtgtaaatgtgcagtaagtgctcatgccacttaggttgtgctagtgcaatttttcttagtttcatggatttgatccctgatcagaccaattacctgtgatccaaggctagcaatcttaaatacaaacaatactaagattggattatcgaaagcctttgcactacagtaagaacaacgcaaatagaactttctgattatagtccatcaatggcattgaccaccgaaaagtacttgcatgtcatctttgtattgccaaacaataccttgattttgaagtctgtaatctttgataatagttaaacacttttcttggcatgaattgagacattcagttcattcactatacatgtgttttggtccagtctttgctttacttatgtctctgtggcgtcaggcaaatcaggtaacttcttacttacacccttgattgtaaaacagattatacttgtcttgcctactgacctagtgtggcaatttggggaaacatcttggtgctgaattaggttctaggctcaggcactaaacatgatttaaaacttgatcatttgaactagaagccaagtacaaccttcaagacaactctgtataaggtcataggtataatcactattttacagatgaggaaacgagattgactacaaatttggttttgaaaataaatcacatgctcaacagaagcagttttggccaggcacggtggctcgcacctataatcccagcaccttgggaaaccaaagcaggaacatcgcttgagcccaggagttggaggccagtttgggcaacatagtgagaccccatctctacaaagaaaaaaaaaagaatcagcaagacgtggtggacacctcctgtagtctcagctacttgggaggctgaggcagaaggattgcttgagcctgggagttcaaggtgcagtgagctgtgatcatgccagtgcactttggcctaggcaacggagcaagaccttgtctcaaaaaattattaaataataaatcaggcacaactttaacaacacttattgagtccttagcatgtgctatactgtgtgccaaattatttgcttttaatgtgctgtgaaatatctgtgcagtagatactaaaattctgttttattaacctaaaccacaaagaggttaattaacttgcccaaagccacacagctcgtaagtggggtaggtccatcattctcacccaggcagtgtgactccagagcttgtgacattgatgtaaaactctgacaggaataaaggatttattgatatcattggttctcaaactttttttggtctcagggcctctttatactctaaaaaaattattgaggatccccagagagcttttgtttatatgggttataattatcaatactaacagtagaaattaaaacaaatttctaaaatgacttttctaaaaaagctgagaagagtagcattttacatttttacagatattcaacatgtgtcttaaggcaattttacttaaacacatttgattgctgtggcggatcattttggtggaggtatatgaagacaatccaaagtcacaaatagatgaaaaaagggggccttacacaaccccctcccaaaaaggactctggaatccccagtgaatccgtagaccacattttgagagccactggtttatattaagtactttctagcgcagggggtccaatcttttggcagccctgggccacattaggagaattgtcgagggctacacataaaatagacttaataccaaccatagctgatgagctaaaaaaaaaaaaaaaaaaaatcgcaagaaagtttcaatgttttaagaaagtttacaaatttgtgttgggcctccaaagccatcctgggccacaggttacacaagtttgttctaacatttactatcatttagaatgattacagatagttggtatgagttttaacatttttaatatttcttaccgtttgtgttttgtttatgcttttaaaatgtgtcagtaattcagactaattcctggaagtcatttgaaatatattaactttcaagactttattattaccagaaataaagaggttagtttttctgtatgcccacacaactctgactttggtgtcattgaacgcagtaattttcttgactttttattctgaatgttttcagaaattttaagtattctacgttgagtatcaaactcaggtttttctgcttgtaaagttaatggaaatcagatgtttttaattaccaaatatgggttcttgctctagtcatttccatctcactattggaatgtttttatttaaaatacgccatgaaaacaatttaatactctgagtttgctgtatgaaaaaatgtcttctaaacaggctgacaaaccaagaggatttgccagaggtcttgatcctgaaagaataattggtgccacagacagcagtggagaattgatgtttctcatgaaatggtgagtatgcagagattgttacatttgaaagtaagagtagctttttttttttaatttgtgaaatggtttttcatcattaggtagggaaaaactatctgctgagaggatgattctggttacttttactagtagtgttttaaagcaagggtcagcaaactgtggcctgttttgaaaatgaagtttattagaacatagcaacaagtaacataactctcctggagcacttcaataccttttgtttggactattatttcttaaatgaatggctgtcggttgacatgaacaacttcgacttgtaactgaatttttctttttcttaaaacaggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaattattagacttttttctttatttgatatgcctttacagtagaaatagaaatgcccacactcattggattatctttgtttataagttagatgataccagtaaggcattacagtacatatcctagatcttttgagcttacgagttttaaacttgaatatgtatttccacaggaatgtttccacagttgggaaataaaagtttcatgtgatgcctagggtcaattgtctcattaaaatgaggttttaaattctggtttgttgtaactgtcttctaaagaatgtaaagtattctgatagggctcagtgtgatgatagacacattttaattgatttccaaaatccatacagaaaaaggtaaataactgatgtttattaagtacctccttatatatatatatatatacccaccactgctctcagcggtgggttcacagatgatagagaaccttctattcatattagtagttggtggccctacattcaattttactaagggcatttctgaaaacaatatattgtcctttggccatgcatggtggcacacacctgtaatcccaaaatttggggaggccaacgcaggaagattacttgaatcccagaagtttgagatcagcccgggcaacagtgagacccccacctctacaagaaattttaaaattagctgggtgtggtggcttgcacctgtagtccttgctacttgggaaggtcccttaagcctaggagtttaaggttacagtgagctctatgtcaataccactgtgctccagcctggatgacagactgtttctcaaaaaatttgaaaaatattgtttttttatattctctagtgtttgtattagtttcttattggtgctttaacaaattaccacaaatttaacccatttatggctgaaaatagttctgtaggtcagaagtccaaaattaagcaagctgaagtcaggttatcaggggaattccttctggaggctttgatggcagaatctttccttctctcttccatttcaaaaggccacgtatattctttggttcctggccctttccatcttcagaatcagcaagcagtggagcatcttgcatcatctttctcgcccttcctctcttcctctttccatctctcctgtctaccacggtgtattatggaaggattgagccaaaccattcattcaaattcttgaattcctggagcttagatctttagctgaagagaaaaccctttttctatcatttctaccctctgatgtttatgtaataggcttcttgtaacaactcagatgctacagaagtaaggccacctcatcaatttccttgcttcaaacccgaagttcaattgatacccatatctctggatttcaagaccagcctggccaacataacaaaaccccctctctactaaaaatacaaaaattagccaggcatgggggtgtgttcctgtaatctcagctgctgtggaggctgaggcaggagaattgcttgaacccagggagcgggggttgcagtgagacaagattgcaccattgcactccatcctgggcgacgagtgaaactcaaaaaaaatagtttttaacaaaaaatatatttgcaatttatatttcacccagttgttatcttgggtcatcttacttaataaatacactaaaatatactctattctagcatagctgctagccactccagagaggttacctgggttggaatctgctatttgattctgaacaaattaatgtacttcacctctctgtgtctgagtttcctcatctgttattcatgggctcctataagggtgaaatgtatgcatgtgagacagaacagtgtcttgtgtttgtttagtaatcaagatattttatatctttttaaatagggacatagtagggtatcatatggcagctccccaacttaaccaattgctgggtatgagtactcaggtggttggtagtttcctactattagactaatgtagtgaggccgggcgaggtgtctcacgcctgtaatccca

SEQ ID NO: 12784 - DNA, 17050 bp, Human
  misc_feature (1)...(17050): n = A,T,C or G
ccagatccctctccacttgaacagttgctactctttcctcaagacctgcgtcaactgttacctcctttaggaagccttctgtctcctggtcaagggacatggcccctctgctgggccccacagctccacattactgattatgtggccattgaggttctttgttttgttttgttttttgaagcagggtctcactctgtcactcagactggagtgcagtggcacgatcatggcccactgcagcctcaacctaccaggctcaagcaatcctcctgcctcagcctcccgagtagctgggaatacaggcacatgccaccattcctgactaattttttaatttttaattttagaggtggggtttcaccatgttgcccaggctggtgtcgaacccccgggctcaagcaatccacccacctcagcttcccaaagtgctgggattacaggcatgaggtaccatgcctggcagcttctgagtcttaaccccaatggattagactttctggaggccctgtttccctatcaccaccccaacctggtctttaggagtcaggagttagtccagggcttgctggggagttggcgcagtgactgagcagcccccatcttcctaccagggcgtgggtttgcccagatgtacaggtggtcccctagctatgccctcccgttagccctcttctccactgtccttagtagcatagtcactgccctctgcttccatggccctggcaggtctgtctgatggctaggagtcctttgctggagggtctgtcccctgcccacataggtggttgtcccagcttttcagagttcccttggcttatcactgggcctgcttcaaaaccctttacttgggaccatcctgggcaccaggccctcagggcctccagagagggcatctgagactcatagagaatcagcttgaagctggacaatcactttttgttgaaataaaaactgctaacgtttgtggggcactttattgtgtgtgccaggctctgttttgaggatttctaaacactggcctccttaatgcccagaacagcaccccgaagtgatgattaatcatcccttttctgtaagtgggaacagggagactccagagtttggtaacctgttcaggttccctaccagtagcgggtggtcagcctcaaagcccaggctgaaagccatccagcatgagggctgaggaccccagcaggcaccagagggtctttggagaggtcacaggttgtcaagtgggtgagaacagggcggggcaagttcaggaccagccagggcctgggtgttcaggcagtgggagagtggatgctggcaccagtgccatgctgggatctgcaggcagcttcagccacagccttccggggctgatttctgggcatggaagtgagaaccaaaagctggggcagggagcaccctggagggatagccggggagcaggtagagggccaaaacctggagtgggggcaggaggtgctccagcagcaactcccccagaggtgggtcccaacctccacgtcggccaattccaggtggccccaccgggtttcccccacccctttgtcccgcggagcccctccctcatgagtgctgagcccaagggccaggctgtccccaggggcggagagttgcgggcccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcaggtaaacggcttggggcggcgccggcggcgagggcgctgcacggagggaagcgcggcgccggaggggttaaccgcgggaggaggggggcttctgccggcgggaggggggtcccagccccggcggccgcccgctccgcccctgccgcctccgcggcccagtcggcaccggcgaggccgtgctggaacccgggcctcagccgcagccgcagcggggccgacagtaagtgcggtgcgggctccggtgcgcgggcaggactcaggggcagggacgccccaggggcgactggccgggcggggtgcccacctctcgcgcgtgggcgcctccgggagtggtgtggccgccggtcccgccgcccgccacgctccgaggcgtcgctgtgcggacgcgggggaggcggtgggagcgagctgcgggcgctgcgcggtggccctgctgtctggcgtgtgcacgctagtgtccacacacgtgtgcgtgggctctgggtgccctggcgcggccggcacgcccatgggggccggggatgccggggcgtctgcggagagtgcaggtggggtgcgtgcgtgcagcggggcggcgcggcgctgcagcctcgggatggagcgtgggcgcgcgggtctttgtgcccgcgcttggcggcgcgtgccggggcgtgtgtgcgcgtgggcgccgccgcccgctgtctcggactgacagctgtctcgggggctgccgccccggtgtggcctttgcggacccccgccccgctttttccgggaactgggcgtccccagcacccctcctcgcctgggtgcggcggccgggacccgcccctgggttcctcgaaagcccggcggggcgcgggggcaccctggagggccagccaggaagcagggcgaggcgagaggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccccgcacccccaccaagctccacacatttcctcgctcgccccgcttccccctaggcaggcttaggctctctttcggcctcccactcgccttcctttcccttctcggtgccctcctctctttcctcacccggtagtcccagacaggggctgagggccgggcagcggaggtaaggggaaggctggagataggagggggactgggtgtgtccagccagagggatgtctgtggacagtgcagctgggggctttatggatctttgggtgtgtaggggatagaggaggagggtgtgggtgtcaggccagctcagtgaccccagcatccctggttttgcccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggtgcgtgggtgggccgcagccccttcagctgtcacccatcacccctggcgctagctgtgtgccagtgaggccctgtgccagtgctgctttcagatcagtatccctgaggacgggtgcagtgggaggctgtgggacagaggctggggaccaggtctctgtgttttcaatagggcaactgtggggtcatttgttttcctggagagcctggcacaggactgtgcacctataatgtctccttcagggtgtgatggtggtgggatgagggggaaatgaatgaatgaatgaatgaatggccatagcgcatgggctatgttacatttgcacaggtctcactcaccggtctagattgccacacaaaatccaagactctcatttaaacatgaattacagttaaactgcaaatgcctttttttttgagacggagtctccctgtgtcacccaggctggagtgcagtggtgtgatctcagctcacagcaacctccgcctcccagactcaagtgattctcctgcctcagcctcccaagcagctggtattacagggattcatcaccacacccggctaaattttgtgtttttagtagagatggggtttcaccatgttggccaggctggtctcaaactcctgacctcaagtgatccacccgcctcggcctcccaaagtgctgggattgcagacatgagccaccacacctggcccacaaatgcctttttaatacaagtccatcccaagcaatatttttgtttgctaaatctggcaaccctacctacaccggttcccatacttttcttggagtcatgtgccttagaaaagcccaagaacatggtgaacacaccccctccccctggaaaagtgtgcatatgaacatgtgcaggtgatttgggagggttccaggatccatgccaccaggaatgccaggtcaggtgccccttcccccagcatgcatgcttaccatgtggggagaagggggggtgcgtcagggttccctgaggcacttctggtcagactccaaccatagactcaagaaagtgttggccgggcacggtggcttatgcctgtaatcctagcactttggaaggctgaggtgggtggatcacctgaggtcaggagttcaagaccagcctggccaatgtggcaaaaccccatctctactaaaaatacaaaaattagccgggtgtggtggtgcatgcctgtggtcccagctactcgggaggctgaggcaggagaatcgcttgaacccaggaggcagagattgcagtgagccaagatcacaccactgcactcactccagcccagcctggatgatcggtctcaaaaaaaaaaaaaaaaaaaaaagaaagtgttgggctgcagccttctgggatacagtcaggcaggcacgtctgttactttttctgatttcggagtcactgtcatacaaaaaaattaagatttagctttaataaattaatgtctattatttgaaattgaagagtaccctttgttccctgcctgttctttgtggagagaggggccattggcacggaggcctcagtgttccagcagattctcaaggcagcaggactcagggcagagatgagtgtggggtggggttgggacacagaccacccgacagcatctctgacacttacagaatgccagtggaggctcagagaggcgtgggaagaatgtatctggccagaccacagggcagagagagggagggagggagggagggaatctgacctagtttgtcttcacaatggaattgcttttttcctggataagaaaaaggaagaaaaggagaggcaggacctagaagggtgggtgacagccgctttatttctcttccacagtaggattcactccctgaattagttgtgcagcaactgtgcacctactgtgtgctaggtgctgtagtgttatatgccaaggggatattggagtggatcagacacagggtctgccttggagggtgtcacatctaggcaaggggagagatccatggtcagacagatcactgtaggattcagtggaaaggaagtttccctctttctgttaagcaccaattgtgctagaccttgagctaggggctggggacaaggatggagatgtcaggggcctgagggatgacctggtgattgaaatacaccaggcgagaggggtagagagtagagacgaggggcaagagatgcccatgtggagagacagcatgggcaaaggcgtggaagctggaaagttccggagcattttgcagaacctggagttagcagatgcctagtcatttgaagcaaaaattagaacacacaggatgacaaaggatttttcccttaagtcgtgaatttattggaaaagtgttgcaaaatacacattaaatcacttttaattagctatttcgcttcttgcttttattaacagttattacaggaaatggaatcatctcagaaaatctggggggaaggttgctgtaacatggggtgccaaattggagtcccagggagaagactaggggaaggggggtggggaccagtttgaaaaaaggaatgctggtctggggtgtttaggcctgcaaggagtggggagccatggagggtgttgagcagccactttaggaagattagtttggactaagtcttgctaatgaggacttcagtcagggggcgaagaggtgctttatgatacgccccacagacaccattctggtaccttgacactgctgcttggggaagagtctctctgacttcctctcacctagggcaagcactctcaaaatagtccctgcccatgggacctgcatgctggcgagagggggagacacccaaatagggacattacattcatttaataatatgtattggctggtccgaatacagtagtgtttacaactaattgatcacaaccagttacagatttcttggtcccttctccactcccactgcttcacttgactagccttaaaataataataatacttattgagaggtgctcaatcaatatgatttacactgcagcacagggtttggcttgggcttcctcaggggtgggatgtgtgtgtttttgtgtgtgcgtataaacctcctaaaaattgggagcaaaattttgtggcatataaaccttcctggagagaaagtccctagctttcttgagattttctaaggaaagggactcaaattcagcttccataggtgcaatgggagtggtggggttggaaagctggaaacacagggtgtggtcactgcttgggaacttactcaacagtcagtgcttactttgttgcacgttcacaaaaaatctgggaggcagatgctgtcactatccttcccacttgagacatgcagaagctgaggccagagagttcacttgctcaagtcccatagcaccaacatttgaacccaggcagtctggtcccagggtctgtgctcctgaccatggtaaaagtggaaatttgttgtctgaagttaggggccagatactgaaaatgtttctcaaacattgtagaagtcaaacaaactcacctgcaggtagactggacccagtttgtatcttctgctgtaagggactgcctcctgggagaccaaagggaaggggagaacagggaggagcagggaaggagccaccctagagactggaggggccacgagttgccctagacaggagggaagaactgaagctcctccttctgcaccttgtcctgcaggaggtggctgatgccctgggagggggtgcggacccagaaaccaactcgaccagcaacagcagccactcagcctgggacctgggcagcgccttctttttctcagggaccatcatcaccaccatcggtgggggaggggattggcatgtggggggcggcaaggagcttcctcatgggggaaggtgcagggagacggaggggtcccaggtggcccctagacttcctgcatcgcccctctgcccaggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttggtgagctgctccatgccctgcctgcccttgtgctgggctccggctacccttccccatgtccctggcacatgagcgcgcccccaaagaccataagcctctcccacaggctcctgggggcgggagtggggagtatgggagtggggattgttggtgtctcctgggtcctgcctactgccccatcccgcagaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggtgaggccgcccttcttgtgctgcactttcccatctactttattcctgatcaggggctctgcactcctgcctttccctccagatcccatgtggttgctctaacccctgcatccatcatggaatgcaccatcacagccttgcacacacaccagcgccttatgcacactcacattcttatatgcttgagtcccatgcatgctcacacatatattaaatgcacccctcgcatgtgtcacattcttgcacgggagcgccccttcttgcatgcttttatcttgcacactttcaactcatgcacaccactcattttcctgcctgcactcacacactcaagcacatacccattgccctagggagggcaggtcctctccaggaactgggaggggggcactgaaccagagctcacaggcttgccccacaatccaattctttctaccttccctggtggtatcccaggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagaggtaggcgccccagggttggcactgtgcctgcgcactgtggtgcaaatgtgctgttccctagcagggggttgatcaggctgtctcctatccagggcgtgggctcctgaggcaggggctgagtgagcctctgtgtgtgccccgcagggaacagaggggtataagtttgtgggtaccttcaccacctcttccttcatgggtaggattgccggatttagcaaataaaaatgcagaaagccagcacaggcaacatggtgagatcccgcctctagaaaaggcacaaaaattagccctgcgtggtggtgtgtgcctgtagtcccagctactcgggaggctgagatgggaggatcgcttgagccaggggaggtcgaggcagcagtgggtcatgattgcaccactgcactccagcctgggtgacagagtaagccctggtctcaaacaaacaaacattaacaacaacaacaaaaacaaaactcagttaaatttgaattccaaataaataaaattttattatggcggggggcagtggctcatgcttgtaatccgagcattttgggaggctgaggcgggtggatcacgaggtcaggagttcgagaccagcctggccaacacagtgaaaccccgtctctactaaaaatacaaaaattacctggacgtggtggcgggcgcctgtaatccaagctacttggagggctgaggcaggagaatcgcttgaaccggggaggcagaggttgcagtgagctgaaatcacaccactgcaccccagccgggatgacagagctagacttgtctcaaaaaaagaagaaaaaaaaaaaaaaaaaaaaagcatgtcccaaatattgcacgagatatatttatactaaaattttatttgttgtttctctgaaattcacatttagccaggcgatttgtattttgccaccctgctgggagcacccagtggaggagcccttccatccttggggctggctgaggctggaggaccaggcagaaaagagggttggggtttgatccctgctggtgaaggggcaggttcccggggggtcgcggagggggtctagacctctagtcgagggctgctttccctctccgtgcagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtaagacgtctccctaggccccttaccctgtccgctccaacccacccttggtccgactcgggcccctggcgctatttcttactcagccttggctgcccgcagcccccacccaaccccacgttctacgggatccccaacccggcccggctcagttccccagcccgctcttccttcccgctccagccatccgcgacccttggctccctccttgtatgtggcccacaggtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccggtcagtgtggcctcgccaggccgtgggcacccgcagggcaataagctggccagggactcaatttctggagctgtaaaatggggggaagctgatgggatccaagtttctaggattctctgggagaggcgcccgcgccaatctttcgccctttaaatccgccaggcattcttggagcgccccctcccgggcaggcgttgtaacaggcctttcggtcgtgacgcgcagagtccggggaaggacgcaccaaataaattgcgcaaagaccccgtggtaggacctgcggggtttttttgtttcgtttgttttgttttgttttgtttttgagacaggatctcactctgtcgcccaggctggatggagtgcagtggtgcgattatagctcactgcagttcaagtgatcctcccgcctcccacttttttttttttttttttttttgagacggagtctcgctgtgtcgcccagactggagtgcaatggcacgatctctgctcgctgcaacctccgcctcccgagtagctgggattacaggcgcgcgccaccacgtgcggctaatttttgtatttttagtagagacggagtttcaccatgttggccaggctggtctcgaactcctgacctcaagtgatccgccggcctcggcctcccaaagtgctggaattacaggcttgagtcactgcgcccggcctttgttttttagagatgacgtcctgctttgtcacccaggctggagtgcagtgttgtgatcatagctcactacagcctcaaactcctaggctcaaggtatcctccaacctcagccacccccaccaccccgagctgggaggacaggccggcaccatcctgctcagctaattttttattttttgtagagaaaatttcgacatgttgccccagctggtctcaaactcctgggctcaagtgatcctcctgcttcggcttcccaaagtattgggattacaagtgtgagccaccatgcccggcgagacctgtgtttttaatggaatcatcccaccagttgcaagagttaactccttgtcttatgatttgcgctggttgaggaggtgtacgtctttccattagtcagttgctggttacaatttctaagcccctactacgtgctgggcactgtctggcaccccctcaaactacttcatcagagagtaagaaccaataacagtataacaatggttacatattgagcacttgctgtgtgccaggcacggggcttcccctggattgtcaccttcaaacttcacaacctccataaagagctatttattttttatttatttatttttattatattttttgagacggggtctcactctgtcgcccaggctggagtgcagtggtgccatctcggctcactgcaagctctgcctcccaggttcacaccattctcctgcctcagcctctggagtggctgggactacaggcgcctgccagcacgcccggctaattttttgtatttttagtagagacagcgtttcaccttgttagccaggatggtctcaatctcctgacctcgtgatccgcccacctcggcctcccaaagtgctgggattacaggcgtgagccaaccgcgctcggctatttatttttgagtcagattctcactctgttgcccatgctggagtgcaatggtgcgatcttggctcactgcaacttccgcctccctggttcaagcaattctcctgcctcagcctcctgagtagctgggattacaggtgcctgccactatgcctggctaatttttgtatttttagtagagacggtgtttcaccatattggccaggctggtcttgaactcctgatcttgtgatctgcccaccttggcctcccgaagtgcctggattacaggcgtgagccaccacttggccaagagccaagagctgttctttttttttttttttttttagtttttttttgagacagagtctcacttcttcacccaggctggagtgcagatgtacgatctcggctcagtgcaagctccgcctccctggttcaagtgattctcctgcctcagcctcccgagtagctgggattacaggcacttgccagcaagcccggctaatttttgtatttttagtagagacgggggtttcaccatgttggccaggttggtctcgaactcctgaccttgtgatccgcccacattggcctcccaaagtgctaggattacaggcatgagccaccgtgcccggccaagagctgttcttattaccccattttactgatgaagaacttgagggtcagagagtgtcagtcactggtcctaagtgtcacactgtggggcagtcattactggaaccatgtgggtggggctctaaagcccagggttgtaacctctgtcccatgctgaccccaaggctgcaccaggagctggtctctgaaggccattccctctcacaaggtgcctacccatctcctgtgctccagggaaggcccaggagtctgcggatgactaacccttttttctcttctcccagaaaagtcttcctcaatgtcatcactcaatattgcgaagcacatgccccatcgagcctactgggcagagcagcagagcagggttggaggggctggggagactgggcgtttcggtggggtaggggataggcaaattgggggttgataggatatgaaagttgggggtggttggcagggtggaggggcaggcaggctggttgggggtttgggggccacagggaggaggtgggggcatttcagctgtgggcagagatgaagtacctggacgcctaagcctcttgctgcttctccagctgccactgcccctgatggaactcatggagaatgaagctctggaaatcctcaccaaagccctccggagtaagctccccgccaacccccaagaactcccacgacagattctggtggattttgcagggctggggcccaggggggtggggtttcagggtgccttatgtcttgtcagatgcccttggcactcacaagtattccaagggccccataaaagttaaaagctgagggactgggcacaggaagacccagtgggggacatgtggtgatgggcagaggcctgggctccaggctgagtgcagcccctctccagctgagggaggcttttctgtggctgtttctccacctgcacagtgggatgaccgccttggtgtggcctcgactgcctctggttggggagttgtgaggagcctttggacagtggattatgtgggtgaacttttgctgctggggtaggaaagcccagcggtgataaagggccagctgatggcttagagtgggtggctggtccagaaggtgggcaaactgctcgctaccaccgccctagttcaggcctgcaacctcttccctagccttgacctcatccatcctccaccttaacactcagcacccttagagatgcaaagttccccaggctaacacagacctgagtgccctgcgctactgctacctcgaatcatctgcggttcctcgaatcacacatgcggcgccccctggtggggagacctttcggttgctcactgccctgagccgagctctgccctcctcctaggctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatggtccgtgagtcagtgcaggacagcccgcgtgaggcggacgcacgtggccccgcccttccccgtgaccttcattcggtcaccgcagtgaccttcattcggtcaccgcagtgaccttgagctttctccgtccgggccctatcggccctaccttccgggactcgcaatccaggacttattgcatgttttaagtcggcttcacccaccccgagttccgcagctctgtggggctactgggtctacggttcgagtgctcagttggtgtcgctttgggggaagggggtagggggaacggggcagcacctccctcctcgcgacggcgcgctaggctccgcccctcaagcataggtagcaggtccagcctctccgctcgtcccgcccttgcgttttcatctgtaagtggtctcttggctccgcgactgcagcctgcaccgcctcgcccactcctctcgcgcgcagcaagccccgcctcctccgttacgaaagagcgcttctggccccacttgctctcggctctattgtccccgccctccgcgtctccggccccgcccctcccaggggccgcgtacgcatgtgcgccgcagtggctcggcgggctgcggggcgggacctgcacgaaggcccgcccactggcgctgccggctccgccccgactcgtccgggcgcgcaggcgccgcccgccccgctggtctgattagcataggaccccgggccccgccccctgctttgcatgcgcacggacgggcccaccccccgctgtcctctggaggaaaccgattttgaagcgtgcgccatatctctttgtgttctacaatcacttcgcggcgccccccatctatgggatcccgctcggtggggtggttcggccctacgatgctgctgaagtaggggcctccccggcccccggtttcatccctggcattccggggcgctcctgccttcattcccttcctcaacatctctgtcgggacccccctgtctcggtgggcgaaaaggcaacccctcctcctggtgttggctttgcagggccctggggtcaattcttcatatcctctctggaacgcctgcgtgtgccgggcttcattaccggcttcctaatcctgtgggaccctcacagggcccccgccttggtatcacgttccaaagcttcttactcgatctggggtctcannnnnnnnnnnnnnnnnnnnttgactcaagcgcggcatccggtccatccccagtggtgtaagaccggacgcggcgacggtgcggggcggcgctggccctgaggtaggcggcggtaagaggggccgcccgcggcccccggctcactccggcactccgggccgctcggcctccatgcctgcccgaccgcgctgccggagccccaggtccgggggcggatgggagcgctgccgcgggggtgggcgggcggggcgcgggggccatgtgcgagcgcggcagggaggcgggcggggcgggctgcaggcggggtccgactctggggccagtccgggccacggttgggacccagtcgagggtcggactggtcagggttcaggcgggatccggcgtccgagtcctggtgggccggcctggggcaggatctggctctggctgcgggtcctgactcgggtcagggttgggcctccgatccagcccgctccggggcagggttcaatcccgcatttgccgaagtccctggggctggccggggtggaagacggggagggctctatgtctgggaaggggctctgaagaccacgtgggggcgctcgaaggggcctggggccaccctcctctctgggtcaaaggtcatcgcaccggcaggggagaacttcctcctccttggctctccccacttacttcctgataacctggtagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgc

SEQ ID NO: 12785 - DNA, 6021 bp, Human
cagactcacccagggtgagggcgccaggcttagggtagaacagagcttgagactccgcttcaccacttaagcagcgcggtgacatggggaactcacctaaccttcccgagccttcgtttcctactctgcaaaatggagataacaagtctgcattttattatgtaactacgtcctaaggtacaaattaaagggcatactattggtattattttagagaaatattttcactgtgtcacccaggctggagtgcagtggtgcgatcacggctcactgcagtctcgaccttctgggctcaagcgatcctcccgcctcagcctcctgagtagctgggactacaggcagcacacgccaccgtgcccagctaatttatgttttgttttgtatagacagggtcttgttatattgcccaggcgtctcgaactcccggactcaagcgatccgcccgccttggcctcgcactgcgctgggattaccggcttaagccaccgcgcccggccagataatattatttttatgttgctggttttttgttgttgttgtttgtttttgagatggagtctcgctctctcgccaaggctggagtgtggtggcgcgatcttggctcactgcaagctctgccttccgggttcacgccattcacctgcctcagcctccagagtagctgggactactacaggtgcccgccaccacccccgactaatttttttgtatttttagtagagacggggtttcaccgtgttagccaggatggcctcgatttcctgacctcgtgatctgcccgcctcggcctcccaatgtgctgggattacaggcgtgagccaccgcgcccggcctgttttgttttttgagatggaggccctctctgtcgcccagtctggagtgcaatggcgctatctcgactgactgcaacctccgtctcccaggttccagaaattctcctgcctcagtctcccgagtagctgagattacaggcgcccactaccacgcccggctaacttctctcttttttttatttttagtaaagacgggggttcaccatgttggccaggctggtctcgagctcctgacctcaggtttaattgttataccccccgggcccttaacaaagctgtagtggccaggctaacctgggcaacatagtaagaccctggtctctacacaaaatacaaaaattagccggacgtggtggggcagggcctgtggtcccagctacttgggaggctgaggtgggaggctcacctgagcccagagagccgtgatcgtaccactgcactccaggctgagcaagagtgagacgcaatctcaaggggaggtggggggaaggaagctgcagtgatctctgcatggattggtcgtgtgtctgatttctttttattgtttgtttgtttgtttatttatttatttatttatttatttatttatttatttgagacggactctcactctgtcgcccaggctggagtgtagtggcgcgatctcggctcactgcaacttctgcctcccgggttcaagagattctcctgcctcagcctcctgagtagctcggattgcaggcgcgcgccaccacgcccggctaatttttgtatttcgagtagagacggcgtttcaccacgttggtcaggctgctctcgaactcctgacctcgtaatccgcctgcctcagactcccaaactgatgggattaaaggcgtgagccaccgcgtccggccgttcgtgtctgatttctatatgtgctgccgaagcgagcactcgtgtctaatttttgatttccccacaccacgcacgctggactagatcaccggctgggcaaggaagggggtctgcgtccctgcggggtcctggcagctcccgcgccaggactttgttgaatgaatgactgaactgagcgggcgccgcggggcggggcgtcccgaagcggacctcaaggcgggcggaggcgagagctccgccccggaaggcgggggcgggggcggggcggcggccgtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggtacgcgggactccggggtcggggaaccccgggccggggctcgggagccggactgggtgtctggagaacagcgccgaactgggggaacaggcggatgtggggatctggggtcaggtggccttcaaacagctcgctcccggctgtgggaagttccatcactctccaagcttcattcacaatccgggcctcagtttctcccaccgtccaattggggttgggggggtcttcagttccacaagtccgaagtacttcgaatggagagagaaagtgagtgagggcgggatgtttagtctaggaaggggcacgcccccagcctggtccgtacagggtctaactagccccagtgatcgacgagttggggaggccgtcgagaggcactagggtctgtgccctctataccatgtggggtgcccccttccatccggtgacttcagtgcccagctatgcggggggagggactggggtcgggcccggtgcccaggagtgagtcacccgccggcggcaggggggttgtggggacctgaccccccccacccccagcgtcccgcgctacgccctccctcccggagctgccgtgtcccggtcgggccgtgcggtcacctgtgaggaatgcgcggggagggcgccggtgactcacgttattcgagccggccgaccctgacctcagaccccagaatagccgagtcccgcccccagcctctgacccgaggccccctccccaggcaccgccccctgctcccgcggcagctcctggagcgcggacctggacaagtgcatggactgcgcgtcttgcagggcgcgaccgcacagcgacttctgcctgggctgtgagtggggggcagggccagtggccagcggaccccagactgggagggagggtggctggtgcgcagagcggggccgagagctttgcatctgggaaatcaatcgggaggaggtgggagctgggagggggctccggtcagggaggaggccacgtttgggagaaggcagaaggctcagtcttagggggcggggctggcctggagaggggcgaggtctgactccgagtcccgcccccaggcgctgcagcacctcctgcccccttccggctgctttggcccatccttgggggcgctctgagcctgaccttcgtgctggggctgctttctggctttttggtctggagacgatgccgcaggagagagaagttcaccagtaagtgtgccctggcctgcccagccctgtcagcactcgaccttttctctgctgctgacgaccccacctcttatcttgcagcccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaatggtttggagaggcagtgatccccgactgactcccctgagctggagggagggagtgagtcagccagccgcgggggcgggggtgaggctctgactcacacattctcaatgcctggaactcagccggcaaggacctggctggccctaacagttttccagggaagatcttgaggagaaaccccagcatcccgcgcctctgccctctccaccatccccaaaagccccaggttccagactgaagccttcctttgctcagcaatctttattcagttcttcttgggggtgggatgcctcccttcccatgctcccacccctcccatcccagaactccgttgggctcagtgtcctctgttgagggaaggtcttggtgcccagatgcctactctgcaggagagggaggaaccttgtccctttgcgggagtcgctggtctcttctgttgtggggaagaaggaaggtgggaggggcactgtccaccagcactcagagctccattatgtccccagctggggttgcagggtaggggggactgggggtgtcccccagcctcagcagacggagggcctcagggatgaggctgccaggatagcgccagagaagcagctcagagcaagggctcctagaagaggaaatgactgtcagggcatggagctgaggctggcctagctgagcacctcccaccaggtccaggtccccaggggctcctgggttcccagcactttccaaagagccaagatgggaaacaacccagaggtcagctagagctaaaaatggcacgatgaggcagggcctgaggtcagctgtgaggaccgcctgtgattctgcagaaggcctggccagtggaggaacctacctgagtgggggcagggctggggagaaggtcatgggggggctgcagtaggggtggtcattgtgcaggctgagttgagagaagtgggtggccatgttctcctcagacagaaactgcttgcgcagaggctccctggggagagatggcagagaggcaggctgggatactgacacaggaggcagcctgttggggaccagaggtgacagagatcttgttgggagtccctccctgcccccaaactcactgctcctcctccaggcgccgcttggtgctcatgggcacagctcctcggagaggggagctgggaaaaaaagagagcctggtgcaccccaccctcttggccccttcccaaggatctgcccgcctaagcctgcagcatcagccaggagccccaagcccattcctgtctcagctggtgccggtccccgctctcctggaccatccagcagggtacctcggaagtctcgaccctcagccgcagccccagtcccatctcagctcacgcctaagccccgccgattcgccccaccccgtattcatcctgcagaccagtcctgagcacccagccaaagctcctgcggcccttggtcaggcccaccctggtcccctacacgcacctggcgtccaggccccaagtcacccccaaggcggcccgcgggaggcgctgggcccctccctgggggcctcgctgcaagggctgctgcaggatcattgggttttggggtcctgcgggtgggatctgggcgacaggggaggagtctctgagggcgtggccaagagaggatgggcgtggctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcaggtgagacggacgtgg

SEQ ID NO: 12786 - DNA, 35678 bp, Human
gtaaatatctgttggaacatagccatgtcccttagtttatgttttatatatggctgcttttgccctataatgacacaattgagtggccacgacagtctgtatggcctgcagagcctaagatatttgctctctggccctttacagaaaaagtgccttgacctgtgctctagagccatatgtaccaggtttgaaactcagcctcacagctgggtgtgatggcacgcatctgtagtcccagctactctggaggctgaggtgagaggatcacttgagtccagaaggtcgaggtcaagattgtagtgagccatgatggcatcaccgcactccagcctgagtgacagagagagaccctgactcaaaaaaaaaaaaacaaaaaaaaaaaacaccctcaccacttatcagctatttgtcttgagaatagtgacataacccctcagaacctatttcctaatctgttaaatgaggctgatgacgtttcctccttttactggcaatttaaacatgatggataataaatgctaagcacttaacacagggcctagaagatattaactgctcaataaatggtagcttcttaacagtattcaaacccatgtgctcttatcacatgcattgttgtccctgtgtccagttggtggaatgggaaaaggctcccttgtaaccccatctaccatctttatcagactttcctgccatggttcacagtaagagatagaagctgcacggtgacttctggctctttacaatggtgagcggtgtgtgcctggtaagggagagctgatgtcactgccccaaatccagtagtgagatctgagtgttctggtttcctccagcagccttgctttttcctttacaatcctgcaggcagggagacaagggctttctacatggtaggctctggtttggtcatcgtcacaactgggggctgttcaggtgggctcccattccagatacctaggcttatcaatcccttttggcaccccaggcctttttctccctcatgccccatttttcagtttgaaaagcatggttatcacaggacaagtagaagaagctccactgtccactgaggccaatggatggtgttctgcatgtgaacactcagtgaatagtgagtgaatgagagtaacctgggctccatcctatttgcagagagctttggaaaagatttttctccttaaagagccagaatgaagcctggtagtgggagagctccagctctagagtcacatgagcctacatttaaattccagccctgccactgactccctttttgaccttgagtgagttacctaatctctctgtacctcacttttcttgtctgtagagtgggaataattcctgtctcagagaaataaaagagtgcatatagtgtttgccacatggagacacatcaggtgtaggttaatactctgggccttgtttccttatttgcaacacagccctgccctggagtggaagtggcacctcccattggtcagctcttgaggctgtccccaggacaggcagagggagggaatgaatgggagccctagtgccaggacagaacagatggcagctcagagctaggatggctctctggacctgtctctcctaccagaggtccccccgtctggtgtggctcttcctggacctggcatcctctgctttttttttttttccacctccaagcagaattactgtcctgtaggcagctcctctgcttgaggacatctggggccagatatgttcacactctatcctgccttgcccttccctgagctcaggatggacgctcaattggtcccagttattgtctgcagcgcctgcctgcagcctcgatccagcccagctccaccccttgcctgcaaggtctgtttcctaacagctgctccaaccacacacctcggttctgcgggagcccctcctcttcctccctccctccctcattcaggggtgggactgaagaagaaggctaacttgacagcagcgcttctttcttagctagtcaccggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgagttggtctccgagttcccctctccatctctcctggcccctggtcctgagaggagggtggtctccctaaatctccttctcacttagtcctttaccatcggttctgccgggcagaagccagcggaggttatacccaaggagaatcggccttgtgaggtacccccattatgtcctggaagtggtgaggggagggatatacccagaaggaacttcttagggagctccagctccccttctatcccagacaaacctgaaggagcctccaaaagatgccactgacctgcccattgtagatgttactgcttccggggggaatagcccaaatagagtgctgtttccagctctcacatgtcttacctgcgggccatgctgcctgcccaggaatttgtcccaacaagcaggatgggcaggttttgccaaactgtggaaactggcaagtcctgggtgtgggtagcctggtacacagtaggcaccttataaacgtttgttctcttaatggcaggcacatttgcctctggccttgaagggcttctgagctcccaggtgaatgtagttgctggggaaagacctgggcgagtgcttctaagactggagcaatgggctttagagtgttcctgagctgctgggccagcccccacacctcctcagtccctaggcctaagtacctccacgagcctctctctgtggggcttctcagagggagatgtggaaactctacctctaacctggctttctttgctcattgccccactccacctcccatagaaactccccagggggtttctggccctctgggtcccttctgaatggagccattccaggctagggtggggtttgttttcattctttgggagcagcctgttgttccaaaaaggctgcctccccctcaccagtggtcctggtcgacttttcccttctggcttctctaagctaggtccagtgcccagatcttgctgccgggatactagtcaggtggccaggccctgggcagaaaagcagtgtaccatgtggttttgtggaatgaccggaccctggtagattgctgggaagtgtctggacagggggaagggggaagggaactggtcctcaatgctgactctaccaagcgccctgctagacactttatcctttaatctctcaacagcctaaagagattatatatccccattttacagatgaggcaaccagtttcaacagagttaacatatggagcctcactgggcagctttttctgtcttcctgactttctctcatccttcagggggctgcaggtttgttttcttctcctagtggagaggaaattctcaggtttgttttcctctcctagcagagagtaaaaaaagggatagtttgcctgacttgttgaaggtgtggctgagattgttttctaaagagccaatggaaattgatcttgagtttaggagaaagcttttacatgtggaattaagatgccaagtgttgaagtagccacatttcaggtcctcattaatttctcttaatcctgggaaggcagcttaggagaagggttgttcctttaggagccaggaactataccccttttacccttggagaggcagggaagccagggaggacacaacttctcaggaagaggagaagctagagcagatagtgaactctcaacctgaacctttaagggccagaccactaatgccacccaagtccacctgccgtttgtcttgttctgtcccaggctttctggagaacctgatcttcttgcccctacccccaagctccgtttgcccagctagagtctggggggtactgactgactttcgtagacattcttcccttccccaaataagaggccacattcctgaagtcacttctgaagagatagctgccacacagggctctttccccccagggagggaccacccagaccctctgctctcccaggtatccgttaccacatcactacctggtcagaaagctgtttctgccattagcccctccctcttttattataggatatcctcaagggctcctctttgggcctcagtttcatccttggcagaaagtagaagctagacttcttgggctcctgaacagggtccttgctggattctgtgaaacaaattaagttcttgaccctaggcctctgggggagtacaaagtctatgggagttctggggctgtggttgcaaggaaagtgacgcaaccagattccatggggacatgatcaggcgtgacatgtgagggaggaagagggagcaagggaatgaagaatacaacttctgtgtcccatacacccctgcctgacaggccatacatactcagcagagaatgcactgtctttcctaccacactagcgtgaggagtgagctgcaattaccactgtgcttccaagtaagaaaatacctcaaattggaatttacaaaagaggtaaattagggagtggcttttgtcggacatctttaaagcatttttctttttatagaatttcacttaatgtccaatactgatttaatgagcttgggtttacacattatctcttgaagaaaacaaatgaacctttgtgttccaaagcaatccatgtttaaagggaaaaaattatgcataactctgcccagcttcacagtaacctttggcaggtgccttaggtcctctgggactcttttccttatctgaaaaatgaaggacttggatcaggtgaatggttcccagctctgcaacttatgtggctcctcagaggcacacaagctcttttccattatttgccaaataatggaggccctgtctttaactgcagtacaactacacaaaatacttgaaactacagtcttcctggtttttggttggaactgaatcagtgcactctagcaacacttatttcttgctgttcgtaggcttcattatgtgtttggttaattttttaaaacaacaataacatattccataataattacagcttaattggcagactgtttcagtctataggatctgcaggaaggaggagtaataaagggatttttgactgagctcttatggaacagagtctctctaggcccctgtcatatctgcccttctgggccctggggaaaagttggcatccccagttgtggtgctctccaggtgccctcaggctgtggtggagggagcttcccattctctccttcagcccactcaattcagaggctaggggctgaaagaagcttctctacaactggctgttcactgggaggttaagggatgaccatccagccaggccttcctcaggacatgggagggcttatgctttaacatgtgtaaatccactgcaataatgactggttcttttaccccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggccaaggctggaggatcacctgagtccaggagtttaagaccagcctgggcaacatagggagaccctgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaaagttgatttctatttggatagataaataattcattttaggacctttctttttcacttacagaaatctgtttcattctgggctgagaagcaggtccatattgctaggcataggagaaaaaggggtctgtctgcatttgcccttggtggtctcaaattggggagggaaagaaatgaacacttactggctaccttctgtgagccaggcatcatgcaagacatctgtacataatttaattctcataaccccataagatattattagcaatgtacaagtgaggaaactgaggctcagagtcatgaagtaactggccttgggtgacacagatggtaaatggcagagaaggaatatggatccaggtcttgaaagagaaaatctcaactgattatcttttttaaaaaactcatatgttctctgctgactcaaaaggtctctgtgtggatctgggttgacccactgaactgaccatcagggttccatgcactttgtatctgcccaagccctcagaacccctcagtaatgttttggaagatgagttttggaggttgtccttaggcatagcctcagcgtatgtaggcctctaggtgatctcccctaacctgaggatttcagctcaattcactctggctcctcaggacagtgggatgactggttcagacctcagctttaccacctcccagctgggtactcttctacctacagccagggcagattttgactttcacttgaaacttccaaaaattgaaaggtagaaaaacagccttggctttgggaagaacgtatgatgtccatggcctctaagcatctgaggtgggacatgttcgagtagcaccttacagttccaaagtgtgttctgggttctttgtttaaaagaacagagactgctggggaattgaacactgtgaagtatatgaaggaggagaattgtgctatttaacattcagtacttgggctaaaggagaagcatcacgaagtgttaacactcaaagggtcttgagctgtcagggctccagcttccttattttcacaggtgagaatcctgaggctcagctgttgagatgtgctgtctcactccggtgacatagtacagtggatgtggctttgcagccaagcacacatagcttcacattccagctccatcaattatgtattgggcagctttgcagaatgatttgactttaactctgcttttcagtcttctgtaaaacagggataatcctgctaccgtagggttgtcaggattagagataatataaataaggtacctcatataggacctggattatggctggcattcaataaatagtagctgttaattgatagctaagctagaactctgaagtctaccatggcaacttcttaagtggtctgagaacccagttgtgttctgtggcaaaacacagcttagggatccatacccagccctcctgtcagctgttcaccttccagttcttcagagacatgtgtggcagtgactttggccacatagctggctgtgccctttaaaggcattccttgacacagatatgtggactggtgacgttgctctccagccaggtgttcttcccagcaggctggcctggctgtctcctgcatgcctgtacttgtttgtctccctgctccctctcctgggcctggccagagctacttgcagcaaacaaaagcaggatattggcaatggaaaggagggtgtgttctggtgctcccatgccctgcggcgcacataccattgcaagggcgtaacagagcccaggcctgcatttgggtgcaaataagtctgcacacagaagaaaagaaggacctggtgaccaggagccatggaacccttgtgctcccctacctgggctactggttcttgccactcctaccattttcagtttggaaatatttgttaaggctttgctcttccaggtcctttgcttggtgctgagtctaccaagagtaagtgggatgctgtttttgtcctcagggagctaacagtctagtgaagaagaaagatggttgcccaggaacttctaagtcagaaggcaggaggcaagaaggaagcccctgctcctactgccagccctctgttgggcaccccatagttcttcagaaccacatttaatcctcactgcaggccaggcatagtggctcacacctgtaatcgcagcacttcgggaggccaaggcgggcagatcacttgaggtcgggagttcgagaccagcctcaccaacatggggaaaccccgtctctactaaaaatagaaaaattagccgggtgtggtggcatgcgccagtaatcccagctactcaggaggctgaggtgggaaaatcacttgaactcgggaagcagaggttgcagtgagccgagattgtgccactgcactccagcctgggcgataagagcaaaattccatctcaaaaaaaaaaagaaaaaagaaaaaatcctcactgctaccttgaaagtaggtgatgacattgccatttcacaaatgagaagtgaaggggctagcccaagatcacttaggtggtaaatggtggtgctaagattagaacctcagatcatctagggaaaaacacagatatgcacagagttaaggggacccagggtattgtttgtcctcttgtttcacaggtggggaaacaacccagagagggaaaggggcttgtccaaggcaatttagcacccaagaacttgaacccatatctctctcctcctcatttagagctcatcccacatgtatcttatattgagaggagtgtgagccacataccaagaacagtcttcccctctgcctccaacctcactgtgcagttttgagacacttcacagccatactcttcatgccatacccagcccttaagaccctgaagttccccttccataagacaagtaggaaaagctatagggtaaaaatagccatcagtgtttgttgagcacccaggaggaattgggcactccagaaagataaagggattctcagggacttgcttctctagacttccctagctcagctgcttcaactcattcctgcccctcttctctacctcccgcagtgctcagaagtagtagaactcactgtggcctctcaccttgcattgttgagttttatttagactttctcttcctcaactcttcataagctcatgaaaggtgaagtagggtgccctgtgtatttatcttttatatctgcagtgcttagcaagttataataatgcacttgcctggcaaaaggctttctctcatacattagcttatttcctcttcacattggctctttgtagtaataggatgctattagttattttcaatgagagaaagctactaagagaagttgtccagctagtgacagtaagtggctgataaagtgagctgccattacattgtcatcatctttaatagaagttaacacatactgagtttctactatattgggtcttttttttttttttttttttttttttttttttttttttgagacggaatcttgctctgttgtccaggctggagtgcagtggtgcaattttgggtcaccacaacctccgcttcccaggttcaagcgattctcctgcctcagcctcctgagtagctgggactaccagtgcacgccaccacgcccggctaatttttgtatttttagtagagacagggtttcaccatgttggccaggctggtcttgaactcctgaccttgtgatctgcccgcctcagcctcccaaagtgctgggattacaggtgtgagccaccgcgccctgcctatattaggacttttatataagctatctctagctagctagctagctagctataatgttttttgagacagagtctgactctgtcacccaggctggagtgcagtggcgtgatctcgactcactgcaacctccacctcctgggttccagtgattctcctgcctcagcctcccgagtagctgggattataggtgcatgccaccacgcccagctaattttttgtatttttagtagaccaggtttcaccatgttggccaggctggtctcgaactcctgacttcaagtgatccacccgcctcggcctcccaaagtgctgggattataagcataagccactgtgcccagctgctctctatatttttaatacatattatttccattaattttcacagcagttcattttatagatgaggaaactaggccagagaagtaaaatatcttgcccaagatgatgtaactagtaagtggcaggatcaagattcaaaccaagcaatgttcaaacctcttggaagcaagaatgtggccactgtggaaggtgcaaggccttgacaacaagaatagggaaaagaaggagctagaaggaaagagatggcatgggctcagcaggccagggagctcttagctgtgtgtgttgggaagctcagaagggaggaagaggttgtctgtgcaggtaagtcctgagaacacaccagacttttgagaggtggagcttcatagccaggtcattaggggagaagggagctatagattttttttttttttttttttttttttttttttttagagacggggtcttactatgttgcccaggctggtcttgaactcctgggctcaagtgatcctcccacctcagcctcccaaagtgctgggattagaggcatcagccaccccgcccagcgagctatggatctaacatgtacatcttacacagtgctaatagaatgttgggtttcttccccaatattttattttgaaaaaaaattcaaatatatagaaaagttgaaaatgtagttcaaagaacacctacatacctttcacatagattcatgatttgttaatgttatgccactttgtatatatctctctccctctatctgtatacttttatttatttatttttgctgaactatttcagagtaacttaaaggcatcttgattttacccttgaacagttcaatatgtttctgctaagaattctcctatataagtcagatatcattacatctaagaaaattcacggcaattttacaatataatattatagtccaaatccatatttcctcagttgttccaaaaaatgttcatggctgtttccttttttaatctaaatttgaatccaagtttgaggcattgtatttggttgctgtgtctctagggtttttaaaatctgtgccttttcttctccccatgactttttagaagagtcaagaccggttattcttatagaataacccacattctagatttgcctgattagtttttttatacttaacgtatttttggcaagaacattacattggtaacgctgttggtgatgggtcagttttgaagagtggagatgattaaactgcttttgttcattgaagtatctgtcaagaccagagatccttaactggtgccataaataggtttcagagaatcctttatatatacaccctgtcccccacctaaattatatacacatcttctttatatattcatttttctaggggaggcttcttggcttttatcaaattctcagagggccccaagacccaaagaggttatgaaacactagtctgtccactgaggcaggcaacacagagctggtttctggggccttgttcagtctgaaccagcttcccttggggagatagcacaaggctgtaactttgccccatcttggctttggatcaaagaggactgtccattttgttgtcatacctaggaaccagggacagcttatgtggcctggttccagggatccaggagaatttcagttcttgtcttgcctttcaggtgttcagaatgccaggattccctcaccaactggtactatgagaaggatgggaagctctactgccccaaggactactgggggaagtttggggagttctgtcatgggtgctccctgctgatgacagggccttttatggtgagtgaatcccttcatatctgcccctcttggtcttcagagtccattgacagtgcttccagttccctgtggcctgttaatcttttagtctttccatcagccagggcatctccctttatttattcattcattcaactagcaggtatcaattgagcacctactaagtgaaaggtaagatccttccctcaaagacttaatagttgaacgttgggagtgggaggagaggcaggcagagaggagacacaatatagttggataaggacctccaaggagagtgttacaggctgagaggaggatatacttaggttgtctttagggaatcagaaaaggagactctggaataggctggcagagagaggggctacctcctatacctgctctggacaaacgactttaagcatagtgacagacttgccaaccctgtattggaagaactgatcttttttagtggggatgattacttctggggatttcttctcataactgagaccaaaacagttttgtgcagtctcagaaatgacaggaggtaccaatctgacacttcctttggaagctctagggcagagagtgaaagagtggattttgacgggggccttgcttggaggtcattcacccacccctgtcctcactccagcaacagtgataactcacttccttcctccctttgtacacccttctccccacctgctcacaggtggctggggagttcaagtaccacccagagtgctttgcctgtatgagctgcaaggtgatcattgaggatggggatgcatatgcactggtgcagcatgccaccctctactggtaagatagtggtcctttgtctatcctctcccatataagagtggctggcggggagggacagtggcagggtgagttgggcagaaggagtgttagggtagtcagagcattggattcttaccacagcagtgctcttaaccagctctttaacttgtaagcagaatgatttacacatgtctctaccctttttccttaccaaccttgaaaatgtcttcactctgccctgcaatcctcccagtgggaggcactcttcaaggacgatcccagaacattaaagtcaaagaccccttagagctcaccctgtccaaccaccttggttgataaaagaagtcagcctggggcccatggaatagaatagtacaagggcaaggttctcattgtgagtcaaaggtagagtgaagagaacccagaccatctcaccccaacccaggccagtgtttttccaaatataccacttgctgcagatctagctcagcacccccagtcccagcccaccctgagaacccaggctcctcattctgagcagccagctagaatcatgacaaagagggtggtagtgagactatgggtactgttgcttaaagccacatggtgcagtggttgctggggggcttctgtgtgggactctagcatcttattcccccctgtgccctctccccagtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagagtaagtattttgagaacccttcagcaggggttcttgagcagagtctgtaaatgggcctcagagggcttagacctccaaagtctcatgcagaactccctttattctcatctcatatctttctcctggaccccactatgctgtaaccgtacctgggccttggcacttactgttctctctgcccaggctacttcctacccgatacttaaggcaagaatcactcacctttcaggtgtcaggtttcaggtcatgtttgctctttgaaatcatctggcttgattatgtgtattagttgtttatcttctatcccctccactagaatgtaaattccagaagaaacttgctgtcttattcagtgctgcatgcccagggcttggaagagtacctggcatatagtaggagttgattgattattattttgtcagtcgagagaatgaatggagaaaatgtggtccatggcccaaaagaagttaagaccctatcctagattcaggccagagaccagatggagaaagagtctgtgtctatctaataccagtaatgtcgtacctctggccgcttaccatgtaaatattgattgtgtatctaccatgtgttggacactaggctagtgcttgcacagcaggtgaaagatactagagtttgggaagtcaggaggagctaaggtctgttctacaaccttattagatgaagaggagagggaattgtgttcagggcagagggagaagcatttctccaaaagtaggagtcttaatcatgtctgatgtaggttgagtgtggccagaaaaggggctgttaagtatagagggcctggattatgaaaatccagcagatccattgagagtttaagcagcaaggtgttgtgaccaagttaacattttagaaggatcactggtatggaggttggattggagaggggaaagcctaaaggtatagagactagttaggaagctattgtaggctgggcatggtggttcatgcctgtaatctcagcactttgggaggctgaggtgggaggattgcttgaggccaggagttgaagaccaacctggccaacatagcaagaccccgtctctgtttttcttaattaaaagaaaagtccagacgtagacatagtggctcacgcctgtaatgccagcactttgggaggccaaggtgggcagattgcttgaggtcaagagtttgggattaggccaggcgcagtggctcacgcctgtaatcccagcactttgggaggccgaggtgggcggatcacaaggtcaggagatcaagaccatcctggctaacacaatgaaaccccgtctctactaaaagtacaaaaattagccgggcatggtggcggacgcctgtagtcccagctactcgggaggctgaggcaggagaatggcgtgaacctaggaggcggagcttgctgtgagcagagatcacgccactgcactccagcctgagcgacagagcgagactccatctcaaaaaaaaaaaagagtttgggattagcctggccaacatggcaaaaccccatctctacaaaaagtacaaaaaaattagctgggtatggtggtgcgcgcctgtaatcccagttactcaggaggctgaggcatgagaattgcttgagcctgggaggtggaggttgcagtgagcccagatcatgccactgcactccagcctggatgacagagtaagatgccatctcaaataaaaattaaaaacaaagtttaaaaaaaaaatagaagctattaccgtgatccaggtaagagatgtgaataactacaatgatggaaagaaggcagagttcttagagatgggagtaggagagatgagggaactccagattgggaagatgatgttcaagtttctggcttaggccacagggtgagtggcaattcccttcactgagatggggcatcctggaaaaggtgttgcctttctgtgtgggtatcctgggccccttaggggccactggtggcctgggacctggtaaaccttccctgcacaagcagaattggtcaagcaggtttttaggacatctttaccctgcctcaactcttgtctggcccagggtcaaccggatgcacatcagtcccaacaatcgaaacgccatccaccctggggaccgcatcctggagatcaatgggacccccgtccgcacacttcgagtggaggaggtagagtgtgtgtctaatctgtcttgtgagggtgggacatggaacagatcctctgagaaatcaggctgtagcctttaccttttcctacccccagcccatctctttgtcttagcattgagcctgtgaccactggtgacctatttcagcgtaacaggttcccagggtagcagggatggttgatggacgggagagctgacaggatgccaggcagagggcactgtgaggccactggcagctaaaggccaccattagacaagttgagcactggccacactgtgcctgagtcatctgggttggccatgggtggcctgggatggggcagcctgtgggagctttatactgctcttggccacaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggtgccacctcccaccctggctctgttctgtcctatgtctgtctctcggatgaagctgagctggctttcagaagcctgcagagttaggaaaggaaccagctggccagggacagactatgaggattgtgctgacccagctgcccctgtggggatcacagtttacagccagagcctgtgcggacccagctgtctgccaggtttccttagaaacctgagagtcagtctctgtccactgaactcctaagctggacaggaggcagtgatgctaaaccctgaagggcaacatggcctatggagaaagcatggagctcagagcctggagtacgggcacagataggattgaataaattgtgtagaaagactttgaaaacaataaagcaaaagatgaatgaacgttttttttagacttgagggaccaacaacccccaaaccccagattctgccaggtccatggggaaggagaagttgccttgagtggaagccccaagtagggagacttacagaaaagaagtcaagagcactggctcccaggcagaaatactgataccctactggggcttcaggctgagctcctcccttcacaaatcacttcatctctctgagcctgtttctgcatctgtgacataagatggtaagataaaggtggctgtctcaccaattatgtaaggattaaatgtggaaaaggacataaagttgtatagtgctgccatagggacagtgttcagtaaacgtgacacattcttagtatcactaagaatcaggttcttggccaggcaccgtggctcatgcctgtaatcccaacactctgggaggcctaggtcggaggatggcttgaacacaggagtttgagaccagcctgagcaacatagtgagacactgtctctacaaaaaaaaaataataataataattgtttttaattagatgggcagggcactgtggctcacacctgtaatcccagcactttgggaggccaaggccggaggattgcttgaggccaggagttcaggagcagcctgggccacattcctgtctctacaaagaataaaaaagttaactgggcatggtggcacatgcctgtaatcccagctactcaagaggctgaggaggaggattgcctgagcccaggagttcaagactgcagtgagccttgatcacaccactgtactacagcttgggcaacagagtgagaccttgtctccaaaaaaaaaagtttgtttttttttatccactctcctcaccaaacaaactgagtaagttagagccctctcagctggcatgtgttggaaacagtgccctctcattaaagtgctgccctcactcccattgcctcttggccttggtcagtatgatgaaattagtgggaggcagggcaacagagggcagggaagagctagaaatccatggcctggaaaagggaagatttgggagtggccaggtatctgtagagccaccatgcagaggaggggggcagctagccttgtgtgctctggtgggcatggtcagcaggaggcagagcaaaaggacaagggtaagtaaacctgtaggtcgggacaagccaagagccatccagcgtcagtcctctctgggtagcccaagtaaagcaggagcataccccagagagaaagttcgcagggctgttcacctgcagtgctgtggacttcaaccttcttgttccttcttcagtaagtgaaaataacagtcattgaccatgactattatcgaccgcttttgaaaatgtaaacatagtgactttattgctgtaaaaatcatacgtgtttatcatcttaaaattcaggaaacatggacaggtacaaagatgtgcaaaatatcatccaaaatcccatttgctggccaggcacggtggctcacgcctgtaatcccagcacattgggaggccgaggcgggcaaatcacttgaggtcaggagtttgagaccagcctggccaacatggtgaaaccctatctctactaaaaatacaataattaggctgggcgcagtggctcacgcctataatcccagcactttgggaggccgaggtgggcgaatcacaaggtcaggagtttgagactagcctggccaatatggtgaaaccccatctctactaaaaatacaaaaattagggccgggtgtggtggctcacgcctgtaatcccagcacttagggaggccgagacagatggatcgcgagatcaggagttcgagaccaacctagccaacatggtgaaaccccatctctactaaaaaaatacaaaaattattcggttgtggtggcacacgcctgtaatcccagctacttgggaggctgaggcaggagaatctcttgaacctgggaggcagaggttgcagtgagtggagatcccgccgttgcactccagcctgggcgacagagtgagactccatcaaaaaaaaaaaaaaaaaaaaaaaaaattagccgggcgtggtggcgtgcacctatactcccagctacttgggaggctgaggcaggagaatcgcttgaacctggaaggcggaggtcgcagtgagccgagatcgtgccattgcacttcagcctgggcgacagagcgagactctgtctcaaaaataataataataacaataactagccgggcctggtggcacatgcctgtagtcccagttactcaggaggcggaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacattggaatgaacaggtgcccctaagtttcctccctccagggtttcttggccggtctctgaggactacacatccctactcccgtctttcctcatcttcaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgagcgcaggcaacaattgctttgctcttctgcccccagtccctctgtcactgtctttcggggatttctcatcacttggccccaccccacaccatgcaggatgccaggcctccttcctggctttgggtgttggtgtgagaggtatccttcacccccacccaggccacctaaggtcaatgttgctgttacagtgagcttgtggacctggagatccaggttgggttgagctgtgcctgtggccctcctgcctccagtcagtgggtgtttgttaggtgcctgcagacctcagtaccgggcatgctacaaggagcacacaggggaatggctcctgcctccctggtgaacagtctcagggactaacctctctctttctctcctcctcctcctcttctgctgagaactgggagggggggtcaggtaagacgtgtgtctcagcttgggggcagcagggctggagagctcacccccgatccacccagctccctggtgcatgtctttggcactgaccttcctgcccccagacttctgttcactcaggagactcacttctatgccaaatgaccagagcccctgcttggcttggcagcatcccctcctgccttcttccccacttcccttttctgggttcttgcctgtcctctgtgcatgcccagctctccaggaaagagggtttgcttccgtgtgagtcccatgttgctccacgctgcatcttccacacatgaactctgtcattctgacccggctcagtgtgccctccaagggatgggatggccagctgcatagattttctcaaacagttctccagaacttcctctggtctcagcaccattaacagtcaccctccctgtaggtgacacacaaagccacgggcaaagtgatggtcatgaaagagttaattcgatgtgatgaggagacccagaaaacttttctgactgaggtaagaagatggagggggcccgggaggttggtgtcaccattggaagagagaagaccttacaaataatggcttcaagagaaaatacagtttggaattactgtcttaaagactaagcagaaaagagccctagaggaatatcccactccctctaaattacagcgtaattatttgttcaatgaacacttactaaaagcaacacaaacagggtacaagggatgcagtaacaaaagatacagggttcagaagagctctcaggttatgaggatgatggacatgaaaacactccaatttagtacaactcaatgttataatcctcacctgaacgccctgctaagggagcctggaggggagctccctgagcactcacactccttgggcatttacagttttcactacccctcccaagttacttcatggagtaacttaagttggggacacctgtggtctgggtattgccctccaagccacttggccactcccaccccagttctcccaatgcagttccaagggtaaggcctatgaagccatctccatctatatggtggtggtcttccctcatcctgatcttagtgccctgtcatatcacaagataggaggtaggagatacaggtggtaacacttgtcaagctgattccttggagggaagaggtaaggaagacagtgagaagttaaccaccagctttccttggcttcccccacccccaggtgaaagtgatgcgcagcctggaccaccccaatgtgctcaagttcattggtgtgctgtacaaggataagaagctgaacctcctgacagagtacattgaggggggcacactgaaggactttctgcgcagtatggtgagcacaccaccccatagtctccaggagccttggtgggttgtcagacacctatgctatcactaccctaggagcttaaagggcagaggggccctgctttgcctccaaaggaccatgctgggtgggactgagcatacacagggaggcttcactgggagaccacattgacccatggggcctggaccacgagtgggacagggctcaacagcctctgaaaatcattccccattctgcaggatccgttcccctggcagcagaaggtcaggtttgccaaaggaatcgcctccggaatggtgagtcccaccaacaaacctgccagcagggcgagagtagggagaggtgtgagaattgtgggcttcactggaaggtagagaccccttcctatgcaacttgtgtgggctgggtcagcagctattcattgagtttgtctgtgtcactgaaactgaccccagccaactgttctcagttcacagccctgttttcaaagaattacacatctctaaaggcaaacagggcacggacaaggcaaactggagaggcaaactgtagcctgagatggcctgggcttgccatcacaggtattcaggtgctgagggcccttagaccaactagagcacctcactgcctaggaaatcaatgaaggggaaatgagttctagcggagccctgaaggatcagaattggataaagttcttattggcagagaggcaccaggattgaagtgacaggagcaaagacctgggaggaaagaggagaaaatcatctatttcacctggaaacaaatgattccaagcatagaaataataacagctgacaagtactgagtgccctctatatgctaggcactgggctgagggattaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttttttgtttttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctgggctcaagcattcctcctgcctcgccctcccaaagtgttgggattacagttgtgagccaccatgcccggcaggaaaagatttttaagcaagaaagcttaagagctgtggtttttccaaaatgagtctgggctggcacagtggctcatgcctgtaatcccagcacttttttgggaggccgaggtgagtggatcacttgaggtcaggagtttgagaccagcctggccaactggtgaaaccctgtttctactaaagaaaaaaatgcaaaaattagctgggcgtggtggtgcacgcctgtagtcccagctactcaggaggccgaggcaggagaatagcttgaacctgggaggcagaagttgcagtgagccaagatcacaccactgcattccagcctgggtgacagagtgagacttcatctcaaaaaaaaaaaaaaagagagactgatatggttagtacattggggtggaatgcggagggtccagggaatggagccctgcatagggggctaatgaaacatttcagatttctgaattaaggtagtggctgtggggacaggagcctgggaggccgggtggagtcagaatggagagactggttggcaatgagggaacaggaggaggaggaggaggagttacgagtggcttgaggtgtcacttaccagacatttgggggatgggggatagccatgattgttgagcaactggtttgggaagagctagcattgatccctgctgttctgtgctagcagaacctatcagcatcttctgggcaggaaactggctccatgagactggcttagggagaggctgctagtcacctaatctgcagagaaggggcagctggagctgtgggacagaagaggcatccatgtagctggtgggggtgtctcagcttgtgaagaggagatggctttgagcagggctgacactgaaaaggctggaagaaaaaaacagacacacaagagtctcaggatcaggtagcataggaaagttgtggacagtctttgaggagcactccctcaggcaggcaggcaggcaggtcatgagctatagcgattcaggaagagctccctgggtgtgtgagcagctccaggagcctaagggatgaaagtagtattgcagggggctggagagcaaggagtggctccttctacatttgcaagggaaggagaaaggaagttgctcctgagagtggtaagagtcagtggtggaggcctggagaggagacataacaaacaaatttgttgacaaacattttggtaggaagggggagagcttaaagtttagacagtggggaaggtggagtcttagaggaggtgaatgtctgaaagacagagctagctggagcaagaagtcacttctctgttgcaggcaggaaggatccaaagtggctcaagccagagattgggagagtggggaggagggagcagcctggatctaagtaaaatgggtagaggtggagggggtgctgcaacggccagggttttctgaagttggggacattaggagagagctgtgagggctttggccagccactgtgctagtgattggtgaaccaaaggatgggcaggagatggcagcagggaagcagaggaagtccaggcttcctgttggtattgggacaagggagaggccataggaggccctggccctgttgtccaggttgggttctgaagctgggtgggcatggcctggtaggagagcatctatggcgcccaattccagattcagggtctagttgatttgctggccctgtagcctcagctcatgcttctgttccaggcctatttgcactctatgtgcatcatccaccgggatctgaactcgcacaactgcctcatcaagttggtatgtcccactgctctgggcctggcctccagggtcctatccttcctggcttccttgtcacaaaggaggctgacttgtcccctctggctagagggcagaggtgttgcctaggagctcctatctttcccttcctgcttcttccaatgcccttctctgtcctctgggagctccgagacacacacagacataatttcaccttctctcattagcaacctttgaaataatttgattagaagggacttcagaagtttgttgactatatgtagaaaaccctgtcattttacctgcttttgccccatagtagtcttgtaaaacagttcattgctgaccccattttacagtggtggcacctgaagcctcagcctgaggccaccgagctagtaaatttacagggaccagtttgagaccagcattcctcccactgcccctcagctgtggtggttacaatgttgtttgtcttactgacttgctatctggcttcctgggtgtctaccggctggccctggctctgccctctagacccacaccacgcaatcttcattcctttcccacatgactgccctgtagctattcaaagagcttgtctcccccaagtctccccatctactgcctccaccttgcctttttctgtcttatcctggttctagccactgcctgaaatcattttaggaataagacaggacagggaaaaacaaaagcaaccccctgtcccacctctgagttccactctccaagtccctgagcctcacctccagggctccagtggctctgccatgaacccactgtgggctgggagtctgctgtgcacagataccagaccctcagaaacacaaatgccaagtgtgtctgtttttttgttttgttttgttttgttttttagatggagtctcattctgtttcccaggctggagtgcagtggtgcaatcttggcttactgcagcctctacctcccgggttctagtgattcttctgcttcagcctcccaagtagctaggactacaggcgtgtgccaccacgcccagctaatttttttttttttttttttgtatttttagtagagacggggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggtgagtcctgaagccctggaggggacacccgcagagggaggacagatgctgcccttgcatcagagccctgggaattccaggggaggcctgtgaagcgtaggaccggatacccagagctgaggatatttttcccttgccaggtggggcctcacgatttagctcctgagctcagggggctgggaactgatcagtgtcccatcatgggggataaggtgagttctgactgtggcatttgtgcctcagggatcgctaagagctcaggctattgtcccagctttagccttctctctccatggtgagaactgaagtgtggtgccctctggtggataatgctcaaaccaaccagagatgctggttgggattcttgaaatcagggttgtgaggcctcagaaatggtctgaatacaatccattttggagtctgaggcccagagaagttcagtgaattgcctaggagcatacagctgcctaatggcagaggctagatgaaccctagtctggttcttttccactttaacgtgcagtttcatcctaggcagtgttatgttataagggctctccaaggcagttcacctacggctgaggaaggactattttcaggtggtgtctgcgcaggacagcctgtggggtgtccctacagaacctgttctagccctagttcttagctgtggcttagattgaccctagacccagtgcagagcaggtaagggatgtaaacttaacagtgtgctctcctgtgttccccaaggaaagagctatgatgagacggtggatatcttctcctttgggatcgttctctgtgaggtgagctctggcaccaaggccatgcccgaggcagcaggcctagcagctctgccttccctcggaactggggcatctcctcctagggatgactagcttgactaaaatcaacatgggtgtagggttttatggtttataacgcatctgcacatctttgccacgttcgtgtttcattggtcttaagagaaggactggcagggtttttttgttttagatggagcctcacttcgttgcccaggctggagtgcagtggcacaatctgggctcactgcaacctctgccttctgggttcaagtgattctcctgcctcagcctcccaagtagctgggactaccggcacacaccaccatgcccggctaatttttgtatttttagtagagacagggtttcaccatgttggccaggctggtcttgaactccggacctcaggtgatccgcctgcctcagcctctaaaagtgctggaattaataggcgtgagctacctcgcccggccaggtttttttttttttttttttagttgaggaaactgaggcttggaagagggcagtggcttgcacatggtcgataaggggcagatgagactcagaattccagaaggaagggcaagagactgttcatgtggctgtctagctagctcttgggccaaatgtagcccttctcagttcccttcaagtagaagtagccactctaggaagtgtcagccctgtgccaggtaccacgtggacagagtgaggaatcttggaaagattcctacctttaggagtttagtcaggtgacagcatatctcagcgactcaaacacacacacattcaaagccttctgtaattcctacaaagttgtgaggggtagaggagaggagagacaagggatggttaggataatgaaggaatgttttgtttttgtttttgtttttgagatggagtttcactctgtcacccaggctggagtgcagaggtgcaatcttggctcactgcagcctccgcctcccaggttcaagcaatcctcctgcctcagcctcccaagtagctgggactacaggtgtgcgccaccacgcctggctaatttttgtattttcagtagagacagggtttcgccatattggccaggctggtctcaaatgcctgacctcaggtgatccacccgcttcagcctcccaaagtgctgagattacaggcatgagctaccgtgcctggccatgaaggaagatttgttttaaaaaattgttttctttaatattaattgaacacctctgttcagagcactgggctggtgccagagggtttcagacatgaatcagatccagcacctcatagagccttaactctggcacacacacacagccacaaggagacacagacaaggcagggtaggatgagtggaagctaggagcagatgctgatttggaacacttggcttctgcagtgaagccccttcttagtcctcttcagtaacccagctctcagtggatacaggtctggattagtaagatttggagagatgattggggattggggagagctctctaacctattttaccacctcctcttctgccattcttcctgtccacatcccagcatccctttcccttgccaagtatctgtggcctctgtagtcctttgtaaacagctgtcttcttaccctacagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcaggttggtatcctgcctttttctcccagctcacagggtcctgggacgtttgcctctgtctaaggccacccctgagccctctgcaagcacaggggtgagagaagccttgaggtcaagaatgtggctgtcaacccctgagccatctgacaacacatatgtacaggttggagaagagagaggtaaagacatagcagcaagtaatctggataggacacagaaacacagccattaaaagaaagtttaaaagaaggaaattcacccaaaccatttgaatacagtaagtgtattcatctttcgatattcccctgtccatatctacacatatacttttttttatagtaaatagttctgtattttgccctgcatttcccttgtgtttactatccagtcttcctgtttatcatttttgtcgacaacatgaaattctattgagagactgtctgaacatattgtaatgtagatgttcaggtttttccagtttctctttacaataggtatttaactacagtgagcagttttatgcatttagctaatttctcctttgaggaagtattttcaaaattacctttattcttctcaggtaataatttcattattaccaaagttaccctaggtcttttcaagtgtgtggttaaaaaacgagaatctggctgggcgcgatggctcacacctgtaatcccagcactttgggaggctgaggctggtggatcacctgaggtctggagttcgagaccagcctggccaacatggtgaaaccccatctctactaaaaatacaaaacttagccaggcatggtggcaggtgcctgtaaccccagctacttgggaggctgaggcaggagaattgcttgaacccaggggcggaggttgcagtgagccgatatcacgccattgcactccagcctcggcaacaagagtgaaactctgtctcaaaaatggggttcttttcctgccatcaaaaatcatgtttcttttaaaaacaagttcaaacattaccaaagtttatagcacaggaaatacgtcttctgtaatctcccttaaccaatatatccctcaacattctcctcacccccaactccaccctcccaggataaccagttgggacataatctttatttaaaaatggtttccggatagagaaagcgcttcggcggcggcagccccggcggcggccgcaggggacaaagggcgggcggatcggcggggagggggcggggcgcgaccaggccaggcccgggggctccgcatgctgcagctgcccctcgggcgcccccgccgccggcctcgccgcggagccggcgagctaacctgagccagccggcgggcgtcacggaggcggcggcacaaggaggggccccacgcgcgcacgtggccccggaggccgccgtggcggacagcggcaccgcggggggcgcggcgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtcgtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcactactaggtgaaggagtttgcctgacgttatacaaccaggaagtagctgagcctagatcccttccacccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaatatggagagtgaaaacatgattggctcagggacataaatgtagagggtctgctagccaccttctggcctagcccacacaaactccccatagcagagagttttcatgcacccaagtctaaaaccctcaagcagacacccatctgctctagagaatatgtacatcccacctgaggcagccccttccttgcagcaggtgtgactgactatgaccttttcctggcctggctctcacatgccagctgagtcattccttaggagccctaccctttcatcctctctatatgaatacttccatagcctgggtatcctggcttgctttcctcagtgctgggtgccacctttgcaatgggaagaaatgaatgcaagtcaccccaccccttgtgtttccttacaagtgcttgagaggagaagaccagtttcttcttgcttctgcatgtgggggatgtcgtagaagagtgaccattgggaaggacaatgctatctggttagtggggccttgggcacaatataaatctgtaaacccaaaggtgttttctcccaggcactctcaaagcttgaagaatccaacttaaggacagaatatggttcccgaaaaaaactgatgatctggagtacgcattgctggcagaaccacagagcaatggctgggcatgggcagaggtcatctgggtgttcctgaggctgataacctgtggctgaaatcccttgctaaaagtccaggagacactcctgttggtatcttttcttctggagtcatagtagtcaccttgcagggaacttcctcagcccagggctgctgcaggcagcccagtgacccttcctcctctgcagttattccccctttggctgctgcagcaccacccccgtcacccaccacccaacccctgccgcactccagcctttaacaagggctgtctagatattcattttaactacctccaccttggaaacaattgctgaaggggagaggatttgcaatgaccaaccaccttgttgggacgcctgcacacctgtctttcctgcttcaacctgaaagattcctgatgatgataatctggacacacaagccgggcacggtggctctagcctgtaatctcagcactttgggaggcctcagcaggtggatcacctgagatcaagagtttgagaacagcctgaccaacatggtgaaaccccgtctctactaaaaatacaaaaattagccaggtgtggtggcacatacctgtaatcccagctactctggaggctgaggcaggagaatcgcttgaacccacaaggcagaggttgcagtgaggcgagatcatgccattgcactccagcctgtgcaacaagagccaaactccatctcaaaaaaaaaaatctggacacaggctgcagttgtcactttccagtaacagggcgaggatgaatgaagaaaaggcccagagcttgccacataggtgttgacaaggtaacccaaagcttctcaacttacacggagggttcctgttacccctcaaaaacttggcaatgtggagtctttttttttttttaattaagtcaaatgcagagcaatttcccacactatatgcaggtgtcagaatgaggtatataaaacatgtatatagagaaatgcctttatagaaaagtagaaaccagtaatattctcttctccagcatcactaacaccaagagaccacctgaggtctaggtccccaaagcagatggctccatagaaagccccactaacccgtctccacattgggcagtggaagggttctggaaaggaagctctatggctaggagctgccaaggcctcttgagtgtgacatcacaggttagaggccctgctgagctgctagcacagtgcagtggagaaatgttgcgctccgtcaggaagctgggctcttgccatgccagtagcttgcttacgaccttgggcaagtcactttttcctctctggggtcctgtgtccaaaaggcttaatgagccctttctaatggttctttgattgcttta

SEQ ID NO: 12787 - DNA, 44554 bp, Human
caaatgctacttcgttcttgtatctgacctctgcagtttgtggggctttcaattttcactgtttagttcgttagtttattaatttttggcttattttctgtaaggaattctctgcaacattttgatgccttcaacctgtcttaccctaagaaattaaggaaatctcttatgattacgtctaaggccagtaggttctaaatgagtctgtaaaagtgacttctctaagtgtgctgcaatgacctaatgacttgtccgttgttacctggcagaactttctgcttctttccaactttccagctgcatttcagataattaaagttattttctctcaggacagaggagcgggactactgttccacgtagacgtatgtgtatgtattaccaaaaaaaaaagttaaactgttaaagtaatcacgggtgcagtggctcacgcctgtaatcccagcactttggaaggccaaggtgggtggatcacctgaggtcgggagttcgagaccagcctgaccaacatggagaaaccccgtctctactaaaaatacaaaattagccaggcgtggaggcacatgctggtaatcccagctactcgagaggttgaggcaggagaattgcttgaacccaggaggcggaggttgtggtgagccgagatcacgccgttggactccagcctgggcaacaagagcaaaaactccgtctcagaaaaataaataaataaataaataaaaataaattaatcattactcattgctgtttattaaatgccttttctgttcccactgtgattctacaatcactgcctctgtaaaaccccggaatgcaggtgttcttgcctccattttatagatgaggaaatcaagactcagggcttccccaccaggccaaaggcattctgtgagtagtttatttcaattcaacatggctgtgctgcacatggcagttggagtaaagatctatcagcatcgggggttcttcatgatctaactaaagtgaatcatgagtgctttcccactgcgtcaagaaggcctggagtttgtgcagcccggctagaggtgagcaaagcctctgtgttgcaaatctccagggcgcagcctctcattgtattcaatgcagatgacagtcccaaaggcaccgcccatacattgtacagacagctggcctggctctccggattgtgcaggataggccttaatggcagaaggtaggggagaggtgggcgtcacaaaagtgcttggggaactataaagtaaacaatgaaaagcagcacaggaaggttcagacatcacacaggagaagcacagggtgttcccctgggtggggatttaaaacaagggcctcaagttccctgcccttgtctctgggcagaaggggcagataatgctatgatacattttttgtaggtggtgccatttgactgcatttaaccaacaaaggtatgtatcgaaatccacgtggaggttttcatggcaaaagtagagcgaattcacaaactgcactgtgtctggcagcttcagacaaaagcaatgggaacaaatcacgactcttgtccagcaattcttcctgttttggaatgatctttgctcaacagcccatccatgagtacagggcccccaaaggccaacaagacagggactctctccagggacaaatgccccgcagctgagagaggccgcccagctatccagcggccgcgcagccagccaagatttcaacacaggtctgccctatttggtcaccatccccgacagtgctgggccaggccatcatgtcacattggggagttttccctgcactccagggggaattctcaaccacaacctctgtatccggtagtggcagatggaaagagaaacggttagaaaagcgtggttcttgcgcaggaaagttggagcaaagaagagttcagaagtgggcgggtgtgtgtttaaaaaaaaaaaagggggtggaaaccccaccagccaagtctgcagaaaaaaaataaatgaagtctgcctatctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccgctttctgtttctttgtgcggggcatgtgaaatgtgtggggccagaattgtctccctaaagaacagttaggtgagagttcacatcacaagttgcttctgtgctgctccccagccagggtccgaccggccaggctccggtgaactccaggcaactccagccttgcccagggacttgctcgctccgctgggcgccgcaaaggcacacagatgcgagggaatcctgcggcctggatcctttggggatttgtaattcctcgctgctggttttctcttttaaaccatcacgttttcttgctgagaggaaatcatctgtgatgaaagtctttgtagatgcttggaaacattgctgggcctctctctgccctcttcctctgccgttggacttttgcaataaaaactaccatttgattttaccaaaaaacctaatgtacatccctcttacccccaccctgccgcggtctgattcttagagtctgtcagagaggagatatcctgagcctatcatgtgacaatgataccttattgatatgataatgatatgggtattggagacaccaactcttttataagtctttgaaatccagggggttgtgaggcctcacccctcaccccgcctgagcttggagcttggcgtggaggagtgctgcttcggtctacgtgtgtacacggcactccatgtgcctgtggttgtgcttgcgtcagcctgggagtgcgcaggcatcagtggtgcttgggagcgaggcccctcagtctgcactgggatcatctgcactgcctataaacaaggcagcctctcttagctccagtttcctcatctgcaaagtaggaaagtaggaataataacaggagataactcatccagcagcacgaagtgcgtataaatgtcccggcacggagtctgacacatcctaagtgctggatccgtgctgggcatgtttatataattgcacatgagactgtggttcccggagcacgtaacttgagcatatgtttatgtgtgtgtatacggcaggtcctgggttaaagggacaggagccactgtcattattccaattcagtcactgaggaggtgaggctgagaggcattctcatgtctgaagaggatgggcttgcctgacccccgcccccgtgcccagcccagcccagcagcccaagcagttctccaggactcaggtttcagaccttcaacacttgccttgggagacaaacagcggtgcagcccttgcttgcaagccattccacattagacttcggattgatttatggcaggatccctgctgtgcgagaactgcagggggggtggggggcggctatttcttgctgctaactcaggcaggatgtgtctatatcctgtctcagtttatgtagctgctcatcagagccagaggttagagcggagaggacccacttccgccaggccggcctgctctgctcagctcagctgggctaggccccaatgccacagttactgcgcgtgagtcatgcacagcaatccattgccttgcccttggatggaaggggtcaaggctcagtgagaagacggccaggtttggcagctttatatagaattcaccgcctctggcagaagcagaggattgcattaagtgccaaatgaaattccacctcagccattgctcaattcctccagatgtcactggcactgggagtcacatgatgctggtggtcagcagctggacccttccaagggtgcccgtggttgggcaagtatttctggggacttgcagagctccctggggagcaaagggttgtgaagtacaaggcattctgcgcttgtggtgggaacaagtgaacccatctgcagtgagtaggaagaggtcccctcaacagaggtgagaggttgggccaagtcaagtcagtttgcctcttcaggtggcagacctgtatgtacatctatgcctcaagtgcctgtctgaggccacagccaaaacatcttccagtaactgagcatacccagtgggccaacaagcacgctctaaatacaaaaccaaacaaacagtaaagttaacagtgaatgaagagttaaaaataggagaaagacaccttctccctacctcaatggcaattactttatttattgaggataatccttctagaagtaaatttgctgatacaaatatttcttattttacataataaaaatgcattttatatattttacttcatcttgttttttttccatcagaatatctcttaaaggttataccttgttattttctttaatcagttcctctgctgatgggcatttaggctgtatgcagacttcatttaatttttttaaaccacacacagcagtcctgtgacaatgagtaaggaggattttacatgcatgtgtctgtaaactgttaggataaattctcccacctcagcatttgatttctgggacaaagtgtgtattcatttaaaatgttagtagatcttaagaaactaccctcctaaaggtcacaccggtttctcatgctcacaaatagcctatgaaagtcactatttccctgcgtcctcactcacactgcattttttatcttggccaaactgagaggtaaaacaacaaaacaaacgctgtcactttggaatgagcctctgtaattaagtgagactgagcatgttttcttacttccataagaggttgtattacttttcggggaagtgtcggttgatgcttttgtccatttcctgtcagcaccccacccccgtgaggaaacgtgccccagaagtgaaaggacgtgtcctcatcacatgacgagtgaggggcagagcagaggccagagcaacatccgtgctgtggagtcagccctgggtttgactgccctccaatgttcaccagctttgggagagagaggaaatacctcagcacctcagttttcccatctgtgagtgggaatgataacagccacttccccagagtcacccgaagagcaacagcagaagggcctggacctgctcccagtggcagaggcttgggaggtggcttttgttagcgaaatttattggagcaaacctggcctgaggatgctggtaatttcaggagtcaccctccagacagctgttgtttttcgcttttgataaaataacaacaaacttagatgccgagccctggtaaggggctttcctgggtctcccctgcacacctgctatgataggcattttcttttctttttctttcttttctttttttttttttttttgagacagagtctcgtgctctgtcactctggctggagtgcagtggtgtgatctcaggtcattgcaccctccacctcctccacctcctgcgttgaagagattctctgcctcaacctcccaagtagctaggactaccggcatacgccaccacacccagctaatttttgtattttttgtagagactttcggatgaaacaccagaggctcgggggagataagccgccatagggcacccagacactgagggcgcagccaggctgtagttacaaactgccagaccccacaggcaactgaggccaacccaaggagagagttgcagggtatgtgggcccacagcttgtatgtgccaggcagggcctgctgctgtggctctgcacactgaggaactgcatgcacagacactcaggacccgcctgcctcccccagctcctcagccgggcctgtgtcccaccccagtccaccgttgtgtccatgctgtgctttctgtggtcaggcctggcatgctctgggctgctgctgcccttgcccgccttagcagctggctcggggtggccctcgagccctccctcacgcaccgtcccaggcttgctgcctttccagctgcacctctcacaactgttcacgacaggcccctcaacacgccgcgggcctggcacacactcacctgctggtctgctaggacccagtttcccaagcctagaaaacgacccaccacagccttgggcacagtttgcagccctgacagattcctgagtctgccttttcccagaattctgacctctccaggggctctgtgaccccgcctgtcccccactcagggcctgtcacagacaggggtttgctgagccactttgaggcaggtggatgattgcagggatgacccaaggcccacgctcccaggactgccaccattccaataccaaaagagcctttaaaaagccttcactcaggagctcctggtccagaacttggcatggacttggaggccagtaaatactaagttgaaatggacaggagtcaaccccaaacaaattctaaaggcacagttgttgggccccaggaatcccacctagtccttcccaccttctcacccagctggggttcattttcatatccactcccttcccctaccccacctccctctcatcttggcctggggttttcttcagatccttacataatcggaacttctgacagaatgctggctcctctccttagactatacattttcatttttctacattcttccagaacaatgttcctatacaaaatcttaacccatggcagaaactggcaagagcccatttcccatgtgcaggcagagccaggccggcgacactgggttccttcttaggcaaggcgagggttgggtggaccctggcatgacttctccagcccctggagagcctctgcagttctgaccccttcacaagtgagccctgggcttggtgaggggtgcctgcctcgcctggcatcccccagctgtagatgggggcagagcaagacttgctgccaacctgcctggctctgtggtccctgctccctctcccgttctgctggcgtcaccacccctccttcagaactctctatggaattgcattctagtctctcctgcttctgcttatgcatgtgaaagccagatgccccttctctctctctcttttttttttttttgatacggagttttgctcttgttgcccaggctggagtgcaatggcgcaatcttggctcactgcaacctgcgtctcctgggttcatgcaattctcctgcctcagcctgccgagtagctgggattacaggcgtgcaccaccatgcctggctaattttgtatttttagtatagacagggtttctccatgttggtcaggctggtctcgaactcctgacctcaggtgatccaccctccttggcctcccaaagtgctgggattgattacaggcatgagccactgtgcccagcctaccagatgccccttctcttattgccaaaacactgtggtcacacactgcttggggcccagcaggcacaacagtgacctctttccagggctcaggggaggaagctccgcttcggggcatgtagagccagccctgggcagggtggccttggttatctccctgcacccctggcacaccctgatggctctgtttatctgcactttgcacatgatggtcttgactgacacatcctcgcagagagccactgccagggcgcctcacacccgctgctcccacacgcagtgggcatttttacgaggggctcaggcacagggtctccagctgacccagcccagcactgccactcttcctccttgaactctggcatggagaatcttcacattttgtcagcagccgatgagcacatgtattctcagcacagtcttaaaaggggggaaattatgggttgccagatcaaaacctgataaaacaatgatgcctctggtgtggggcccagccaagcccttctcctgtattcaccgggcaacaggggcccattggatatgaaatccactttcgcttgagaaactcatccagtgctcttgctgaaacctacacacaggccttagcaatgcttgaagcttcaagttcaggttccccttctgtattttttcttaaacctttagctcaaatagactttgtgtcaatttgctagtgataaagggttagctttgaaatctgaggatgaggttttgggtctggatccactatgagctggctgtgacctgggacaagttgctggtccatcgtctggcacagggatggcttcacagggatgggacctgcccagcagggtcccgcacttcctaggtttaatgctctgtcactgctatcttcaaattcttctcttttgaataagaggcctcatgtttttattttgcactgggctctgcaaattctacggctagtcctgaacctgtcaatggagctaataacagtctctacctcagggctttgttcggaggattcagtgcattctcacagataaacatcctagtgtagtgcctggtatgtgctcataattgtgcttaattgcttccgctcactgagtgtgtgcgtgtgtgcttaaacgccagcttcctccccactgccctgctccctccttgctctccagactcctcagatgtttgcccctttgccactgaaagtcatacccaatgacagggggccatctgcatctgtgtggtcccacagagaccagggaaaggccctctcgctcccgatgctgctccttcatggtttttattgtttttgtttttcttttgagatggaatcttgttctgtccccaggctggagtgcagtgacatgatcttggctcactgcaacctccgactccctggttcaagcaattctcctgcctcagcctcccgagttgctgggattacagacatgtgccaccacgcccagctaatttttgtatttttagtagagatgtggtttcaccttgttggccaggattgtctcaatctcctgacctcctgatctgcccaccttggcctcccaaagtgctgggattataggcatgagccaccacgcccagcctccttcatgtttttatccaggagtcagcactgcggtggagacagcccagaaaacacacgcaggccctgctcttggccacgcacgccagctgtgtgatggggagcaagcctcttaccttccggagctccatttcctcacatcaccctggagagaggtcatctttgcccccacctcatcggggcaccagcccctcaaccactcatacctgggccatctggttctccatggagaagagtaggctctttgaaagcaccgtatgagtgaaggaatgagtgaatgagtcagcaaacggatggagggatgtgaaggtccatccatgtaggcaaacaaggtctgcaaagagtgccctgggccccagcattcactgcaccctctccctgccctgggcaaggccctgaccctggtgcactctaagctcctctcagctcagcccctgacctctcccctgtctgccagtgcccctcccctgagtgtgaagccgggggcctccttccctcggctcacctggccctcatgcgctctacctttcaatgtcttctttaggcagtcatttctcctttttccttcatgctcccctttgaatgggcttggagctgggtctctctaaggttctggtctctctctctctctctctctctctctctctctctctctctctcttggagaaagctccttctcagccttttccagcttttccaggtcccaaactcctgggaggggagccaggccttgcttgatcatgccctggatggatttgtcatattaatccctttccttcaacttcagcaaaacttctcattttagcgaaattaatttcagttatggttgaaaatcctgagtattccctttttaaaaaattttcatagtcttttttttttctttgtcactgattctttacactatcctgagccatcctcctcatctggtgacagtagccctgtctcagagagtagagatgaggctccactccacagacgccatctcatttagccctctggcagccccagggaggtatttttatctccattttgcatgtgatgataccgaaactagcaagtggatgtgacttccagagaacctaccagcccctcacacctccttctcttccccctctacattgaaagctcagccagggcctgaccccagacgcagtgctcagagaccacagtgcttctagaggcccacaacagtattagagcttcttttaaaatcagaaggaaggaaatgaacctctaagatcaaatagtacatttgcctttataccagtgcagctatacaatatgatttctaatatttgggaggagaagggacccataaggtaaagcaccttggcccatggaagtcaccctgtgacctgagctcagcccattggaggttgaggggctgaagcccactgcctctgctctccctgcctgaatctgccccttgctcccagggctctgatcctcctctacgttggcagtcctggttccttagcagttctgtctgtcacgggaggactccctgggctgggcatctgcaggggcagcctctacctctccctgtgggacttcactaacacagctggagtagatgctagggaggctcaggtcatgcactacttgctgtctttctctctctctctctctctctctctctgtgtctctctcattttctgtctctatctttctcttactcttttggccttttaagtcagaagaataggctactcttcacttacaagtttaaaaataagttgtctttgccctatttcattattgcagaagcaattcatgttcattgtagaattgtaggaacaagatcaagaggaaggatgtaggaagaatctctatggggaagagggtgactttgagatacaatctcttgccctgatctgagctttcagttacctaaggtacagtacagtaagatactgagagagagagagagactagttcatataacttttatagagtacgttgttacaattgttttacttcattattcattgttgttaatatcttactgtgtctaatttataaaataaactttatcatagttattcgcatataggaaaactatcatgtatgtaaggttcagtcgtatctctggtttcaggcatccgctgggggtcttggaaagcatcccccataggtaagggggaaccaccgattcatgggacagatagatgatcacccagtggcagctcgaagggagattagggcacagataaggctggaggacatcagtgtaaagaggccaccctgtgaggggcccagaagggagccctggagaccctctgggtgcattgatcacctcagatgggggcccaagggatgccgacgcagggcaaagcactacagcagactcggcacaggtgcctggggctgtgcacgccctggcaagcgcccactctgccctgctccgcacctagtgaggacgtgtaacacacacagtgcctcctttaatgctgaaggcatcacacagatgcagatattattaattccagtttaggaagacaaaaagtgaggctcaaagaggtgatttccccagtgcttccctgtgcatcactgacacgctctctcctggaagccaggtgtgtcttcctccagctctgggactctgcagcctgccctgctgggagggggctgcccatgaccccttgcccttctgctcagatcgttacagccctgaggtcgctctcctggcctctgaagaaaaggcctttctttgttccccccacacccggaaccacttgtgttccctctgccgtcctccgcaggcacccacctgtgtcccagcagctgcgaatgcagtgctcagagtggtacacaagggctgggttgtgacagtcctgccagcccaggccaacccactcttcccccggggaaggagtgggcagctgcctcccaaggtcactacaggggcactgggagagaataatgcccccaccaactcctggccaattcctggaatgcctccaccgtggaaccacccctgggctggcaactttattctgtgttaaagtacaacaagccagccggaggatcattgtcactgcatgactgcaatttctgttacactttgctaggcactttcaaatctgtttccactcttcattcgagacatactagtctccctcttttgcaggtaaataaagcagacctcaggaaagttcagtgacttggcagaatttacacaaccaggttgcaatagaggagccagactggaccagtcctcggtccctgtctcctttgtgagtgtactgttcaggccactgaaactcattcatcattcttaagtgggaggggctgaggctgaagagtcattgcaagtaagaaactgtgatgctggccttccattctcctgcccccctcccctccctccctacacacacacacacacacacacacacacacacacacacacacacacacatatgcacgcacacacacaagcacacacacatttcttcctacacaccatctccttgcgtttcttagcagcagacaggtatcagccccagacctgaggcagacacttggggatctggttcgggacagggcagacaggcatttggtgcatggatcctactgacctcccagagataactagaaacaaatgtaagaactgctgcctacaacatcttttggccttgggtgttaggtgccacatgcttttgaaactttttctactccactatttttaggactctgttcccacttctttgctcagtgtagagcatctgccatgtagaatatctcctcatagcctcttctgtctgcttgtcactcaaggtcattgtagccatcagaccccacctagcagacagaggatttagagacagaggatttagagatacgtggatttagagaattcagcaaggctgttttgcttatttttggtttgggttcagcactaagtctcccatacccttctgcaatgaatccctctggagtgtatcagtaaagaaaacagaaacaaccttccccaatcataccccagcagttaaatatttgggtcagtttccagacatgactcctacatgcattgcctatcacatgatctggatatcttttttttttcttttttttttttttggagatggagtctcgctcttgttgcacaggctggggtgcagtggcatgatatcggctcaccacaacctcttcctcccaggttcaagcaattctcctgccttagcctcccgagtagctgggattacaggcatgcaccaccacgcctggctaattttatatttttagtagagacggggtttctccatgttggtcaggctggtctcaaactcccgacctcaggtgatccgcccgccttggcctcccaaagtgctgggattacaggcatgagccaccacgcctggcctgtggagtccttttctaagttccaagtctgcagggacctcttgtgtagcaggtgacctgagccctgagccttgaacttttcatccacttatagtgaatacagtcaagagccccaccattcagatcatcccagtccaatctgatgcatttgattttaatccagggagtccctactgcatgcaaggtgctgcacaggagacataaagggacaaagaccatatcttcaaaggggcttcagcctagtaaggaaggggagatccaggagcatcagaaaacagaataagtcaaaaagctgattagagacacgtggcccagcagactgcttgctgcacctggctcagacacaggtaacagtgccaggctgctttgagattaaggccacatcttcctgaactttcaaaagaaggggttcttcacctgggatccccaccctaaaagtcacacacacacaaaagagcgtcacaactacaaatctctgttgcagtatttttgtttttgactttttttgcagcagtggcaattttataaaattaattcttagatgaagtctagaaatacataagagataaaagtccatctgacccatttgagtaaggaataaggcctggtggccacacccccagggccccttgtgatggctcactcccgagacaagtttgagatctcctgcctggtgccttccagagccagagcagttaactgatgctcggtcactgtttgctctcagggaggacactttgaggcctggatctcagatgatccctccatagcagacgtctctaccccatgcagttgtgaaatgctctcattgtggttaaatatttgcctacagccaactacaatgcacacacagctgtttatcactttaccaattagttccatgagaaaaatgctatcaaacttcagaaggtttacgctcaaactccaggaagaaatctgaaatgttaaaaaagagactggatacaaaattggattgcgagagcaattcatccgcaagcaattactaatcactttagacatccctggttccaccatcattggaaacacttggcgttatggtggttctcccctgccgtcagtcctcagaattgagaggggacaaaggtgtgagatgagatggctgccctcaaagccttgttgggcttcttgggacagcaaggttcacatcatgacaggaataaaaagcatccagtcttcctggtgagaaatttcttatcacacgaattcaggtttcggatcgaattgcctatgacttactgcgattagttgctgaactggctcaatagctatgtagctacttagagaataacttcaaggagtataattcccccaacgtaaatgggtgcttttctagctaataggaaattatagtaaattttgacctagttagacatagtcgcagcttgttgaattaaaatcctgtgcttgaagagacaggttgttggtgatcaatgctgactgctgaggatgctctaactctggagaatgaattggtaaagacaagttgcagggatacgaagcaggaagaacagtgctgatgtccagagctcactacgtgcgcagtgttgcctggcgacatttgtccctggtcatcatcctgtgctgcgagtggatgctccaggccatgccccctcctcagggtacaggacatgtctgtgagtgtcagggctgtgattcaagcccaggggttccaacccctagtctatctcttaatccctgcacggcaccacccctccctcatatgtgcggaaactggggagtttcaaggaagaacagagtatcctctcccaaaaggagggagagaaagttggttcaagcaggctgtcgagtacattgatttatatcaggccttggtaattcgccctgggtcatttcttatttcagaatcctggagcctctgaaaaacccttttgggacaggatatttttaaacaatttatttgagcgaaatgaagcttgtcactcactgagaaaactaacaatgctagaggaagtcaaaatgcctctttcaggacgtggcggtcacaggaggatgaaatccacggtgttccttcgaagttccgatgagctagtgtttcccgctcatgggcacttctgagccttattattattatttcctggaggcttttgtcctctgcctaactctcttcatggtcctaatctcttctgtttccagggtggtgcttttggtaaaagccttctctgaggttgcaacatcccagaggcacaattatctgagtttctggccacatctcgtcttcctcggcccagggctgtgggaacagaggctgaactgtctggaggatgaaaggatgaaaggctggcctctcactgccctgcctcctgccctgagagccccagtggttctcaaagacggttctcctttgaattccctgcgtgtgaggccctccccaaggaaaaacaagttctctctgctccagttcatgatgtctccttctgagaccgcagctcccactcagggaggcttgtgctgcagcacgccactgcccagagctgctctagcctcactggaccaagccttaagtttagccaggactcacttgctggggcccttctgggacaccccgattccaccctggggctcaggattgcctggagaagtctcactgtgcagcgcctctccaaccagtgcactcacagaggggcacaaagagcccagcaggccacccacctcacctccccattgctgtctcggccctgccatgagccagtgagggtggccttggggtactggtttcaccccctttggcctctgcttccccagcaatgcctgtgtcctcacaggcacttctgtaatccctagaagggactgaggcagcagggatgtgcctgcgctctgacaagaagcaggatatcgcatgggtcacaggcttcgagggggccaggctgggctacaggcacagctcagcctcttggtggcttagtccccacaggcaccttgcgtgagaggctgtggatgaagtcccaggcctagcacggggcacacactcagtaaatgttaaccagggagggaccagaaagactcagagacaggcagacttcaacaggagggctgcaaactgagacccactgccaaatccaactgccccctatctgcacacttgaagctttcttggggcccaacagcacctatcatttacggagtgtcatgtgctgcttccctgctacaatagcagcattgaatctttgccatagagaccggtggcccccaagcctaaactatttactgtccagccctttatagactcctgactttaaccaacaggagactctctgatggcacaacttctaggcctgggcccacctgaccccattgcacctcaaccccgtgagtggatgggaagccatggaagaaaaatccaccctgaggtcagggagcaggcagcagccagggaggcccactaacctgggcccacgagaagagcatcagttcccgttccctgaccttccactgcccaggctgctagcgggtaggaggggctcttgtagtcttcccctctctcctgccctcctcctacctcctctggaaatacaggcactcggggctttgcctctgccctgcagaaaatccccacctcactgggcaggtgccggagggagagccagagcaggtgcaagcatgcgaggcaggcttccctgagcccgacagccagggacaaccagctaacacccaagttcagaaaacagtgctttatcacaggcacgagcacaggggagcaacctctccacgcacggggccaggtgtcagctgtgcacttgcatgcttccttattggaacctctccctaccgggaggccatcattagatttggagatggagcctcgggggtcaatgtgtgtccgtattcttccagtcataacctggtagctccagagctcaaccgtggtctcctggagtccacacttctgctgactgccctagcacacacgtggcctgggagctcagattccacaaatggtcactgagcaccagctgtgtgtcaggcccaggccaaagccctgggaataagacagtgaacaaaccagcaggaatcccaagaggacctcacactttggcgaggtggacacatgggtaggatgcccagtacatcagatggcactaagggctgggtggccagtgaagccgggaagggagatggaaggtgaggagtgagggggtgccatcttatagggtggccatagaaggcttcactaagggtggcaatgtttgagaaagccctgaaaaaagtgagtgatccagacatggggccatctgagagaagcatgacaggcagagagcacagcaagtgcaagggtcctgaggcaggtgcaggcctggtctgaccaagacacatccagggccaggtggctgggggatgagggagggaaaaggtaactgagagatgcaggtggacaggtgaggtggtagagagatgaggggaccacctcccggcacctgttacagcatccagaattccaccatcccctctaagtcttggagccttcaaggcccctccagaaggctcatgactctgaggaggtgcccttctgcatctcaccttagccctaacaagagactgagaggaaggcccgggcaacctgtgacatgcggtgggagctgggaaggaggaagagaatagtgagccctcctgcagtccctgaaatggggggcttcacacagtgcccaatttgcacattcacctgcacacacacaaacacacacatacacgcatacacacacaaacacacagaggccagctttcagagcctgtctgaaattgtcagatgtatctttcgggtgcctggccctgcagggaatgagtgtgagtgtgggtcccctgtcccctcagcacctgcagtccacagagcacacaggacccttagggagcagggagaatgtgcatggacccctcaaccgcagctctgggtcagtgcgagccctggaggcatcagcctcagagagagcacagagcagcaaccttctcccctcagggtggaggggctggcccagcagtggacagagaacagaactgtgaaaggaggtggataagggaggtctcgacctgatgcttctaggtccaagctgccacctaacctgggggaggaaggccaggaaccacactcagccccacccacacttccctggcacaatgaaagcacagcccatatacatagcctccttctcctctctgaaatcagagaggcagagagaacagctcggcctcacacagctcaggctagaacccagtattccaccacctcagtcttatcctcacccatgtcagaggtacagactaatgtaactcacccagaaggcaagtcacactcgaggtcaggatcctaatacccagaagggtattgggagacccagaagggtattgggaggtacttttcatctgcttgatgtgatgaacggtccagggagggcaagtgagcgaagccctccaacccaagcacaagggctctttctgtgctctttctgtgtgcctcctgtcctaagtaatatgatgccaggacaagaatccagttgctccggaagagactgactcctgattcctgcgcttctcatcttcacctaacatcttggaagttggcccccgggcatctgtctgtacttggaatcgctcatgcacaccaaaacacattcacatttcttatccctctgtcctcaccacagcctgggacagtggcagggtgggggtggagaaggtgatcacgttcactgagccctccgtgtgccagtcgagctgccagtgtgctctcgggaggagagtgtcattatgcccttgtttaaaagacaaggtctggggtcctaacacaacttggtatcctgagtgttcctaaataaatgggattggaaaggtgtgaaataacaatcctaaagccacaccaatagcaaatggcggagccacgactagaattcaggtgttttccacaacctctgtcccccacagattcctgggcaggcagaccgtgccaactcctcttctcagttcaaccaggtgctttaggtaccataattttaagtggacaaatggtttcatgcttaaacactgccagatcctctccatgagatgcacatgtgtacacacatacatgcacacacactcacacacacacatgcacatgggcacaggcacactgttgggagacttaaatgacacctcttaaatccaggaggatcagcctcttggatttaagctcgagtctctgctgagcttggaccctatgcgacctgagggctcccaagtccttccagagcaggactgtggtgccttgtcctaagagaccctgtctctgaatagaaagtaagacacccgcctcctgtcagcaacatcaggacacaaagcccggactcacaggcaggctgtatgtggctgtgtctgagtgtgcctgggcattgtattataatatttcttccaagggccttctttccatcctcttattcaagcagatggaaatggctcctccacccaggcctgcctctgataagcctccgagcgggagaagcagaactgagcctcttatcagtcagctgcaggggtacctggtgggcctgtgctgggtggcctggtgttgataaaatgggcttgggccagccgctcaccagcttctccctcagacccatccccaggccccaacctcttagaaatgggagcagtgagacccagaaaacttccttactttctgagataccaaagcaaggcaggcttctgggggctatgggcaacaggaaggacctgatgggaaacaagtggggggggatacaggctcggcaaggccgcgggtggagaaaggggcactagagaggccctcgagccctgaatgtggtggtgggagctggtgcctcccacaggtgtgacaggattttgcgtgtgctgagaattccctgtgaggcagactctactgctcccatgtgacggcactgagcctcagagaagatggaagcctttttttaagtgttttgttcatttaaggtatgatgtggtgtggtcgggttggaagccagatctgctggtgccgaaagcccaagcaccttgctccttcctgggagctctggctggaggggttcacccctccgaatcccacccctgccacacacacacaccctgtttgagacagcacattttaccttcagaagttaacttttttcctcagcttctgttactgttaaccccccaacacatttggtgagttcaaacggaggctggcatgcaatatttgggacatacttgtattcaaacaattttcattttttatctgaaagtcagatttcactggcttcctgtattgtgtctggcagctgtggtagaaaaggacctgaacatgggtgtttctgaaagggtcccagatgattccaaggtgcagccatagctgagtgcccagggtgagtggctcctgctgagcacacccacctgctgcagccctaccaggccccgccacaaagcccagggtggacggacccttcgtcatcagaaacatcctccaaggggctttcccagattcccttcccatcctttgcatccatctcgtggattcctcccacaatgaacagaaatctattttgtatgtaaatgtagaatctgagacacatcttaatttttaatactttactgtaattgtggaagtgattcaataacggggcatgtggaaacatagaataataaataattattcataaccctcctacatctcccatcacactgatgttcccttcattcgcttctactcacactcctgcttaaaccccaaattctcagaccgccagcctctcctgcagctcctacctcatacccagacccttgtctctgtccatcatccactcctgtgagcctctcattgtgtcatcctgattctttctcagtagcttcaaagtgctattctaaacaatgggctctcctttccatccctaccctgcttcaaaactctagagaatccccttctctatgacctcttcacctgtcgtggctgttcgtcactacccgagaaaacgcagacttcttagtctgatcttcaggatccttcattgccctttcctcacccaagcaggtgagtaataaaatttattagtgatattcaccgtagtagtgatggtggaagaagtaataagacaaggaaaagaaaaagagaaaaataagctaatgatatgtactgggtttagccatttatattctttcattttttcccacctaaaaccacagagtttatacttcccaaaacaactcagaagtagttatgttaaatgtgtaaagaaaaattaatgcatttgtttcattatgaaaccatctatacttgaaaatgatacaattatttgaaatctgtacaacctggcttcttccagctgtgctgtgagccctccacacaacctggcttctctaggagcctctaatcctgattgaagaaacagatccacccctgtaactgcctcatgtctttttgggtaactgctttcactctgttacttggtttgcttaagcaaaggtttcttgcctttatcaaggaaattagcacaccagtctgacagaagagtagattgtgtttgtgcttacccttcttctcctaaaattaagtgttagctttcaaacttgcttttgaagtgctaagaaccctgatgataaatgatgaacaaagcctcctgtttacattagaagcatcaaaacagcaggactgggccaattcacccattcctgttgatcattagacattaactggttgtccaacttcaaccacatcaactacaaaatcctgaagtgaaacaaagtctaagttagttgacttttctttgattagtctctagtgcatttatcactttctatgaaagaagcatctaatttagatggcagttgatttgtgtcatgggatttcttctgacaggaggcagagttatgtatgtgtttatggcttctttgcctttaaaagattaatgttgggcaaatataaatcacaagacctggatagggggctgggaagatggagcaggagcttgccagggtgatggattgagacgtattttagaggattttcattgctagaaaaacactgggaagttgtggcagaggggtggtggggcagggacagtgaagagagatggctttttctccctaagcacagagaaaggacaggatgggcacttgagccagggcaggtggctttctggctctgtttcagaagcaaaatgaaattgaattggtaacttcctgaagcttctttcctgccctgatacccagaagacaggattggaggacaaaggagggttcacagcacagctggaagtgctcaaggtacccagctgctccaggagataaagtactccctgcctgccccagtcacaggaactggcccctgaagccaggctgccacaccctatcttcccatagaccaagtctaggcttctgtcccctgaggctgtgtgtgtgtgtcagtgtgtgtgcatgtttgtgtgtgcacctgtctgtgcatatgtggaaaagtgcgagaggaatgtgcatgagagtgtgtgtgtgcatgtgtgcctgtgtgtgcatatgtgggagagtgtgtgtaagagtatatgtgtataagtgtgtgagtgcatgtgagagtgtgtgagtgtgttagagtgtgtgagtgtgtgtgagaatgtgtgtgatagtgtgtaagaaagaatgtgtgtgtgattgtgagagaatgagtaggagtgtgagtgtgtttattagtgtgttagagtgtgtaagtgtgtgagagaatgtgagagagtaggagtgtgtgtgtataagagtgtgacagtgtgtgtgtgagcacgtgtgagtctgagtgtgtgtgtgtatgagagtgtgtgtgagtctgtgtgtgtgtgagtctgtgtgtgtgtgagtgtgtgtatgtgagtgtatgtgtgtgagtgtgtgagtgtgtatgttcatccttaaatatatgaggacaataagaatagctcccatgtgccgggcaacaccccgagagccacactcagtgctgctttgtatgtgttgcctgccgtaatccttcgctagggacgagcacacgagggtccgggaggggtgcttggagttgggacccagagcaccaggacttactgtcaaatctctctggcaccaaaacgcatgctccctatgccacctatcaggatgcacccttaaagcacttttaagatgctttttggaaagagccatttgttggtgtgcatttgtcttcaccactgccccaaacatagctgtccaatattcaggtgaaaatgtcccccatcggccgggtgcagcggctcacgcctgtaatcccagcactttgggaggccaaggtgggcggatcacgaggtcaggagatcaagaccatcctggctaacacggtgaaaccccttctctactaaaaatacaagaaaattagccggccctggtggcacgcacctgtaatcccagctactcaggaggctgaggcaggagaatcacttgaacccaggaggcggagcttgcagtgagccgagatggcaccactgcactccagcctgggccacagaccaagactccatctcaaaaaaggaaaggaaaggaaagaggaaagaaagaaaagaaaagaaagaaaaaaataaatgccccccttctttccaacaggctttcaaatgcgagtctgacataaaagacagatcacagcatcaccaacagcaatggctaagatgtacagtgtatacactacccacgaccttcacaggcatcctttcctgcgagcctggtcaccaccctctgctgcaggctccctccccatcccactgagcctgtgtgcctctggctcatacagagccagtgtgcctctggccggcctgagtagggagaatgcagtggcctttcctgaacccttgagttctcacggagccctctctggctagggaggaggagaagccttctagggaatgaggagaagcggccccctgcatcctgctcctgcacttttccttccttccagcatccttcaccactgcatctccaccctttgtgcccataaactgtgggtcctgttgtctctgggccactttggcctccccttcctcagcacatctcctggggaagcacggctatctgccttgggatgtagccacgaacctcctccttggagccaatcctcctgaatgtttgaactgagtttccaggcagcagaatgttccctcctgcctcctgccgcccctgcggtcctgcccactccccacactggctctgctgctcctgcctgtcaaacccggtggaggaaggagaaaaacactttccacatcctgttaaccaactgatgagccttctggaaacccaataacaaagcgtacctaactaaatcatcattatttacacatgcagcccaatcgaggacatttagtcatgtaattaagtacctaattatgctgaaaatgcaattatatgattttttaaatgaattaagtcctccagagaagtggtaaagattagcacgcagcatctgtctggggagcaggtacctcgaagggcacccaaatgtgacaccaagctgcacaggggccaaatggtctgaacccagatcacatgtgtgagcacacacgggcccacacaggctcacatgcagaggatgccagcttcacctctgtgtctccaggactctacaaaggtctggtgcacaccaggaacttgataaatgacagtcattaatgtcattggaagcatagtatacatctatggagtgactattgagcgacttagagaatcttaggaaggttatttatccagcatctgagaggcaggtgtgtagagaaagaaaaaaaaattgagagaaggatcagccaggatatgtcagaggatattttaagcaacatcactcattcattcagatgctaaagcaaaaaaacacagtcagtgtcttctaggagctcaaaaattagtgcagagttggctgggcctggtggctgacacctgtaatacaagcgctttgggaggccgaggcgggtggatcacctgaggtcgggtgtttgagaccagcctgaccaacaaggagaaaccccgtctctaaaaacacaaaatttgccaggtgtggtggtgcatacctgtaatctcaactactccggaggctgaggcaggagaatcgcttcaatccaggaggcggaggttgcagtgagccgagatcgtgccactgccctccagcctgggcaacaagagtgaaaaatccatctaaaaaaaaattaattcagagacagaaaaagcatcttaatggtgatatgaacaggttgttcagcaaactacaacttgtgggccaaatgcaacctgtggcctgtttttgtacagtcaggtaagctaacaatgatttttacctctttacggtgtttcctcacttccatcccatgcaactcaggttccgaggccatagtattaatcactcactgtacatgcacaactccagtggggggtccagagtgatcattgcatccaggagccaaatctcatatttctttataaatattgaaacaaaactgtggagccaaattgttaatgaaagaaagattcattatatcttggaaaaggaagccaatgatgtgaataaggatgaagaggttgaagatggtcacaggaattgtcagaggaggagatggagaaagatgaggccaagaggggaaactgagtctacacacttcagtgtagggtttccctccatgagcccaaaatccaagggacaacccggagcctcccctcaaataatcctggcagcggactctcaatgagcataggaagtgagaggaacctttccagtgtctctaggaaaccgttcacactggagacccctgagaggacagctgagtaacacaccaataacaaactcagggagctcgagaagcaaagtctgtggccagcggccctgtgattccaaatgcccagcctctgacctgctccctgagaggtcagaacttcccttcatttccacctgcagaagcaagggactgggggtgaaccatggactgaagccacagcgcacatttctcagtgtgcaattgcagcccagggaaagggtgaaaggagcagtggtcactgaatgtactgtctcttttccacaacatgcatgtctttcttgaaaatgaaaatgactacttggagcatctcctaaccaggttaggcaaaggatgtgtggacacgagactcagagggccattcagagagggtggtcatggtcctactatccaacaacagcctgacgcctgctcacgggagacaccgccaagcaggtgcaggcatccagtgggaacctggagcaaggcgggcaggtcagggcggcgggaagggaccttaacagaccttctagtcggcgactttgaagattcttcaagacaatagccagttctgaagattcatccccgtttcttcactgtaaaagtaacacgttttttgtagatgacttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtcccgttttcttcacttaacatcaataccctaagcatttcttcctgttgctaagttcacgtgcaccccttccctaactgcataatactgggtcatatgggggtatcataattgacataaccaatgcccaaatatggaacatttagattgctctctctcttcaatttttcattttagactgcattaccatctactttcccgagcacggacttttgttcctgttccagattgtttctctaggatcaattcctagaagtggattgcttgattctcagggtgatacatatgccaaatagtataccagagtattgaaggtacttgtttctaggaatcccactttgacatatcgacgatgagaataattaatattcaaatagcctgacctatgtcaggcactgtgtaccacaaactagcttacaatggggctacactgttgtgccaccgggttttacatgtgaagaaaccatggtttgcagtgagccaagattgcgccattgcactccagcctgggcaacagagcaaaaacttcatccaaaaaaaaaaaaaaaagaaagaaagaaaagaaaagaaagaaaagctacatagcattcctcaaaatggtctggccatgagtatcgtcactgaggggccactccctcacctgtctgcgccatgcctggcaagtgtgctgacttcacagcagggcggccagatgcctggccctgagcctggcagatgggtgaccccaggagcatggtgcgcaggattgcacaccctcaccctcctcagggaggtgtctgggtggagctgggactggaaataggtgtgtccagggtgttctgcgctccagccacctccggtggagcttggagctggcaagtcaagcagatgctgattgggatacacgggccttcctggctcctcagaacacctgcacacagccattttctttgccattttggtaccccaaacacctatttttggagaagcatttccctgctgcctcactggagctcagctatccttaaatcaatcagcagtggtctggtaggtggatcagctgggaacacatgcttaatttcccaacaacaaggccaaggagactgcagtctcaggagctatggagcagaagggtgtgtgcatggaccagaccccggcacaagggccccaaatccctgaacccagcaccaggcatgggggtagacaggggacacgcagaaggaatagattctccgagtcctccactgtgcccggtcctcatctctgtcagggtggggttcttgagagcctggttgccgctcactctcagatggtatctcccgcttctcccctcagcttcagttccctcttaaggactctgttctccttccacttccgctgtgaagatccctcagcgtgatgaagatgcaggggcaagtcagaggttacacagtgggggctgccctgctagtgtgctgaagccacgccaactgttcagggcagctttctgcttccaggaagaacacattgacctggctcctttcaacagtctgggcgttgtcttaagcctgagcttcttcagttgcctgctgaccccagacaccccctccagtccctacccatctccagcagccagatgctgaccaagccccaggagcttcccagacgtaagagccactagaatcgcctcctccccactcttcctgcctctttcaaatttgatttccctagaaatcttccggcagggtgtgtctgctgggggtcaggctgggggaattgtggttctgctttccttcagtctatgccatgagtaaagaaggatatttgtgaacaggtgagatggctcatgcctgtaatcccaacactttgggaggccaaggcgggcggatcatgtgaagtcaggagttcgagaccagcctgggcaacatggcgaaaaacccatctctactgaaaatacaaaaattagccagacatggtggcaagtgcctgtaatcccagctactcgggaggctgaggcagggagaatcacttgaacctggggggcagaggttgcagtgagtctaggtcacgccattgcactccagcctgggcaacagagcgagactctgtctcaaaaaaaaaaggatatttgctgctttcctgataaactacaaatgctgcaccatccacagctgacaaagtcctctccccagtggtggacaagggcaactccaccttgctcagccagcttttatccccagattcttcctccttcagagtgccttgctgatttctgctgttgtcaggatcctggactttggagacgatggttccactttttcatactctcgcctcacaagggagaaaaagcactctttccttttacttagatgtcatagctcaactgaggcagattggttatggtgttgaagtaaggttctgtttaaattttttttctaaggctcagggcgagtaacagggaaatctatacagaggaaaccctggaaccagacatttcaagttctaagtcacggcagcctcactttctttccagttcccctcctgggagtacatcccaaaagcaagtgactaggtatgaaaagttatccagcaagactccaagatgtacataaggaagagatgtcctttcctgactctgccttctgagtgttgagcctctgcttcatcccaatttactgacataggaatgactgtcttctccagggcagagaggccacatctcctcccccctcacctttgcaggcctctacacttccatccagatggtgcagtgcagcctgcgtgggtccaattctgtcatcgatgtggtgttttgataccgcagcagcagataagaccggataagggttaggaggaggaaagcactgctgatcatcttatagagtgtcaaagcagtacagctaaattgcacagcaccttggcagccttggggattgttgggggactgttgtaaggtcacccatacagaccttcagggcaatcattttgaccttgagactttcagacacgttctgaacaggctggtcaagttcacatcaacctcacctgtgtattccatctgcaagaccagacgaatgcacatgtgctttatgcacagataggaagagtggccatgcctgagagtgacggcagattgaagccctcatagcatacatccagcaggtccctggagcccatggtgatcaggcatccagggaagctctccacccaacccagaggcttactgaccactctatcatcatggccttcccttcatgtatccctcccaccaccatgcccactaccacactggcattgcccacccactatctcagaaggacagacttggggccacctcttcaggaagcctttcctgaggatactggagatctatgggttccaacagagagcaaccttttcccaacttacccacatgcatttgtccttgtcggttacacagcgtgctcctgatggcagggacttggccttaacggtggagcatatggctggagcgtagaaggtgctacaaaaggtttgctgaaggaaagaatgaaccggcacaattatgagcatccccattgccatagaatcctagagtcctggggctcagtctcacagttgtgtctccacaagtctccctagcacctcgtcaatgctcattttgacgcttcatcacatagagactgtgggcagtctgacttttgcacctccccagccaagtcatatgcttcagggggacgcgcaccatattctcctctcccctgtaactctgtggctgaataaatgctaactgcttagccaacactggctggcttctaggagaaatggatgcgtgggtaataagctattcatttatttcttgggggcactttattctgagaccctacagcctgtacactgcgtcttttccggaagcaatgatagccagccatcaagggcaagtaaacgcatttgacctttcctaccaaaaagaaaagttagttaatgtacttcaactctcatctgatttctgcttcacttgtgcaaggatgctcaggaatctagagtaggaagaaaaaccacagtgctagctgagaagcacttaccatgtccccaaaggttactgttccttcccccattgctgtctggctcttgaaccccaaatcagacttgcacaaagcctttctgcttcagagtgcttgttaaattgacttttctttctttcttttttttttttgagagggattctcactctgtcgcccaggttggagtgcaatgatgcaatctcagctcactacaacctccacctcccaggttcaagtgattctcctgccttagcctcctgagtagctgggattacaggcacccgccagcatgcccaactaatttttgtatttttagtagagatggaatttcaccatgttggtcaggctggtcttgaactcctgacctcaggtgttccacccacctcagcctcccaaagttgggattacaggcatgagccactgcacccggcctggtaaattgacttttctaaccaggcttgtaggttcctcgcaattgaacactccaggtaactgccacagcacctggccaactgtcaagcagtcaacgttgctgttgctgctgcatcactgtcatcaacaaggtttgtcattgcaggaagtctccaaggacccccatgaaacacctgcatttcctgtcatgattttgaggctgaaatcatcttcctcctcccagaacacctaggtgttctagtctgaagccatcctcactctcaactcccctccttcgagccctcaccctgtgcctgaattcttccttctttgctgggacagatggacaggaggaagacaggaagtggggaaccccttcaacaactcctatggcagaggggagccataggagatgggccgggaaatgtaaagaccagcccacgcaggaaaaaaagagaactttttagcacagtgtcatctgaaaatgcaagagaagagaggctcttggtggcaacagaggagtgtgacttccagcctcagggctagcacctgacccctgctctccgtccacatctgaaaaataccactggccctgagaatccattgcaactgaggttctgcaccccaacagctgcactcaagctgccaactgaagcagagagcactgcccgcactgcagggttgtgcctgtgtgccccgctgcctccaggggtggctgccttctgccagagaatggacagctgacatcctgaggacatagagagttagtaggaatgactgtagccaatggcaaatcccatggatgaaaagccactcccaactccacaaagatgagcatagtgaaggctgcagtttagttggttcgtggttccccagaaggctttcaaacattcagcagttgtcattcagtgccaggcacccagtctaatgctgagtatagagttgtgagcaagacaagcctgaacgtgtggagcttcctgtctggtagggtgttgcagggggccggggggaccttgcaacctggaggagggctgggaagaaaaaaagtaggatgcttgggtctttccaaaaaataggtcctctcatgtctgtccaatcgttgtgctgggtaattgtctatttctgataccagacccaagcttggccgtaatcaacaccttattctgccatgaacccacccccaaggctgcccgcagatcacccccatcctagttgctgagctcagcatgatcctaatctcaacctcagaagtatccctcagctccagcaaggggcaggctttcattccaggccccttaagctggatgcagaccaaccacctactttctgggctggatctgagctcactcagccagtcttctccaaagacctgatatcactgctgctagctgaatgggtacagtgtaagggagtgcgccaaggggggctctcacccctccatctccagaggcttccggagccttggagccgtggatggcaagcagacactggggagaaagctgagaagtggggagagctgccttagatgctgagctctctgcctggaatgcttataggctttgtgcagcaaactcctatttgcccttaaaggactaatcctgatgtcaccgcttctggaagccctctttacaccagcacttcccagcctacagcatgaatcagaatctactatagtaattactgggtcccagtcctagtgtttttcttcagtaggtctgggctggggcctgagaatttctatttctaacaggctcccagaggatgctgtgtatccagagactatgctttgagaattgctgtctcacagcatccgcaccttcccagacagccttgagcttcctctctatgctgattctgatctattaatatagggcagctctggttgggctgaaatgtcactcccctggagtctgtcacattgtgaaacatgtgtaaattcagctccacacacttggtggggtggggggcatggagagagtagttccagctgagggaactttcctgcccaccacgctcctcagagggcatgagcttggagggagcccacattgggaggcccagctggcaatcccaatggtctcccaatgaggccccgaagctctcaggtcctacctcccctcccagcctggctgccctgctggaagtgtgtgtagtctcccagtatacagatttgagtacaaggtccctaaccagaagccaagaaatgcaccccaagttgttcaagccaaatatctcacctggaaaccagcttaccaaggctctacactttgcagtgccctgtaaggctaaacacactgactcaaggctgccagggcttcaaatgattgacttctgactctcaaggtacaagccggggaaaataacacttttctgggacgcagctgccaaatctggaaaatggggctaataataactcctatcgaatggaaatgttgcaaggtctgagttaaaatacattaaatgttgagagcagcacctggcatttagtatgaaattattaactgttttaaaggaagggaaaataacagtcccttctaaccctgattgtgttggacaaactgtcataagaaatgctggtctttacctggaaaatttctaagggcagttctgggtatttgagcttctataaccatccatgcctacttaagcaagatgttattctttctttccgaactttgaggtgcatagtggttagaaaagtctagaactccaccactaaatccattcatttatacatgcatgcatttactcatgcattcagtgaatatttattgagtacctactatgagctagatactaaattggaggctgcacttgttcactgtaataaagtctagcacccacttgaacttgctatggctcctgcttcaggtcttgctactgagaagcactgtgaatgctggatcctctaccctgcctggttcctggttcccaaggtgctgactccagacccagagttcactgggtctcttggcggcctcagtgccttgtattatcttcttccccacctccaagctccttggtggccccagacaccactagcttggcccacctgcttcctgctgtggacccctagctgggagtctgttttcccctcacccactatgactcctgactccagcaggcagttacttataagaaagaggcatctggcagctgcactggggagaatgacctcatagcactataattaaagtgatcatctgagtggaaatgactattatgaagcatccttctctgttttattatgtagagccattgtaatgggaatacgggatttcctatgttaatgctgatatttctgtgatccaataaatccttcttcacaatcatctcccagaggaaagaaggcattctgtgcagcagctctaggaaacatcaggtccccaatgtcctagacatcctaccctctttggccaggccattaagctgtgaaaaaacacactcagtaacttggataatgtcatagagtggtccttcccacagcagagtcaatgtaaagacctatgggagggcttcaggaatgactcctcagacaggagccctgggaagggcttctgcaagagagaaagtgcactccagaggcaagagcactggccaagtcctgacctgatatcggatgagctgtgtgatcatgggcacatcacgtctctgagccttggtgttcttcctgtgagatgggccaataacaccaggcacctcataggatggatgtgaagactgcatgatagagtagatagaaggcagttaaagcaacacctggtgctatggtttggatgtggtttgaccctgcaaaagctcatgttgaaattggttcccaaggtggcagtgatgggaggtgggacctagtgggggatagttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagcagtatgaggccctcaccagatgcagctgcccaatttggacttcccagccactagaactgtgagccaaacaaacctctcttctttacaaattacccaagtattcagctatagcaactcaaattggactgagacacctggtgtgagcatcagacactccacaaacattctttcttaaacacaacaagagtccctgccttcatacacagcacagatatctgttgagcatctaccacatgcaggcaccactctcagtggaggcatactgcagagaacttaaatgggcctggagtgacctggtggttcaggttcaaacagttccatcccagtcagtgaccaagcagaacctggttcctggtctgtgcacccctgctaggagtcggtgggtgcaccacactgtctctgtccacttgaacccattctcagagctgctcacacctgagcaaaggatgcagcttgggccaaggtgctgctaggcatggagagtcttcctctctgacctcagattcttgtcctctgttcacagagcctgatccggggatggcctctgcctccaccacaatgcatactaccaccattgcaggtgagttctcatcacagagcctcaccataatggaaactgccgtgacttcagatgagctctcatcacagagccctttaagcagccagggttgggggacttggtgaaaacatccaggggagaactgacctaaggacttggacaggggtggctgtggccattttttctctccctcagaggtggttttgaatgtggaatggaggagtctacccctgggtaaataaatatacataggtatgtcatatgtatctgtatttatatttattggcctttctcagggctgttgactcacaggaactcaggagctggagaggcagcagttttggtgagggaggttgagggtggaggtgagatgagggtagactgaccaggctacttagacttctccaccgtctccctcatcccacattattttcttccctgggtccatgacccccaaccctccatcctcaaggaaacttgagcctgcctttgccttgctttgaaccctgagcaacgggctccccatgggtcatggctgtgactgcaaattgtgtttgaagaacaaccaagtttgggaggtgctgtgtgctctgcgaccttctttgagatccacacttctcagcagcttattaataactcaggaaacatcgagaaggtgaggagagagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacagaggcttgctctgcagcttcaaagtaaatgcccaaactcaaaacacccccaccccatgagactgctgccccctcactctcaaggtcctgagtgatctgacccctcctgagcagccttacactgtacttccccacccctctggagtcccagcagaagtgaggggtgactgcccctcgcacagccaacaccttggcattctctgcgttaccctctcccacttcagtcctttgtgtggccaagtcctgctcctcctgcagactcaccccagtcctcaatcgccaggagggaatgggagcagggtaggctgaggagcagtcatcgggccattgaaaaacacaaaccacacaacctgccccaagcacagttaatagcctcatttttccccctgtatagtgtacatacagcaaccagctctgccctgttttctgggacttccctggttttagaatgaataatctccaagcagtgttcttgcaactgttgcaaggaccatgttaaattgctttaaatgttgagacctgcacctggcacctagtaagcgattgttagttgttttaaaggaagaggaaataacagtctcttctaacgctgattgtgttggacaaactgtcctaataaatgctgtcttcacctggaaaatttctgagggcagttctgggtatttgagcttctataaccatccatgcctacttaagcaaggtgttattctttctttctgaactttgaggtgcttgttgattggaaaagtctagaaccccaccactaaatccattcatttatatatgcatgcatttactcatgcattcagtgaatatttattgagtacctactatgtgctagatactaaactggaggctgcacttgttcactctatataataaagtctagcacccacttgaacttgctacggcccttgcttcaggtcttgctactgagaaacaccgtgaatgctggatcctataccctgcctggttcctggctcccgagacccagatcctgagccagtgttcactgggtccctgggctgcctcagtgccttgtattatcttcttccccacctccaagctccttggtggccccagacacccctagcttggcccatctgtgtcctgctgtggacccctagctgggagtctgttttcccctcacccattatgactcctgactccagcaggcagttacttataagaaagaggcatctggcagctgcactggggagaatgacctcatagcactataattaaagtgattatctgagtggaaatgactattatgaagcatccttctctgttttattatgtagagccattgtaatgggaacatgggatttcctatgttaacactgatatttctgtgatccaataaatccttcttcacaatcatctcccagaggaaagaaggcattctgtgcagcagctctaggaaacatcaggtccccaatgtcctagacatcctaccctctttggccaggccattaagctgtgaaaaaacacactcagtaacttggataatgtcatagagtggtccttcccacagcagagtcaatgtaaagacctatgggagggcttcaggaatgactcctcagacaggagccctgggaagggcttctccaagagagaaagtgcactccagaggcaagagcactggccaagtcctgacctgatatcggatgagctgtgtgatcatgggcacatcacgtctctgagccttggtgttcttcctgtgagatgggccaataacaccaggcacctcataggatggatgtgaagactgcatgatagagtagatagaaggcagttaaagcaacacctggtgctatggtttggatgtggtttgaccctgcaaaagctcatgttgaaatctgattcccaaggtggcagtgatgggaggtgggacctagtgggagatatttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagtagtatgaggccctcaccagatgcagctgcccaatttggacttcccagccactagaactgtgagccaaataaacctctcttctttataaattacccaagtattcagctatagcaacacaaaatggactgagacacctggtgtgagcatcagacactccacaaacattctttcttaaacacaacaagagtccctgccttcatacacagcacagatatctgttgagcatctaccacgtgcagcaccactctcagtgcaggcattaggcagataactcaaatgggcctggagtgacctggtggttcaggttcaaacagttccatcccagtcagtgaccaagcagaacctggttcctggtctgtgcatccctgctaggagcagtgggtgcgccgcactgctcctttccacttggacccattctcagagctgctcacacctgagcaaaggatgcagcttgggccaaggtgctgctaggcatggagaatcttcctctctgacctcagattcttgtcctctgttcacagagcctgatccagggatgtctggatggccggatggcagaatggagacctccacccccaccataatggacattgtcgtcattgcaggtgagctctcatcacagagcccttcaagcagccagggtggggggccttggtgaaaacatccaggggagaactgacctaaggacttgggcagtggtggctgtggccattttttctctccctcagaggtggttttgaatgtggaatggaggagtctagccctgggtaaatatatatatacatgcatacatcgtacgtatctatgtatgtatttattggcctttctcagggcttttgactcacaggaactcaggagctggagaggcagcagttttggtgaaggaggttgagggtggaggtgagatgagggtagactgaccaggctacttagacttctccaccatctccctcatcccacattattttctgccctgggtccatgaccctcaaccctccatcctcaaggaaacttgatcctgcctttgccttgctttgaaccctgggcaaggggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacaggcttgctctgcagcttcaaagtaaatgcccaaactcaaaacacccccaccccatgagactgctgccccctcactttcaaggtcctgagtgatctgacccctcctgagcagcttcacactgtacttccccacccctctggagtcccagcagaagtgaggggtgaccgcccctcgcacagccaccaccttggcatcctctgcattaccctctcccacttcagtcctttgtgtggccaagtcctgctcctccagcagattcgccccgtcctcagtccccaggagggaatgggagcagggtagggtgaggagcagccatcaggccattgaaaaacacaaaccacacaaccttccccaagcacagttaatagcctcatcttttttccccctgtatagtgtacatagagcaaccagctctgccctgttttctgggactttcctggttttagaacggaaaatctccaaacaaggttcagtcctggggtatgattctaacgtgtctgcagagtgcttagagtggttagtagcagaactgtgaggaagaaaaagaaaagggagggaaggaaggagaggagggaagaggaaaggagaatcattttaggaaggcacaggttacagtgccaccacacaacaggttggtgaagcatggggaaggaatgaactggcctgtttggtgttggtacagttgtctccagtgtacacggttcaacttatgagttcttgagtttggaatggcgtgaatgcaaaagcattcagtagaaacggtactttgaattttgaactttgaccatttcccaggctggcaatatatagtatgatacactatattataaaatagtctctgggtcagatgattttgcatgactttaggttaatgttaagtgttctgagcctgcttaaggtaggctaggccaagcttcgatgctcagtaggtttggagtattaaatgcatttttcatttacagtatttttaacttattatgggcttacaggaacctggctcccatcataaatcaaggagcatctcttttggttgtggcattgtatctgtcctcacacaacccctgtgggtcttgaccaccatcccaggccccagagcccctgcctcagactgacccttgcacctcttcccacctgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggcgaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcattccgagtccaacagtattactgtagttatctggggaaagataaacgccacccagggcttgcttttcacctgtgcaatattatattctctgacggggccaggacagttcatttctggctcttgtgggggccagttcccagagagcacagccagtacaggcggctcccaagcctgccaagggaggaaggacaagtgaccagctttcctttccctacaggggcaccagctgcaggaaacaaaaggaagggtgaaatgtccctctagaaatagccgttcccagtggccagggcactagctgaagtgttgattttccaaggtgcagtattagaacaaatggacctgatccaaaaatatgagtgagtcttgtccttccaatcacagtgaccgtggcacccaggggtggaagcagaggctgcagagctccgctcgatggctttgggtcccagctcccctttcctggtcccaggaccttgaacaacttgtttgacccctctggcccccgtgttctcctccctcacgtacaaatgatgctgataatgacacctctgttgtgcctgactcccagcgttgagggtcaagtgctcagacctccctgtcttccagtgtcagcaactgtgtgcagcggtaaacaaacattcttcattgcactacttctgcacacttcctgaggagtagctgtcactcaaaatcacagagtaacaggaagagaagatgaactggttaaccatccccttccaggcgagtttttccaagattcccaacagctcagctgtcactccaaggaccagcagctatgaggttaaagactgcacgccaggtgctggggtcacctaggtactccctggggctcaggattcttgaggctgcaccatctccacttgggagttggcagaaaggtcccaaagatctccctgggaggattacggggaatgtgagctcagtggggggtccacctgtcagaggagctggcaatcctggggccgtggtgggggagatgagctgggagctcacagaagcagtgatggcagaagcctggtccaaaagtgagaccttttcctggtgacccgagctcgcaggccttcatctatgaaataaagggcttggctgtatctgcatggcccacactgatcttcagaacaccagtgtggcaaaaatggcgataaataggcccaatgaatatgcacaagtcagtttagaaaatgatgtatcatgtaaagtgaaagcagtgcaggctcctcagcgtcttcactggcccagtgtggatgctgacactggtgggaggggagctgtgcacatagcctttcccaagcatgttgaaccagagaccccatttgctcacacgatacctgctaggaactcgtggaccaagtggtcctcggagcacattttggaaacactcaggtaaatggtttctaacatcccctcctgtggcaatgccatttcaggtttttgagcacccacatcttccaggtttgggagcacagatcactgtccagtgagcacagaggaggcaccagaacctacacatagacactcattggggtgaaaaggctccagaagaggatgagcccagggctctcgaggcctcctagagagcaggtgcctatgtgggggaaggatgatggtaactcattcctttctccctcattgggcccaggggctgtctatactaagcttgactccctggccactcacctccccttcctcacctccctttatcctcactcttttgcctgcctagtgtcctggaaaacaattgaaacacagtctgctcccagtctactgggtccccagacccagccagaatcaggctcagcagcagtagtgatgacatggaagctgcagagctggtttgtcccaggtggcctagctcagatgccacgaggagggaactgttgcaggctaactgcagaggccagatggccacaccagagagcagggcaacttaaagagataatgcacacacacacacagagtgcacactggtggacacttgtgg

SEQ ID NO: 12788 - DNA, 36625 bp, Human
attttaaaaatttagccaggcatggtggtgcatgcctatagtcccagctactcaggaggctgaagtaggaagattgcttgagcttgggagggtgaggctacagtgagctataatcacgccactgcactccagcctgggtgacagagtgagactctgtctcaaaaacaaaacaaaacaaaaacctcctaaaatgtataaatagcaagaaaatgaggggcaaatgtggtaaaaaatataatggctaaaaagtctaaggaagttctttgtgtgcatcttgtaaattttctcagcatttcaaattacttcaaaataaagtgtttttttaaataacaaataaagcacaggctttggagtcaggcagtgtgttagtgtgagaacctagcctgacaacttcctagctgtgtgatcacgggcaaatgtttccacctttgtgagcctccatgttctcatctgaaaaaggaaccttaggactacgcctgcccagcctgcctacctctcggtgttgcagtaaaagttggataagggcaggaaaggcccttaatgagcatgtgcattaatcgaggtttttccagaactaacagggtatttatatttattttgaggtatttattttaaggaattggctcatgtgattgtggaggctggcaaatccaaaatcggcagggtagactggcaggtgggagacccaggaaggagttgctgctgcaagtggaggccaaggcactgcagccgaattccctcttccttgggggagctcagtctttagtctattaaggccttcaactgattgaatcaggcccaccaccttacagatgataatccactttactcaaaaaaaaagtctaccaatgtaaatgttaatcttatctttaaaaaataccttcacaaaaagatctaggataatgtttgaccaaatatctgggtacctgggctcagccaacttgacacataaaattaaccatcccagtatggaagggccctggtcccccactacatcttggagatttttgccttctctgtgaattattattgctgggccaaggcagctggctgggagtcctctgcgagttttgttttcaaagctctgggcacaggagttgcatgtctgtctcctttctggctcacacacttggggtgtgttttcttgcccttgcgaggctggacaagtgcctcatacggtccctcggctgtccacaagtgtgctgagaaactggacacacagaggttcccacccgctgaccacacgggggcctgtgtttacccagaagcagaccaaaacctgagtccagctaggtccctgctttgctgtgtgtccctgagcaagtcagttccctctctgggtctctttttcctctctgctgctttccctgaatgtgagttccctggccactgagaacagggggaaagggacagagcctcaaaagatgacctgtgcgcccctgcttctaagcactttgcaggtattatttaatcatcaagctaatcctacgagagagctgccattttcccccagcttacagatgggggaattgaggcgcgaagagggcaggcgatgtgctcaaggacagacatctagcaggtatgaagccctcacaatggggttctagaggctgtttagttaacctcaagttttggggagcccctgaagggctggtcaccacgctgccggggacagggaaagcctctgagcttgagtcagttttggtttccctgctggggtgcaggagtcagtaaaccttgctgcaaggggcggggaagagcatttgagcttaagttagttttggtttccctgccccggatgcaggagttggtaaactcactgcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccatagtgagtccagggctgaggttgggtctctgggaggcaggagattccacggcggcagcaaggccgagctactgggtgctgggtgcctattatgtgcgaggcccacacttgggtgggatgtggtgtaggagtctcaggctctggagcaggcgcttgctccagagctgtgtgacactgggcaggctacttaacctctctgtgcctcagtctctgactctgtaaaatggggagaggcataatacccacttcagagtatcgtaaggcttgagcacatcatgttcttagcaaaagactggcagtgctcagtgaattcactgtgattactcactgcgattttcttctatcctctccacagtacagaggagtaaacttagggaggctagagaactttgttcaaactacccaggttgccttgtggtttctccgcagcaagaaggagtggcttttatcagttagaaatatttggttttgtggacacaaatctcaggactgaggctgaaaattctggacctctggggaggaagggggactggggagatgccaggaccctagaattgggggcgtgggggtcctgatggcccaatactatcctcttagcctcctgagctgctgacgtcccttctctgctgctgccacactttttggtctctaccccttgcacacatccgctagtgcctcaataaagaaatctagacacgtggtgtccccagccctggcccaggccagcaagctaaggcaagtttggttaatagctattgtcagaactgggattttaagcctgggtaattggcttgagggcatgcatgtttaaccactacactatcctgcctctcaatttttttttcctcatggaagtaaaacagaaaaagtgcccagatcaaagtgtccagcttgataggtagccacaaacaatgtaactgtgtaacccccacccagatccagaaacaaaacattctcagccccccagagccctgggcccccgatccagtcagcacctccaaacccaggtaggcaatctcctgacttctaacagcatagacacgttttgcctgtttttaaacgttttacaattatagggtgaccaactatcccagttcatccaagattggggtgtttcctgggatgtgggactcttggtgtgaaagctgggaatgtaaaccaggatgcatgggtgaaccctacataaatggcatcatgggctctgtgtgctttagtgcgtggtttctctgacctatgatgtttatgaaatttatgttgtggggtacagttgtttatcttttcattgttgtgtcaattccattatgtgaatattccacatttgtccattctactgtgtttttttatttttacataattgtgcatatttatatggggtacatgtgatatttggacacatggatacaatgtgaaatgatcagggtagttaggatatccatcacctcaaacattgatcatttatttgtgttgagaacagttcagatcttctcttctaactattttgaaatatataataaattattgttaactatagtcaccccattgtgctatcaaacactagaatttatcccttctatctaactgtatgtttgtatccattaaccaacttctcttcatttcctcctctacttcccagcctctggtaactatgatcctactctctacctccatgagatcaactttttttaacttccacataaacacatgcaatattgtctttctatgcctgacttatttcatttaacataatgacctctagttccatgcacattgctgcaaatgacagaattccattctttttgtgtctgaatagtattctattgtgtatatatactacattgtctttatccattcagctgctgatggatacgttggttgattccatatcttggcttttgtgaatagtgctgcaataaacatgagggtgcagttatcccttttttggataaatacctagtagtgggattgctggattgaatggcagtgccatttttattttttttagaaacctccatactgttttccgtaatgactgtgctaatttacattcccaccaacagtgtgtaagattccctttactccaaatccttgctagcgtttattttttgtctttttgataatagctattctaactggggtgagatggtatctcattgtggttttgatttgcatttccctagtgattagtgatgtcaagcattttttcatatacccattggccattttgtatgtcttcttttgagaaatgtctatttaggccctttgcctgctttttaatgggatgggttgttttctttgctgttgagttgttcacgttccttgtatattctggatattaaacccttgttggaaaaatagtttccaaatattttctcccattctacagcttgtcttttcactcttgattgttccctttgatgtgcagaagctttttcatttaatatagtcccaattgtctattttttgtttttgttgcctgtgcttttgaagtcttagccacaaaatacttgcatagaccaatatcatgaagcattactcttctgctttattctattaattttatcatttcaggccttatgtttaactctttaatccatttttagttaattttttataagatgacagacgggggcctagtttcattcttctacatatggatatccagttttcccaacaccatttattgaagagagtatcctttccctaatgtgtgttcatggtgctttctcaatcagttggctgtaaatttgtggatttgtttctgggttctcgattctgttcctttggtctatatgtctgtttttataccaatcccatgctgctttggttactatagctttgtagtatattttgaagtcacgtagcatgatgcctctagctttgttctttttcctcagtactatttggctatttgagatcttttgtgtttccatacaaattttaggattgttttttctatttctgtgaaaaaaaatgtcactggtatttataaggattgcattgattctgtagattgctttgggtagtatggttattttaacaatattaattcttccaatccatgagcatgggatgtctttccatttgcttgtgtcaccttcagtttcttttatcagtgttttgtagttttcactgtagagatctttcacttccttagttaaatgcattcctaggtatttttgttaaatactataagattgctttcttgatttctttttcagctagttcattactgatgtgtagaatatgttggtattttggtatgttggtatggtatgttgattttggtattttgattttgtatcctgcaactttaccaaatttatcagttctaagaggttttcttggtggagtctttaggtttttctgtatagaagatcatatggtctgcaaagaggggcaatttgactttttcttttcctatttggatgccttttatttctttatcttttgggattgctttggctaggacttccaggatacaggctgaaagcctttcccaattcagtatgatgttaactgtgggtttgtcatatatggactttattatgttgaggtatgttccttacatgcctaatttgttgagggtttttagcataaagggatgttgaattttaccaaatgttcttctacatctaccaggataatcatatgatttgtccttcattatgttgatgtgatgtgcaaatgttcaacatttgttgacttgctcatgttgaaccatccttgcatccctgggataaatcccacttgatcatgtgttatcttttcgaagtattattggatttggtttgctagcattttttgaaggtatttgtatctatgttcatcagggatattggcctgtagttttcttttttgttgtgtctttggtctagttttggtatcagggtaatgctgacttcatagaagtggttaggagtaattccctcctcttcaatttttttggaatagtttgagaagaattggtgttaattcttctttataagtttggtagagttcagcagtaaagccatctggtcctgggctattctttgttgaggagttttttattactgattcaatctactcactcactattggtctgttcaggttttctgtttcttcctggatcaatcttagtaggttgtatgtgttcaggaatttatccatctcctctaggctttccaatttgttcacatgtagttgttcatcatagtctctaatgaccccttttatttctgtggtatcaatggtaatgtctccttttttatccctgattttattttacttgggtcttctctttttttagtctatttagtctaagtagcggttcatccattttgtttatctttttaagaaaccaactttttattttgttaatttttagcctctattatgtttagttctgttctgatttttattatttctttccttctactaattttaggtttggtttattcttgcttttttgtttgtttttgagatggatttttgcttttgttgcccaagctggagtgcaatgacgtgatctcagctcactgcaacctctgccccctgggttcaagtgattctcctgcctcagcctcctgagtagttgggatcacaggcatgcaccaccacgcccggctaattttgtatttttagtagagacggggtttcaccatgttggtcaggctggtctcaaactcctgacctcaggtgatccacccgcctcagcctcccaaagtgctggaatttcaggtgtgagccactatgcctggcttttcttgcttttctaattccttaagatgaaccgttaggttgtttatttgaaattgttctactttttttgatgtaagcatgtattgcttcaaactttgctgtatcccttaggttttggtatgttgtgtttccattttcatttgtttccagaaattttttgatttccttttaaatttcttcatcagcccagtggttgtccaggagcgtgttgtttaattttcacgtatttgtacaatttccaaagttcctcttgttccattgtggtctgtatccattgtggtaagtatccattaagatacctgacagtatttcaatttttaaaaatttgttgagccttgttttgtgacctaccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccagtatttctttgctgattttctgtctacgtgatctgcccaataccaaaagtgagatgaagttcccagctattactgtattggcagtctctcggtctctgtttagctctaatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactctgtctgatataagtatagctactcctgcacacttttggtttccatttgtgtggaatattttttccattccttcacattcagtctatatgtatcttcacagatgcagtgagtttattggaggcagcatatagttggaccttattttttatccattcagcttgtctgtatcttttaactagagaatttaaaccgttgttaaattcagggttgttattgataggtaacaacttactcctgtcattttgttatttgttttgattgttttgtacattctttgttcttttctttctctttattgcctacctttccaattgttgggggttttgtaatgataacatttgactcctttctctttgtcatttgtgtatctgctctaccagtgagttttatacttttgtgtgttttcatgatggtagacatcatccctttgcttccagatgtaacactctcttaagcattttctgtagaactagtctagtggtgatgaattccctctgtttttgcttgtctgggaaagactttgtttctccttcatttttgaaggatagctttgctgggtatcgtattcttgtctgaaaggggttttttttagcactttgagcatatcatcctattctcttctgacctgtaagttttctgctcagaaatctgctattagtctgaggagaattcccttatatgtgactttatacttttgtcttgctattttcagaattatatgtttgtctttgacttttgacagtttgactataatatgcctgcagaagacattttggggttgaatctatttgagaatctttgagcttcctgtatctgggtgtctaaatctcttgtaagacatgggacgttttcagctattacttcattaaatagattttctatgcctttgcccatctcttctcctagatctttccaaatttaaatatttggttactttatgattaccaatatggcacataggctttcttcactcatttttatttatttttctctccttttgtctggctggattatttcaaaagaactgtcttcaagtttagaaattctttcttctccttgacctagtctattgttaaagcagtgagttgtatttttattttattcattgatttcttcagtttcaggaattctctttggttctttttagcaatatctatctctttgttgagtttctcattcagagcataaattattttcctgatttatttgtattgtttatctgtgttttcttgtatcttactgaatttctttaatatcatggttttgaatttttcttaaccattgcacagatatcattttctttgggatctgtactaaagaattattgtgctcctttggaagtgccatgtttcccttgctttttcatgtttctgtgtccttacattgatatcagcacagctaatgtaacagtcacttctccaattttatttattgactttcatagggaaagacattttcctctgctgggcatgatggctcatgcctataatcccagtgactcaggaggctgaggtgggaagattgcttctggcaggagtttgaggttacagtgagatatgattgtgccactatgctccagcctaggtgacagagcaagaccctgtctctaaaaaattaaataaaaataaaataaaaaagatgttttcctgtagatgtgtctatagtgttggttgagtggagcgctttggctttgattctgtgtgggcacagttagtggagcctccacatgatttcattagcatcagtgttgtctgtgagctcctcagtggctgacagtgtagttgttaatggagtctgtggaaaggctgtgctgggaacagggacatcaggcaggttggtcttcaagcaccagtggtgacagcagtatgccaggcatgctggtcctcaggcccccaggcagtgtatgtgggtgtcaatgctggtgtgtccaggtgggcagggtatcagacttcaagatgacatgttcgggtgccagtggtagcagcagtggactgaacaggcaggtccttgggcccccaggtggcttgtttggaagcggcagcagcaggccaaccctcaggccctcaagtggtgtacacaggcatcagtgatggcaagctgggtaggctggtccccaggcccttgggagacacatgtggtcactagtggcaggcagagtgggcccatccttaggcctctggatggtgtgtgcctgtgctgctggtggtaaagaggacgggttaatctcctggcccctgggcagcacatgtggatgctggtggcaggtggggcgagcctgtcttcaggttccctaatggtgtgtgcaggtgctggccgcaggtgggacagtttgacccccattcccccagatgcgcacaggcaccagcaacaatggcaggtgaggcgatcctatcctcaggccctgggacagtaagcacaggtgctggtggcaggtggggcagttcaatccgtttctattgccagcggccatttgagtcacctccaggttggggctagtatgaaaagtgttactatgagcatcccaatcaggtctttgtggggcaaatggatgcctgccactcaatgttaagaccatttttggcttttacttgagttgagaaataccactgcctgctagagatccctgtaaccccagaatctagtgtctcatatctgcttctttgtcactggcagggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagggggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccatactctgtacctgccttgaattctttcctgcatgagatccaagaaccctctcttgggatctgaatcaggaccctcttttccagcaacgctatcacctgtaaaccaaaagtatctgagacaggtctcaatctatttagaaagtatatttgccaaggtgaaggatgtacccatgacacagcctcaggaagttctgatgacatgtacccaaagtgctcagggtacagcttggttgtatacgtggtatggtttggctgtgtccccaccaaatctcatcttgaattgtagctcccacaatttccacatgtcatgggagggacccagtgggaggtaattgaatcatggaggcaggtatttcccatgctgttctcatgataatgaataaatctcacgagatctgatggtgtcataaaggggagttcccctgcacaagctctctctggcctcccaccatgtaacatgtcccttgctcttccaccatgattgtgaggcctccccaaccatgtggaactgtgagtcaatcaaacctctttcctttataaactactcagtctcaggtatgtctttattaacagcatgagaacagactaatacaatacattttagggagacatgagacatcaatcaatgcaggtaagatgtacattggtttggtttggaaaggcaggacaactcaaagtgggggcttccaggtcattggtagatttaaagattttctgattggcaattgatggaaagagttatcatcaatagaagggaatgtctgggttatgatgataaagggttgtggagaccaaagttttatcatgcagctgaaaactccaggtagcagacttcagagagaatagattgtaaatgtttcttatcagacaagagcctgttctatcactaattccaaaagagagggaggtatcatgaggcatgtccagctcctccttcccatcatggcctgaactggtttttcaggtcaactttggaatgcctttgctgagaggagaggtccattcagatgactgggggggcttagaattttgtttttggtttatatacctaagccaggattgtatctccagctcccccacctcctcactcacagcccatcactaagtcctgccagttctgcctaacttgctcctaaatctgcatcatttctctcccttcccactgctacttccctagtcaacgtcaccaccagggatggggcaatggcttcctaattgtctccctgcctcctgtctcactccaccctgcagctggtgctctctttccatgcacaaatattgtgtcacacactctgcctctaatggcttttcactgcatttaggaagttgaccaaaaaggccaaactctgtaaaatattttaagaggttttttctgagccaaatatgaggaccatgacctgtgacacaatctcagtagttcctgagaacgtgtgccccaggtgattaggttacagcttgatttgtatacattttagggggacagaatttacaggcagaaacgtaaatcagtacacataagatgtgcattgattcagcctggaaaggcaaaatgtctcaaagcagggtcttccaggtcatagatggttataaagatttcctgattagcagttagttgaaggagttcagcttaagaaaaggggagttgtggaagacaaggttcttattatgtagatgaagcctccaggtagcaggcttcaaggagaataggtggtaaatgtcccttatcagaccttaaagatgtcagacgattagttaaaatctctcctgaatcaggaaaagatctggaaggggaaggggattctccacagaatgtgaatttttccacaggacacagctttgcagggccattccaatatatgtcaaagaaatatattttggggtaaaatacttttgatttcctttagggcctgttatctgtcaggtgatgccagagttaggctggaatttggtgtcatactgctacaaagagtctgttctgtcagtcttggggtctctattttaatgttagtgtttgtcgattgtgcctgaattccaaagggaggagggtataatgaggtgtctgagctcccccttcccatcatgacctgagctagtttttcaggtttctttgggggttccccttggccaagagaggggttcattcagtaggttgggaaggcttagaattttatttttggtttacaaggataaggatcaaactcctcagcaggacaggactttgatgatctggcagcccctacttacttacctctccagctgtaccactcaccaccaactaactctctatgcttcagccactctggccttccctgagctcctcaaacccacatgatgctagctcaacttgagactttggcctatactgttcctttgcctggaatatacttcccccagccttttatttttggataactccaactcatcctttaagtcctctggctctctatgtctgggttagatccactttccacatgctccagtagcaatttgtgctttctgaatcatgggatttatcactttgcaaaccccaactatctgagacaggtctcagttagtttagaaagtttattttgccaaggttgaggatgcgcacccgtaacacagcctcaggaagtcctgatgacatgtgcccaaggcgctcagagcacagtttgcttttgtacgttttagggagacctgagacatcaatcaacatatgtaaggtgaacaatggttcactccggaaaggcgggacaactcgaagcaaagtgggacaattcaaagtggggagagggcttccagatcataggtagataagagaccaatggttgcattcctctgagtttctgattaacctcttccaaaggaggcaatcaaatacgcatttatctcagcagagggatgactttgaatagaatgggaggcaggtttgtcctgagaagttcccagcttgacttttccctttaaccgagtgattttggggccccaagatttattttcctttcacaacttatatggaaataatgtatttagctttctcctctcctagactataagctccatgaggacaggtatcatgagtatcttgttcttctatggtctctagtacaatgttcattattaataatagttgttggttggatggatggatggagcatgatggataaatggatggaaggtaaatggatggaaaaatgaatgtagatggatggatggatagatagatattaaatatatgtatatatttatggatgaggtagatagatggatagtctcaagcacaaagtctcaagtacaggtgcacatataatcacaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaaaaaaaaagaaagaaagaaaagaaaaggggaggggaggggaagagaggggaggggaagggaaaattcccaagctgaaacttaagccatcattaaacaaatggggaaacagaaaagcccaggtcttctaagcccatggccagagtaccttccatcacctatagttttaaggaatttctgggttaccaggaaccatgaagaacaattagcccaggcatcactgataaggaggagacatacagacatcctgataactcacattcacagaaaggtggcctggcttggggaaacatgtaccagtttgggaggttggcagttctgagttcttatcctggtcctactactcacttatgcctgccagctgtacagtcagactagaaactagattccagggccattaggatgctcagggttgggggtgggggcctgcttcaaacaagggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggtaaagctgcacattccaaattattataagctcctttttctgcaaggaaacacagggtcactttctgagaaaagcaacctacaggggaattggtaacttgctttttgttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatctgtaaattagtaattgcaattgcacttgccagctaagagttttgtgaggcttgtatgtttcactgtacataaaaggcttagagtaaacacaccataaacgttagctatttattatcattatgggggaagatagaatgctctttccgtcaacctccctgcatgccaagtgcccagaaccatgcctagggagtcagtaaatatccactggggtgtatgaaaggaacaagctagctgctttctcctggtttcttatctaaatgtgtttatgggccagggagctggctcacgtctgtaattccaacactttggaaggccaaggtgggaggatcacttgaggccaggagttcaagaccagcctgggcaacaggcttttttttttctccaaaaaaaaagccaaacatggtggcacacgcctgtggtcccaggtactcagaaggctgagccaggaggatcacttgagccttgaaatatatttgagggtacagtgagctatgattgtgccattgcggtccagcctgagcgacagagaagactctgtctctaaaagtaagaataatgatgaaacaaactcagtagtcctatagaccattttttgtttgtttttgtttctatttgtttggttgtttttttgtgggggggagggttgttttgttttttaatgaacatagaaattgacccttctgatcttaaagcttgaaacttacatttgttttatctaagttccttcctcagaaaaggaacctcagacctctcaaaaagtatcaaagaactgaaactcaccagtcactgcatccagacaatgggatgtcaaatcccttattcctcatgattacctccttacccctccctaattcccgttttcccacacatagttacatttcttccctgctatatagaaccctaactttagtctgtcagggagaaggatttgagactgatctcccatctcctcagctgcagcacctgattaaagccttcttcttggcaacacttgtttccgccattggctttctatgtggtgagcagcaggacctagactgaacccctggtgtttcagtaacagtaatcaatcaataaatgtgtttattttatttttatttttattttgagacaaagtctcactctgtcacccaggctggagtgcagtggtgcaattatggcccagtgcaacatccacctctcggggtcaaggagttcgcatgccttagcctcctgagtagctgggattacaggcacctgccaccacgcccagctaatttttgtatttttagtacagacggggtttcatcatgttggccaggctggtctcaaactcctggcctcaggtgatccgcctgcctcagactcccaaagtgctgggattacaggcatgagccaccgtgcctggctaaataaatgtgtttataaacagtggaactcagctagcaagaatggaaacccattgattaaaccagcccctgtccccagacctccagggccctgctgccaccttgcctgcctcctcaaagtccctgtaccctgacattctgaagtaaaatattcacaggatggactcaatgacagaatatattgcatgtaaaatataaactttcctttcttccagatgtatgctaactatgccaacacaaacaattttttaaagaacccacttgctccctactaatttggataattccctttctcgtttataattccatctcttgtccctccattaggttctgctgatcttgtcttgggttaacaccatactgttttcattacagtcagtttagactacactttattatctaatgggccaagtcacccttccctactatgttttatgtaaaggtacctgtcctctgaccgattaagcaagagtcgtgtgctatcaaactataactgaccttcattgtagagcaaccctggctctctaaaaccaggttacataaataacaacgttccaatttctgtttcacatcaggcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacaggtaattttccaactgtctatatatggttatcattcatttcctttttatcgagataattgacatccagtaaagtgcaacaatcttaggtatacagctcaacgcattttttacaatcttaccagcaacacccaaatcaacatagggaacgtttcgtgtaccccagaaggtgcctcaagcccattgtccccctagtaatcctcccaaacaaacccctattctaacatctattaccaccgcagattagttttgcttgattttaaacaaacaatgtaagtgggattatatggtacatacttcatgtctgcctcctttggctcaacgggatgtctgagagactcattcatatggttgcagggtcttgctctgctgcccaggctggagtgcagtggtgggatcttggctcactgcaacctgtctcctgggctcaagcaatcctcccatctcagcctcccaagtagctggaactacaggagtgtgccaccatacctggctaatttttgtattttttgtagagatgaggtttcaccatgttgcccaggctggtcttgaactcctgggctcaagctatgtgcccacctcagcctcccaaagtgttgggattacagacatgagccatggcacccagccatagtagcactttttttcattgttttcccatattcaattgtattaatgtaacacacatttatccattctgctgctttgggtcattttcaaattggggcaattttcaaatagatgattgggtcattttcaaattggggcaattatgaattaggttactatgggtatttccctacatgtctttttgtgaatgtaagcattcatttctcttggataaatatgtagcagtagaattgctgggctatccagtgcccatatatgaatgttgtgtacatatatgcgtgtaaatatataaaatatatatgtagtttgtttttttgtttaaccatagcaaatcttgccgaatcatttccaaaatcttaccaaattatactcccatcagcaagatgtgagtttcaggcatattctcaaacccaactggggatctgcccacccagcgcagcaaagccaaacagactttgggattgcagtgagagagtgaagcatttattgcagggagccaagcagggagaattgggcagctcatgtttaagagccgaactccccgatggcttacaggtaagggttttaaaggtgaggggacagaggttacaggcaaagccataaatcaacacgtggaggctgtacattggtttgacctaaaaaggtgggacgtctccaagcaggagggaggaggaggatgggtggcgctggtcacaggattcaaagactttccaatttgtgatgggtgaaatgggcgaagctttatctaaaaatttcagatcagcagaagggaacgttagctctggctcgtaggtgtgacctcctccaaaaccctcaggaagaaatttagaacaaagaacgaggtcagggttcaatcctcagtttcccctcatctgaggtctacctgccagtggatttgcttggtgggggcctgagtttctgaaaatcaactcagggacatatgctaagatgttatctttagtttctatagggaacaaaacatcttttgactctaacttccttggctactgttttaagtgactattaccttcttttttgttgtttttgttttattgggttttttttcactgctcctgtagaccctgaactactgtatttttgcttatcgagttgctcattgacttttcaaggctagtaaggtgcctggaatttccctcgaaagaactccagattttcctttattttcatgcttgtgggatgggggcagtgggtggcctgcagacacctaagagaggtccctgctccatcccagttgttccacatctttgtcaagacttggtattgtcagtccactgaactgtaggcattctagcaaaggacaatgacttcctgtagacctctggtttcttgatttcagatccctgacatggtaagaactagatccccaaatgagctgctaccctttccttatcccacagtgccagaaaaaaatcaaggatttaccctcgctgtctccgtatgccctggagctgcttacggtgtatgcctgggaacaggggtgcagaaaagacaactttgacattgctgaaggcgtcagaaccgttctggagctgatcaaatgccaggagaagctgtgtatctattggatggtcaactacaactttgaagatgagaccatcaggaacatcctgctgcaccagctccaatcagcgaggtgccaagcttctcacaccctatccctgtacctcatcatccgcatgccaggcatacctctttggaatgagatctcagccttgccctatcaagccagtgctggaccagaagaatggcagccaccatgggtggggaggcagatgggtctgtctgaaagaggggaggtccagccagtgcttttcacattccaaaccatagtcacattttgtcccctaaacaaacactggagagacacttccccttatagaaggaaggagctaagagagaaaggggatggggggcaggaagaggagaccactttgttattttattaatagaatgtctctgtaaagcagcaaacccagggccagaggggcttgatgtcgtagacaaaatccctcagcagcttggaggagctgcaggaatccaaattcaagttgccggattcccactccaggcctctttccccaaaacagattttgcctcccacaagcagctcaactgactttttttaatctaatggaatacacaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctggtaagagggttttccaaatacagggtgtttcatgctgcaggaaggtcttcctgacacccaggctaggtcttatctgagagtactctatattcgtttcctgtattgctgttacaaagttccacaacacagatggcttaaagccacagaaatttattctcttaccattctggctattacaagttcaaaatcagggtgttggcagagccaagctctctgcaggccctagggaagaattattccaggcttcctgcagcttctggtggttgccagcagtccttggcttgtggctgcatcactccagcctctgtccctgaggtcacatgcccttctccctacatgtcttcacatcaccttccctctgtgcatgtctgtcttatcatcccctcttcttctaagaacaacagtcatactgaattagggcccaacataatgacctaatcttcactagatcccatttgaaaagacactatttccaagtaacacacattcatcgatactgtaggttggaaccccagcatcttttagggagacacagttcaacccatcacacaccatcagggcaatgactgtgaagtgcaaaatggaacaaagagaaaggggggtacccaaagatgcgagatctcaattaatttttgcaagagagaaagctggtgagcaggtggagacatgaaacggagcattgctcagagaagggggtggcagtcaggcctgtggatgccaggacaggctctgagctccgttcaggcaggtgccgggggcaacagtcagaagtgcggccgaaacaagagaaccaattaaggcaccagctgtgaaacaggtgcactggccttccccctcccatccccaaaaggagaagtaaatctgtcaacacaaactcccctgcatgctcagtgcttattagagaaaagccatccaagaagaaccttcccaggttagaccactgagccctctcagctttcctgggaaccgcactggagacaactgtattaattgaggccaaagaggccaatcaaattccacagttcacagacagattaatttatattcaagttatgggaggcggaatctataccccgtttgcacagaagtttgaaggctaactgagtaccaatctggcatgtaaatgaagatgtaaatgagtttagcaaacttcacagaggttggggagtctatgaatggggaacttccctaactggacccagaaggatcaggacgctctgagcagtcacccctgtgcccaccctaacccctactttcactggacccctggtctttgctctctgaccccaattttcccggcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttatagttgtttttaatctttttttaagagatggggctataactcgctacattggccaggctggtctcaaactcctgggctcaagtgatcctcccacctggcctcccaaagttctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatattattgtcccaatacagcccattgggatgatttcgacagtcattccaagaagggcctttataggacattcttttccaacccagaagcacatgtggcatttagttccaaacatctcctaaaccatcttttgatactcactgtggctgtttttgttctgctatcccatcaacttctattttgagaactgtgagaccatccctgtctctgcagttgttgaagaaaatttaggcccaggaaccactgcataaggcggtccaaacattgggggctcatgcacacatacacacacacacacacgtacatgcatacacaaacatgcacacacacactcacacacatgcacacacatgtactcacaccatgcacacacgcacacacgcacacacatacatgcatacacacatgcacacatgcactcacacacatgcacacacgtactcacaccatgcacacacatgcactcacacacatgcacacatgcactcatgcacacacatgcatgcacaccatgcacacacatgcactcacacacatgcacacacatgcactcataccacgcacacatatgcactcacacaccacaaatattctgccctgtggaaggggcagtgttggcaatgaatattccttcaataggcaccgtcctcagcaactataaggccaacttacaacatctgagaacaaccaaggttggccttcaactttcaagctgagtgcccttccccacctccaggtgagctagcccatcttgtctgtgttgccagcaaaagtacaatatttgtatagaacagtaattacttgcctcttactgctgttttaaaaaaatgccctaaacttagtggcttaaaacacatgaatttgagccaggcacagtggctcacacctgtaatcccaacactttgggaggctgaggcgggaggatcacttgagaacaggagtttgagaccagcctgagcaacataacaataccccgtctctacaaaaataaataaataaattagctgtagtcccagctagttgggaggctgaggcaggacgatcacttgagcaagggagatcaaggttgcagtgagccatgattgtgccactgcattcagcctgggtgacagaacaagaccctgtctcaaaattacttttgcaccaaccaaaaaatatatatatacatatatatacacacacacatatacacatatatatatacacatatatacatatatacacatatatgcacatatatatacacatatatacatatatacacatatatacatatatacacatatatacacatatatatacacatctatacacatatatatatacacatatatatatatacatatatatgcttcctcaccttttcaagctccttgaggttgtccaaatttcttggctcatggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcacgcctgtaattacagcactttgagaggctgaggtgggaggattgcttaagaccaggagtttgagaccagcctggggaacctagtgagactcccatctctacaaaaaaaaaaaaaaaaaaaaaaatagctaggcgtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggttggaaggctacctattgggttctatgctcactacctaggtgatgggatcattcatacaccaagcctcagcgacatgcaatttacccatgtaaaaccccacacatgtacctccttgaacctaaagtaaaagtggagaaaaatgtattaattaattcaattaaaaattaaaattaagaggaaaaagacccctgtgataacatcaggccaaaccaggtaatgcagaataatcctcccatctctagagacttaaccacgtgtgcttcagagggagcacagctgtgccaaaacctggactttgaactgttggcctccagaactgggagagaataaacttctgttgttttaagccacctagttgtggtcacttgttatggcagcctttggaaaccaacacacccgcacatggcgtgtttaacgcaggctgatacaaccttaagaaaggaatggatgtggtcatcagcaatctccaatacctacagcaaatgggaagacagggaaggaccagaggtgtaggtaaagcaaaaagccacaggtcattaggaagtgatgctccaactgggcatggaaaaggagtttggagttaggaacacgacagatctgtctggacaaggatccagatctctcctagggggaaggaggggcaactaggacagtttttgtgtctgtggggggtcttgtgtgccactccaaactctcaggtgtgttcttgggatgtatttgtgcaatgacaaaagacggaaaagatgccagcccacgagcaggagggcagttgggagaggcagggtagggggcccagtacaggcaggaaaagaagccttgggtgggcttacaggtgccactcacacttggggtcttccttccttccccagcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccgggtgagcactggcctttctcatgtcttgttggaatgatgtaatattgggcattcctggaagggaggtaagtgggcattgtagctctccaggatccatctaccttcagaaacttgaggaagggaagccaggagttaagggaactaggacactagttttcaggggggttgtggatagactgcctaggtcattaacaacacaactttgattctgtattgtttttcttggagctgttggccgtccttggggctcttgggcctggagacacatcactcccgtctctgcctctgtcatcaccttttcttctgtgtcctcccccttctcttcttttctaagaacacttgtcataggatttagggcccagcctgatccagaatgatctcatctccaggtccttaactcagttacatctgcgaagaccctttttccaaataagggcacatccacaggcccccagagcatgtatttttaggggtccaccattgaacccactgcagattctaaggagcttagaatctccttctcctttgagtgactggagcccggcttgccccatcagctgagctagagatttagaggcttttgtcattcttgtccgtggctcaaaggccacggggctgacatgtttctctctgtttactggtcacacgaccagataaacgtgtccccgtggtcacaagaagggaaggaggaaaatgttattatgtacgcgtaaatttctgcgttgatgccagaacaaatctgtgcaactagagaagaggggcctgggaaatggcaccaatagccccagggcaatgagtgaactgtctcattgaaggtcactggagtgaaaacaggactgagtttctgatcagtgttagaattgtcaaagcatgtgctttctcctctccttcctgaaaccccattcacatgatagtcagtgaaaaataaaaggtatatgacacatcaaagaagaaaagagagccatcggcagataagacattgctttccatcttcctgaagttggttgaaggtttctctgcttaggccagaggaaggtgacacctagagattgtaaggaaggggctacagtctgagaggagccgccgaagcccacctcttaaagacaaaggtggcctgcatgaatgaagggggctggaacagggatgaattgaggatctgcatacaggaaatagaacataccctttcctcacctccttaacccatgtaatcaggcatttaatacccatggataaaataaaacatttttctctacagaaactaaatggaggagaaagaggaggaagaggaggagggagggaagggagaagccttaatggcagagacataaatagcccacaaagcctaaaatagctactatctggcccttttgcagaaagtttaccaaccctgtacctcaattatggatattcacccaatgatcgccagacctgcaggagaaaacacacatcaaagaacagatgagcaccttcaccataattattgcattccgctcgatttatttggttacaggaatccaaataaagctaaatatgtctttaggaaaatctttaggaaattgacctgagaagcaggtaacttgtaactagcccatcagttgttcatgtataaaaggcaggagaataattgccttgggaactgtattgtttaataactgcattatctattagtttgtaaaagaaaaccctttgctttggactcagccctcactgaaccctaacgcagaacttggccttggaaacagtgtcagttagcccaactggtgccagcccacgggggcacgggactcctcggttaaggaaattctggatctcaaccttcctttcttccttagggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtaaggctccccagaccttagcttggaagtgatggtggacagaaggtggagggagagccacgtgacttgattacgggctctgaaaacatgtgccactcatgggtccctggccccagcaagtggcattagtcatggcagtaatacttcacacttgtagacaattttggtcccatttctcttttccaagcatgggggtgtgtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaataaataaataataaacaaagttagccaggcatggtggcacacgcctgtagtcccagatacccaggaggctgaggtgggaggattgcttgagcccaggagatggaggctgcagtgagctgtgatcatgccactgcactccagtctggggcaacagagcaaaactctgtctcaaaaaagcaaaaaacaacaacaacaacaacaacaacaacaaaaaaaaaaaaaaaaaaaaaaaaaaacaagaagcagcgcaccagatttagcccagggggcggtagttcacaaagtccagatcagtgtcgtcccagagatctttctgtgatcatgaaaatgttctatgtctgggttctacaactactgagagcttgacatgtggctacagcaactgaggaactaaatttttaattttcattccctttaatgaatgtgagtgcaaatggccacattgctggtggctgctctgttagtttaagtctagataatactttaataataccagctgcacccgtgtagaccacataatttttacatatctcattattctggagatgctccctgtgtcttagacatcagtcttttaaatatgctaatactattcacagtaatttccaagaattaaatcatatttgtcaaaaatgttttggaatctgttacttactatgtgtattaaagcaggatgtcaatctctccctcatgccaggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtccttgttctgaccatggggttattatttttaccagtaagccatgaacattaagccctgttgcccacaatctcccatgctgagggctgagccactttggagaatctgcccactggatatctttacgacgttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgccaataggacttttctgcttcccggcgcacatgctctctctcagaaggcaggttgaagctgtaggtggaaccggggctgcattttctatacacccagctcacaggagcttgaacaactggtcagcccctaagcccctactacaagtgatcctcaggcaggtaaccccagattcatgcactgtagggtgctgagcagcatccctagtctctacccagtttcccctcacttgcacacaaagtagcttctgaacatcctcatgacagtaaacatcaagcacgatatcagctcttcctgagatgcctcctttctgtgtccagctccctgaaatgtgaaaccaagaccaaactctgtagttttcatcccagaaaatcagagagctggcatggcgtgtcagaagacttggggctgtggcgtgaccttgagtgagtcactccacttcccgcagcttcaaagtcttcatctaaaatgcaggtcatgctgcctgcattgtggggaagattaggaatgatgtgggtaaatgcctgggcccatagctggcatgcagtgggtttctagtaaactgtagctatgttattgtcctaggaaggcatatatggtcaaaagcacaacaaagaaactcaaatgtgctgctgccaggtggactcctgtaggctgtacaatttagacatccaagctgcagagtgtgagcacaccagcacgacactgtgactcagttgccttgctgtggtccctgtgcggctctcactgagctcctaggctaaccagttcgtctgatgttcccactcttacctagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggtgccttcaccctagccccatacttttcttaacctgattcccttgaacactgtctcagcaacctggattttcctctgctggggtcacgattcattccttgcatgacgggggaaagtgctagccaacagaacctgtcacagtctccagggataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttattgggttagggtttatctactctttcagaccttcaagaatagtaagaaatcatatccatctgcttagggccaccagcaagggacaaaaacaatggaaaccagaggaaaggaaagagagaaaataaaggagcgttgaaaaagaatagaggagaagtaagagagaaggagacccccggtgggttgcctaccctgggttcttggcaacattgtatttgattaaattatgtatcatattttagctgacatagcaaggaggagatatttagactatgccttcattatgccttcatgagtatagcaattaacagctttcaaaacgcttttggcaaatacaatttaattctaggaagttgctttggttttggcttttgtttttgtttttgagacagagcctcactctgtcacccaggctggagtgcagtggcacaatctcagctcactgcaacctctgcctcccgggttcaagctggttctcctgcctcagcctccgaagtagctgggactacaggtgcgcaccaccacgcccagctaatttttgtatttttagtagagatggggtttctgcatgttggccaggatgttctcgaactcctggccctcaagtgatcctcccacttcagcctcccaaagtgctgggattacaggcatgagccactgcacacggcctctagaaagttactttgaaccctactagtaaatttgagttgctgacatctaagctgtaagaacacattgtcttattgctgaaagtattataggatggaccccaaattctgaagtcactgggatttggaatctcctaatgccttctaacctctcattcaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagccccctaagccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggttacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagacttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatccctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagagcattttcctgagttctatgagtcattctgcaaattatcaaaactgaaggaaagtcatggaaactcccaagtttgtaaccaagtcggacagaggtgtgggtagcctggggaccccatgtatggctggagtctgaaagaagggtggacttggtgaggaccttgctctttaaattgtgggacctacacacattccaggtagtcagtgccagacttgacttaaattgcaggacagtcagctggtgtcacagattaggtgttggaatgcaccactactcttgtccaggatgcaggcaaaagaaatatatatgaagatgttgaaaaatggaagaatacaggaaacaagcatgagaagaaaaggcaaaaataatttttaaaaagttttttaaatgataaaaaacatttaatgaaagaatgaccactttaagtacacatctactcagtctacaactagttaccagggccttctggatgcccaaacttgcactagatacataggcaggaaacacggaagcagaaactgtgagacgctgtccccatcctcacagggcttggctggaggaactggaacacatagccctaaatcccttaaagaaaaatgaagggccaggcttgatggctcacaccagtaatcccagcactttgggaggccgaggcagacagatcactagagattaggagtttgagaccagcctggacaacatgatgaaactccacctctactaaaactacaaaaaattagctgggcatggttgcagatgcctgcaatcccagctacccaggaggctgagacaggagaattacttaagcctgggaggcggaggttgcagtgagccgagatcgcgccactgtactccagcctgggcaacaaagtgaggctccgtctcaaaaaaaaaaaaaaagaaaagaaaagaaaagaaaaatgaagggcagtttaccacacgtgccaagtgagatgtatatgatgagaaagaccataaagaaaaaggtgagctgctcaaagccatacaaatgcagaacaggaccatttcagtttttctcatcaatgtcttctcagcactcagtagacatttaaattcattaagagcaaagagaataaaatgttcacagtaatcaagaaacatgcagtcatgggtcactactggaagtagctagggcaccaattctttctaagaaaattggcaacaaatggccctgaataggcaataattaaacccggcctttcttatacaaactgtatttcaggattaaaagagcagccataactgacgaggaaattttattattttttttacggaagaattccatttaataaatgtttaaaagatgacaaattagaaacatcatcattttgtaaccgtaataggtttcttgccctatgcacacagcaagtcaataggctgagacaccaggttgcagcagacaaagaggtttcattgtagggctgccaaatgcagagataggaggaaacctcaaatctgcctccctgaagagttggg

SEQ ID NO: 12789 - DNA, 12383 bp, Human
accatgaacagtcctttgagggcagggaccatcacagagtctggccagagtgggtgcttgggtggtgtgtttgagtgaatagaggaggaaggctggtccttgttctccctgagatgatttatttgatcttcaccttatcctataggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaattctttgttcttgccccctgccagggcaaaggggatacaaagggaggttctgtgccccagggatgatacataattgggcccaagtggttgctgactgctgtgcatgctacatttcataagacacagcaaagagagcccctgttgcccatgcatggagtgagtggcaggccctgtgttgagcacctttagacattcagctttgcgtaatccttgcaataactatagggtagtttaataatagactggttatctccacaaagatgctgaagtttcaaaaaattatcttgcctaagttcctacaactaggaaggtgcagagctagaattggaacccaggtctgtttgcaaacctggctcttcaaccagtatgctgaactgccaggggaagagtcaactatcgattcctacttggcccttagaggcctcaagtcctttgccagtggcatggcccaagtgtttcagcatcaatacagctgagaccttccccactgcttaaccggagacagagctgggatggagacggttgctctttgctcacccccaacctcagcaccttctttccagactccaccgacatttattgaaggaatgccttccaagtgctaggcgcctgtgggatggcatgcctacagataggaacagtcacaggaagaaggggcggcccaggccttgcagccactgaggactggcactgagacaatgatggcactggtctgatgttgattccatgctgacggtacactccgctaggtctctggctgggacacaagggtcaatccgctgcagatgttgctcttcaagaatttgcagtctgggcggggtgcggtggctcacgcctgtaatcccaacactttaagaggccgaggcggctggatcacgaggtcaagagatcgagaccatgctagccaacatggtgaaaccccatctctactaaaaatacaaaaattagctgggcgtggtggcgcgcacctgtagtcccagctactcgggaggctgaggcaggagaatcgcttgaacccgggaggcggagcttgcagtgagccgagatcgcgccatcacactccagcctaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtgagtgactgagcctgagaagcctgtcccctcggactggctcctgccgcctcaacactgcctggcatggggtacaaaggaatttgggggatgatggaagaaacccggggtacaaaagaggaaacaagcacgggtagccaacctgttacctttaatatgtctgtacagtgataattgtaaggatccagcggtataaccgatgcagaagataatagcacttgtttttctttttttgagacagggtctcgctctgttgcccaggtaggaatgcagagaggcccattccagcctcgaccccccgggcgcagcctcccgagtagctgggactacaggtgtgcgccatgcccggttaaatttttgtattttttgtagaggtgaggtttcgccatgttgctcagactggaagatagcactgttacttgtattagtttcgtacatggagctattgtaggataggagggaccccaaagggtgcaagaaaggaaattgagtgccagggttgtcatgtgccttgggctcaggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgagtacaggacctgggctggggttagggttcttggacataagtcacttctctatgactcagttttgccacctgtaaaatggggattatatctacttcataggcttttatgaggatttaaggaactaatacatgtaaagtgcttagaataatgccaggcacatagtaagtattattaccattattattatcctgctaatcaccatagtgaagtgacaaggattttgagcccattcctggttgtgtgacctagggcaagtgatttcattcattctgtaaatatatacaaagcatctgctgtgtgaccggggatacaccagtgaacaaaacagacccaaatgccagtcctcatggagcttacattgtggcctctttatctgtggaatgggatggtaactcagccctcacaagatgctatgaggaatgagaggtctggtgttgctttctctaacggtgctgactctcattctcctgggatcctcctggagttttggtacctaggatctgacctgtgggtgggaagaggccacacccaacagcaggtacctctcctaccccctgcatttctggtctccaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtgagtaggtgggtcccctgcccccaggccttccatcagctttcaagatctgttcatttctcccctggttaccttctcaaggcttcctgccttcccaaacacttcccctatccagaaccgccctgcctggtctgatcaactccagttactcatcctccctatgcatccctaaaatgtcagcacctcactggtctgtgctttttgcccaatgggttcaatgcctaatcagaaaaatatctgtatacaatgtacagtagtttggggttaagagcatgcattctggggacagacccatgcctggttctgaaccccaactctcacttgggcacattatttagcatctctgtactaaagtttcttcatctgtgaagtagaataataatagcacctacctatgctattattggagttgtcatgagggttgaagaaaggaatatacatactgcacctagcacagtgtttggcacacaggaagtatatgtaaaattcaagctggtatcagccaggcgcagtggctcacacctggctaacacagtgaaaccccgtctccagcctgggcaacagagcgagactctgtctcaaaaaaaaaaaaaaaaaaaaaaattcaagctggtatcattgtagtgaatgggatagttttgtatctaagaacacgtgtgttcttcacagtagccctgtaaggcaaatgttttacagaggcaagtgtatcgattggcagatgtgagaaccaagctaggacaagtgcttgggaactgcatagcaaagagacagactgcctcaaaacaggagaatgtttttggtgcttagaaacccattcctggccgggcgtggtggctcacgcctgtaatcccaacactttgggaggtcgaggcaggcagatcatctgaggtcaggagttcaagaccagcctggccaacatggtgaaaccccatctctactaaaaatacgaaaattagtcaggcgtgatggcaggcacctgtcccagctactccggagggtgaggcaggagaattgcttgaacccgggagcaggaggctccagtgaaccaagatcagaccacagcactccagcctgggttacagagcgagactccatctcaaaacaaacaaaaagaaacctgggtcaggcacggtggctcacacctgtaatcccaacactttgggaggctgaggcaggtggatcacctgaggtcgggagtttgagaccagactggccaacctggtgaaacccgctctctgctaaaaattagctgggcgtggtggcaggtacctgtaatcccagctactcaggaggctgaggcgggagaatcatttgaacctgggaagcagaggttgcagtgagctgagatcatgccattgcactccagcctgggcgacagggcgacagggcgagactccgtctcaaaaaaaaaaaaaaaacctggccgggcgtggtggctcacacccgtaatcccagcattttgggaggccgaggcgggtggatcacgaggtcaggagatcaagaccatcctgcctaatacggtgaaaccccgtctctactaaaaatacaaaaaaaattagccgggtgtggtggtgggcgcctgtagtcccagctacttgggaggctgaggcaggagaatggcgtgaacccgggaggcgaagcttgcagtgagccgagatcgtgccactgcactccagcctgggcgacagagtgagactctgtctcaacaaaaaaaaaaagaaacctgttcttgagtctcagctcctggcttagttagtcataaggcctcaagaaagtcattcacctcttccggcttctcttagcttgtttgtagaatgggaataacagtttctatctagaagggctttgggagtgaataaagcaatcatgaggcagtgtagtgtaatgggttaagagcacggcgttagccaggtggggtagctcatgctggtaatttcagcacttttgggagcccaaggtgggaggatggcttgagcccaggagtttgagaccagcctgggcaacatagtgagacctcatctctacaaaaaataaacaaaattagccaggcatggtgacacaagcctgtagtctcagctactcaggaggctgaggtgggaggatcgcttgagccttaggaggtcaaggctgtagtgaactgagattgtgccactgcattccagcctgggtgacagagcaagaccctgtgtcaaaaaaagaaaaagcacaggtcttggtgtcccagacctaggtgcaagatcttatctcccccatgtcctttcttaagtaagttaacctcttctaagccctcattttctccacatgtaaaatgggaaaacagcagtactgtcagtggggttcttgggaaaagtaagcatgataatatatctgaagcatgttgcctagcacttgatcatagaagctgttgctatattgtggttatttttttagatcatgagtgtgaacactctttcggaaaggttaaggaactcagttggggagctcctcaagggaagcaagtcctcagtccctggactagacttgggctccggggccaattcatagcaggtgctcagaaaacatgtgtagagggacaggacccaggcctaaccctttcccttgcacataaaagtgtccactatcccatagagggtggggaggtaggaggggaacttaggaaaagcactcttgtgaggtagagagctcacttactagcctaaggacaggaagaacttgaagatgcctgatgcttgccctcctcctcactccccgcagggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtgaggccccagggggtaggagctgccctctctactgacactaagaggagagcaggaaatgagccaagcctgggagctgggtggaggcttggcttccggaggcagagcaggaaggagaaaggatataagtagatgttttatgagagaaaaaagcagagtgcagaaagagtagaaaggatatagccctttgaatgaatttctagaaagaccatttgttcagatgcaacacatatatgctgctatatatatgcagcaatttccagaaggaaattgcaggaaactaaataatagtttccttgggggagacaaatgggaagatatttcttcttttcggttttttgtttgtttgtttgttttggtagaaataggctcttaacaatgttgcctaggctggtcttaaactcttgccctcaagcagtgttcctgctttgccctcccaaagtgctggaattacagggatgagccactgctcccggccacattttgttcctttcgtaaaatgacatgtactgacaaaactttttgcttgatgtcaatagggttaactggcaataagatgactggaaattaggcatttgtctttttttttttttttttgaggtggagtcttgctttgttgccaggctggagtgcagtggtgcaatctcggctcactgcaacctccgcctcccggcttcaagctattctcctgcctcagcctccagattagctgggattacaggcatgcgccaccacacccagctaatttttgtatttttagtagagatggggtttcaccatgttgggccaggatggtctcaatctgacctcgagatccacctgcctcagcctcccaaagtgctgggattacaggcgtgagccactgcacccagcctttttttttctttatacttctctgtagtttaaaaaatgaatttttgcttaaagatttttttttgatgggctttggactacagcctaacattaaatcttggttctgcctattctcagccatgtgactttggccaggtcacttcacctttcaaagcctcagttttcttgtctgtaaagtgggtgtggtaataccttcttcccaggttatgataacctggcccacataggtgttcagctagtagcacctcttattacagcaatttcagtgtattcataggccgcgcatggtggctcacgcctgtaatcccagcactttgggaggccaaggtggacagatcacttgaggtcaggagttcgagaccaggctggccaacatggtgaaaccccatctctactaaaaacacaaaaattagccacacgtggtggcacatgcctgtaatcccagctacttgggaggctgaggtaggagaattgcttgaacctgggagagccaggattgcaccagtgcactccagcctaggcaacagagcgagactccatctcaaaaacaaacaaaaaaaaagtgtattcatagatagtatctgttgattgagaatatagaacaacagtaaccccagagtgaaggagaaagcagccggctttggggctataagcaagatgctggccacatgctgcccttcttccacaagggctcattctgtgtctgtcaaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggtgaggaaagtgggctgcaggggctggcagtgggctgggatggtagaaacttctctctctcttagtcacctctccctcagaccctacttctgttgatgggtcacagaaggggtcagataacttagtctcatcacttctgatttaggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaatgcagtgaggagtggtagggaagcaggtgaggaggggacagggcagagaaactcccggttcagggagggaaggggagcaggctgcccccaagccctcccacgcagaggatcatgacccgaggtccagggccctagagctggtggggcagtgtgggggacagttctgtgcccggctccacgcagcagtctcgacagcaacagccagctgccggccctgcatgggaagacagaacagaggtggccgcaggggcaggccctccactccagcccgggtgcacctttgtggaccacccatgcccttctgcagagcccgctcctcacccccagccactggtgtcagcagctccccatggctcgccgtctgcccctgcccctcctggctggtgcccagctgcagtttcctcatgtgccgcaccacagccgtggcattgaaggcttgctggcattgaaggcattgaagggagaggggagaaaggacttttgagagagtcaagtcatggggcaggggcgcagtgggattcttgcaattgttctgttattttcattcaggagttattttattaattcccctaaagccccccaaaaacctctacaaggctttattatatatttacacacacacacgcacatatgttagatgtatgtgtatctatatatataaatagaaacataactataattcatattaatatgtaatagcaaacactatagcactgtatgtcaggcactgttctaagcactttacgtagtaattcatttaatcttcatgaaagtctttgaggtaggtactattatcattttcaaaggaggaaactgaggcacagaaagctgaagtaacttgctcaggtgtgtctctattcaatatctccacctaggtgtcccacacacccctcaaattcaccatgtctaaaactaaaaccatccccccaaaacatgtttctgtccctgtgataaccatctcagtcatggtaccaccaccatccattctgttcccagccacagtcttgggccagcccttgacatctctttcccccaacatccattgcatcgtcatgtcttgtcagtttcacctcctaaatgactcctggatcaaccactgttctctgccccctgttgctgctactgtggttccaaacccttaccatctcctgcctgtatctctgccacagcctcctaatgcgtcacccagtctttactccatgccattctctgcatcctgagagctctttcttttttttttgaggtggagtctcactttgttgcccaggctggagtgcagtggcgcgatctcagctcactgcaacccccatctccgaggttcaagtaattctcctgcctcagcttcccaagtagctgggattacaggcacgcaccaccatgtgtggctaattcttttatttttagtagagacagggttttgccatgttggccaggatggtcttgaactcctgacctcaggtgatccaaccacctcggcctcccaaagtgctgggattacaggcgtgagccaccatgcctggccctgagagccctttctatgcagcaaatacttgcctaagattcttctggggctcctcagtgccctcaggatcaagttggtgctcctctgtggcatatgaggccctaagaggcctggccccttacctgcttctctaaattgggctcctgcctctcagtcccctcagcccctccagtctggccaggcttagcacttgcacttcccggaatggctatagacattattccgctatgcctcactaattcctacttaactgacagctctgtcaggtcatcaccacttttatgacctttctcggaccccataggctggatcagatgcctcctgaagaattacagacttcttcctctagacttggaggtgagggaccctctctggaatagagaaggtgttgggagtgtttgttgaatgaaagagtgaatgaatgaagtccttcagtaaggatccctaagcagttactgtgtgcccagtgtgatg

SEQ ID NO: 12790 - DNA, 4876 bp, Human
gtagctgagcttcagtcaccttgccagcacctgaccaatgaggactagttaagggacaacaatcccctgtctgataagggaaagggtgtgagctaaaggagagtggaagaaggcaaaccagaattgggatcactgcaatgaggagaccccagaggtggccctgaaggttcacatgcacacatgatgaaagagccagactctcaactcctaaccccagggaacatcaatcaccagtctatggacactctgtatgtctcaccttcaaactttcccaaaaagagtatctgggttatttaatcagccactatcacatagaaaacactccagtggagtagagtagtgccaggccatctctcatgcagcaggccagtctatgaggggctgctttggacagaaactcattcctggtcatactattgtggctggaatccagtcatgaggggtgtagtatggtggccacactttcacaacccctcagacagagattgagagcatcacagtccttccaagtttactcagaatggggcagtgtatatagctggcaacatgcttagtgtattcaggacataaattagaggttaatgctattattgcatgtttcacataccaacatttcatatctcatctttctcccttcttatgtctggatacatctcaaccaattcaccttttaataatatatattgttttgtcatctcagttttttatttcctgtttcttgcattttattgagaatgcaaagcagatgctttcttacacttaattctgttttctggtgtaatttttcaagctattgcttacctttgcttcatgagttcagtagtttcttgttttgtgttcaagaattctaagattcatgtttgcttgcttctgtgttgtcttccttgaatgactaaaaagtccatacagactccgagtttatcatacataaggtcaatgactttcactttgtctctgtcaccaactagcaattagaataacctctcatttctgaagccacttattacatatttggtgtctatttggaagagttgtcctgaactgaaggaaaacgtattccttttatagcctgcttgtatagctatgaaatgatgcctgcacatttagaagtaatacgctttactagtggtaagagggtcctctttcaattcttcctgagcaatgggagcagtgacaaaaagaacctagccatgtaagagaaaaaaaaaaacacacagtgatgttaatgggacaagaacaattcctgaaaatatataaggcatatgctcaaagcattggaattggcagaagaacaatagctaagagaggctgtgtgcagtgttttctctgcagtttgatttctctaagtgggggaattcaatgggcagttatgagagtggcctgcattggatggaaatacttgaaggtctggggttcagcaattttgtggaatttcggaggaaagacttttcattatcatttttatttaccctcacactttggttgtagcatccaccactagctgccatgagaactgggaagatagggcttctgaggttcgctttggtactgcactcaacagagcagaaacatcatgcaggacgtgaatgaacagggaaggattcatctttcttgttgctcaaattttaggttaaaagagtgaagatgtcatttaaagaagataaggaaataagctaagtgcacctcagaaaaagaggaaataaacaacatggttatgaaatacatatgcctttttggaataatcaaatcacctcaggagcaggaatccacatttaaacatttccctacattcagatgtgatagcaaaccagcaagcaaagcataaacaaattctatagataggaaaatgacaaaatcaaaaatgagcttgggaaaatttgcttccagagagaggggttttcttgtaccagacagtggtggaatcaggaacccattctctacctggaaattggtacagagattcagagtctttgtccaggaagacactttggagtagaagaatgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcacttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctaggcctagaggttgcctgaggcacaggataaaagactcccgagcaattgatataattaataccagaagagagtattgctcttatcaatcaattcattgtgaatcaccataatgcaaccctcattcccttccatcttcgcagccatgtatttgtaaataatcaaccctttctctatccttttccactggtttcctttccctttcacaatcctcaggttggttccaacttgctcaagactgccccatctctccttagtccttgccaactctggaattgtacacctggtatattctacacaagacagtcaaaatcatggtgtccacacattactttaaccttcccatgactgccagttacttcacacatgaatatgaataccatcccacagaaacatattgcttgtaccctgaatgattcccatactaagccttcaattcacttttttagtcaaggagtctctctctctctctctctccctcactctctctctccccctctccatctctctctctttctctatcccctggctgtttctggacttttatctgatgacacaaatgttcttatttgcttctcttccaaatgccatgtctttatctctttaaaactcaagtcaaaatttaactctttcttcatttccattagccaaaacattatactcttccccagaatagcagacactttacccaatccagattcatccttaataattccccaaatattgacaatttaattgtgtcaactatacaactataaatggtttccattggctcaattcttgcctctctattgtattataacttgtattgtattattaacttgatggaacatctccatgttgagacatagttgttttatttcccatatacaacccagatatcagttaagaaccactcttagctcataacatttgagtggcgttggcttacactttctacacttttttattctgtccaaagccctcccaaaatgaataagaatatagaaatcacacagtaatcagtgaaaaatcacgtataaaacatactcattctttagacgttctttctgcctccctgtctgacacgtttctctcataccttcttcccttgcaggaccccatgcccttatctccaaggcatctcactcctcatttatctcctcttcaccctcaactaccagcagctatgtgtcttggtaatgtccaaccactatgcctttgggtctcagcctctgtccaccccagatacttattaaggtattcttcttaaagccagttgcatctcttacaccattctggtaccaagcgtaaataatgtgatgttttctaccctttgtatatattgggcatgtctggtgaactgatcttctagctctgccgttagaagattgaaacacctcctgaaagcaaatcatcctatggggcaaaggatgcaagtatctcaagcttgactgtgaaagaatggcttagtcctggaaaggaatggaaattctgatctgcttgtgggcttatcactctgatttgtctctgagtcaaattcatatttgaaactgaaggtgtgaaacataagtaaaaactgaaagaccacttttaccaaagactctgtgccatttggcatatctcagcagcattcctactgttgcacacagaggggagtgaagcatgctgtcccactccacagaagcaccctgtcagccttgcatctccctaggtccaatggtttcactgcagtagaaggtgggacaaaacctggtggatgcagtaatgactggggagcagagtcctaaccatgggtctgagaagaaaaaaggaaaaaaaaaaaggtagatattggcattgagttgactcccaggaatgcttaggaggctggaggggaggtgccttatagggtttgggatcctgctggaatagattgaacaagagccagtgaaattaggattctactgctatttgtcatttgcatccacatccagatgaggtcttgcatgttcaaaaacctcagatagctgaaataaatagaaa

SEQ ID NO: 12791 - DNA, 78846 bp, Human; identical to SEQ ID NO: 12396

SEQ ID NO: 12792 - DNA, 78846 bp, Human; identical to SEQ ID NO: 12396

SEQ ID NO: 12793 - DNA, 78846 bp, Human; identical to SEQ ID NO: 12396

SEQ ID NO: 12794 - DNA, 112507 bp, Human; identical to SEQ ID NO: 12420
  misc_feature (1)...(112507): n = A,T,C or G

SEQ ID NO: 12795 - DNA, 11085 bp, Human
agagtttagtgtacagttcactcattcattccaccaatgtttgctgaactgctgctctgagccgggctctgaacttaatgagcaaaactgaagatgagcaaaaacagccttggtcctggccttcacggggcaagatgacagtctcatcgggaagagggacagggctcagatggtcacagacataggccaacaagacaactgcaagcagtaaagctagaaagcacaaaaaaaggaaaaagggaaggcccctctgaggaagggagggtttgatctgtgaccccatggaggagacctcagccagtgctcgggaggaagaaacgcctcagtgtgggagggagaggggtttgggagaaaacccccaaaggccagtggctggaggaggaagaggaggcagagccaggctgccataaagggccggggccctggaagccacagggaagttgagcctctaacctgagtgaaaggcgatcagtagaaggggcacgatctgcgggggtgagggaggcaggacccacgtgggagagcccagagtggaggctatcgcagagcccaggcaaatgatggtggtgtcaactaaataagaaatcagccttttgaccaggtgcagtggctcacgcctgtaattccagcactttgggaggccaaggtgggtggatcagctgaggtcaggagtacgagacgagcctggacaacatggagaagcctcgtctctacgagaaataaaaaaaaaaaaaaaaatagccaggcatggtggtgggtgcctgtagtccccactactctggaggctgaggcatgagaatcgcttgaacccaggaggcagaggttgcagtgagttgaggatgcaccactgcactccagcctgggagatagcaagaccctgtctcaaaaaaaaagaaaaagaaaaaatccaccttttggccaggcacagtggctcatgcctataatcccagcactttgggaacccaaggcaggcggatcagctaaggtcaggagcctggccaacatggtgaaaccctgtctctactcaaaaaaaaaaagcaaaaattagcctggcatgctggcatgtgcctgtaatcccagctacccgagaggctgggttgggagaacctcttgaacccgggaggtggaggttacagggagccgaggtcacaccactgcactccagcctgggcaacagagttaaactccatttcaaaaaaaaaaaaaaaatcagccattgaaaaaattaaagttagttttattgagtcttactgaggactgcaccctgggagagggtttcagagagtttctgttagactgcgccaaagcagcatttcagcccacagtttagatacagaggcaggcggttctgtgtgtgctcagaagctatggtcaggcacggtggctcacgtccgtaatcccagcacttttggaggctgaggcgggtggattgcttgagctcaggagtttgagaccagactgggcaaacacggcaaaaccccttctctacaaaaaatacaaaaaaaaaaaaaaaaaaaaaaaattagccaggcatggcggctcttgcctgtagtcccagctacttgggaggctgaggtggaaggatcacttgagcccaagaggtgagctgtgatggtgccactgcactccagcctggatgacagagcgagacccggtctcattaaaaaaagaagaagaaaaatttacatcaaatgtcttcagaagctacactagtgcaaatctcgccaaggtttgggttcgaggatgcacctagttatatagattatagaggcataatcgtcaatcctgtcaggtgctatcttatgtacaggaaaaggcacagccaggatcatttaacttatattttctaacaatgcagtgattcaggcaagaggcgtgggagcctgtgttctgccctgcctgccatcttcaaggcatccttccgttgggctgcccccagtcactgagtcagggctttgtcagcttctgacaagcagaaagagcaaatgcggtttcttgggattgcaacttggtctcacagtggcttaggccagggtgggagcagtgaacggagtcacaaaagaaatttttcaggtagcattcacgggtgggtgctggattagatgcagggctaagggcaggggaggaagcctgggtaatggaaggctgcggggccaaggggggactgggaatcctggagggccaggtctgggggagagttaggaggtcgtgaatttggacttggatgcttgttgaagctgatgcatcttgaggacatttgtgggacacataggctgggtcagggctgaaagaggtgctggttatggccgggggcagggactcatgcctgtaatcccaacagcccaggaggatgagacaggaggaatgcttgaggccaaaatttcgaggccggaagttccagacgagcctgggcaacacagcaagaccctgtctctagaaaaggaaagaaagaaccgctggttgtggaagccagccatggcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacacccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacaggtaggcgcgggcctggcgcttgggggccccggggggcggtcaggggcgtcggcgggtcccccggcgcgggggcgagggtgccaggctctctgggtcctcgatcctggggcagccgcggaggttcctgaaccccgcgccttcagagcggaggccaagggggcacctggaaagtttggggttgctctgcagagagaacgcgaattgggaagggcggggagcccgagtttggggggagccagaggtgaggtcgtcgggggatgggacatcttttgttctcccggggaggttggaatgtggcgggtggggtggggggggggggtccggtgggaatggccgagacagagacgcagagagacaaagagagatcagagacgggagcgcgagggcgcgcggagcaagtttccgcggctgattgttcccagctgtgcggcgctgcaacatctgggtttctcccgccgggacccctccccctgagcccggctctggagccggcagagccctccctccgtctgatgtctgagcgagcgtcggggccccctgtcccccacctcccaggacgcaggggagtcgggggtgggggaggccgcagctgtggaagaggccagaggtgggggtggggcagcctcccaggcaggtcctggcctcccgcacgccccaaaaccccttcgtctagaagagctcggagatgtggtcccgtgggaggagttcatgaactccacactgacttctctctttcctgcctccccgctagcccgtgggcctccttcccccaataagcctgggttcgggggccagtcctaggggaggaagactccccgcagggtaccgacaggcatcccccaacaccttgcaacccctcttgccccaattcagcgccttctgctgagcagcgggggctccgaccgacctgacggatggggagaagggcaaggaaggctctctgggtcttttcatccccctcccatgaggaggtcaagggttttcagaatggggtgtggggagccagctatccctcgcctctggggcagcttggtcctgagcttcgtctcccggctcccactccaccttagtgaggtgcctaatgcatgagaggagccagggggtcaggaggcctcaggattgagaggaaggagggaaagacctcctgctttctcccctttccctcccctctccctggactcccagtggggaaaatagaccaaagttggggtttccagctagctctctgaaaggacttcctgggttgcagccgggaggggccctcctggatggaccccgccctcgcagccctccctacagaaggctgacggacctgaggtggccctccactgagctggggctggatgtggggaaccggaggctcccccaagtcccaccgtgtagccaggactggaggctgggctcttgaatgtcaggagcctgatgaaagccacggaccccatgccctctccctccaaatgacacacacacttgcctacagtgtcagggggtgcagaacccccagcctgggtgatgtcacggccccttcagtgctgcctttctgggatccagaggagccccctcaggcttcactctcgtgcttcctgctgctgcaaatagcccgggtctcgtgagcctgtgatgcacacagccaggtcttgcgaggcctggaggcctggcaggagaggagtcttctgggagctgggagccctgcccggcctggccgctctgggggccgggcaggcccatgtgtatgtggtttcctgctgagcaggatgcttagggcccaggggctaattgggagcaggtggtggcttggcagaagctgctgagtccaggcggtgatgccggctggccagggctggggtcccaaggatgggcctgggttcagtgattcacgcagtcagtgccttggacacccagggagccactgggccagagggctgagcacgggtgtgggtgaggacagaatggcctgggctgggagcacattaggaatgtccccttagtgagcagggcagggtccgcccttccctgaccacatcaagtacacccactacacggggtttgcttgtcaggatcagccctggagctgggttggaggccttgtcccttgtgacctgaacacctgggtgggccagcagggactgggatgtccctccactccagccctcccatgcctggcttctattctgggtgccaccttctccagggcgaaatcaggggatcaaaggtgagctctgctgtcctgggtgtggccctgggtagagctctcccaccggtctttccccagctgtcctctctgacaccaccccggcctgcctctttgttgccatgagagctgcctacctcttcctgctattcctgcctggtaagtggctcctggggcagggggtagctcctcttatgtggggctgaggagtagggttagtagggggaattcatagtgagcctttgtcacgacttatgaccagaactcagctccccagctcccagggccttctgcctgcttggaccacagactggaccagccaaccctggcagcatctggaggcagctcctggcccttcccccagccttccacagcagcaggcaggcagggttctggagggcacgtcccaggcacaaggactccgtgggcacaaggcacaaggcctctctgggagccgatgtgcaggtgcaggggcacccaaggcagggagtccggatgcttgagttctagatccattcagggcccttctgctctatacagtcctgaccttgtgggggtccctactggccaaatgaagagaatcaatgaggaccacaaaagtcctagcagggccaacattcattcattcagcagcgatgtgttgagtccctaccacgtgccaagtgctgggctaggccctggggattcagcgatgaaccaggcagacacatcgttgctcctcatcatgctgccagtccagggaagggagacaaataggaaacaagcagacatgagaaactccagcatgtgctgagtgctggacagaaatcagcaggagggctggtgggctggaggtggggcggcatcttggcacagctgaaattccagggaagacctgaaggagctgagcaggcctcacaggcccagggagtgtcaggtgcaaaggctctgagggaggcaggagcatgtggagtcctaggagcagccaggaggccagcaacaggaaggggcagggtaaggtcagggaggtgacccatgaccagggtggggaagggtctttaccatcgaagaagagtctggatcctctaggaatctgcttgtggggtcctaggctcttatgggcctgaccttgtgacccccgcctccactctccagaagcgcctcgggcccccgttgcccctcccgatggggtaccctacatgctttgcctccccacagcaggcttgctggctcagggccagtatgacctggacccgctgccgccgttccctgaccacgtccagtacacccactatagcgaccagatcggtaagggccttgccgggtcaccgaggcctggctgctcagatgtgcctggctcagccagggaccgcactggacacgctgatgggaactctgggggttggtccctggctcaggagggaacttgtttgccccaggggctgggggattagccttactcccaccaattccactttcatctttgtttgcagacaacccagactactatgattatcaaggtaacgggctaggggtaggataggacgggccggcagctggggtggggagaccccctgggaggggtagagggagcagacccccttatcctcccctggctgcagaggtgactcctcggccctccgaggaacagttccagttccagtcccagcagcaagtccaacaggaagtcatcccagccccaaccccaggtaggccccagaccctgctcccacccgtctcagctcctgcctcacccctccccaccctgtcaaccctgggagtgggggtctgccagggctgggagaggtgactccccttgccctgaggagacccctcccagtgatgtctgcctacctctgtctccacaccagaaccaggaaatgcagagctggagcccacagagcctgggcctcttggtaagggctttcttgacagctggaaaaatggaggcacgccctgaagttggggtggagtagggggtggtgctggtgggctggaggtctttggcccttgcccatgtgggctcttggcagtgtgggcagtatgactgccgtaggctggcatcaccaggccccccaggcagctccaggaggtcccacctgtccccagtgtgcctggctggaggctaaattggcagcctaggaaggcccctgacctcacagatactgggaggggcagggagtgtgctgggggcttcctgccagccagagagactgagtggtgcacatgtggaggcgaggaagggccagggagtgcaggctggctgagcggtgccctccggctgccctagctgagagcttgaaagaacaaggtgtgtgtgtgcaggagaatccgtgtgctcactctcgtgtgggttggtgtgagcgctcctatgtgggcttctgtgagcgtgggcacgtctgctcgggagttggtatgggcttttgtggcgatgcatgggtgggtgcaaatttctgtttgaacttaggcttctatagtaagtgcggttgtgaattgatacgtgaatattacagccctgggaagtctgacaatgctgcgtgggtctatgtgggcatgtgtaggtatgggtgtctgcacggggcctgaaggtacaggggggactaggccctgtgagccagcctcaggtgggtgaggctgggggccgccccccactctgggctcctagtctgaccccacctgtcaccagactgccgtgaggaacagtacccgtgcacccgcctctactccatacacaggccttgcaaacagtgtctcaacgaggtctgcttctacaggtgagcacagatgggcagctgtcgggaggattccggagcatggggggctagagggcacaggggacagctctggcccgccaaggtgggagttggaggaaagatagtgagtccttaagttgagctcagttctgtggttgagcctgggccagggacctcctccactcctgggctccagtgccaggttctgtccgggctcccgtgccaggttctgtccgggctcccgtgccaggttctgtctgggctatcccagtgggattgggtggaagtggggctgagacctcccgtgccctgtccccgcagcctccgccgtgtgtacgtcattaacaaggagatctgtgttcgtacagtgtgtgcccacgaggagctcctccgaggtaggaaggccacctccccaagacctcccctgtccccacacccgcatcattatctggccacctagccacccacctgatgtttattcaacacgtattatccaccaggcccacttccaggacaccctgagctcccctccttgctacttttcatcctcaaaacactcccatcaccagagttgggggaggggcagcggttcccatcacccagctccaccctgaccctgcctccttcctgcccccaatagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaagatcgagtcactttttcggtggagagcacagaggggccagccaagtgcccccaacgcggactgtcctgagaggctcctgaccccttggagtgaacgatctgctcaggtgccctgtgcttccgcagtcccagccccaccgccttacccgccggctccagctctgccctgcccagaacgctgcgtcatgacagtgtacgcgcgcatgcgtgttgtgggaattgcacgggagatggaaggcttcagggacacagctttctgatgaccggggctgcttggtgagcacattgagttcccatcaccagaggaacacagcaaaaatgggaggccgcccatggggtggggggggcacagggtcaaggcaggcggactgacatccaaggcctttgtttgggaagttggggagatgggtgccattaagagggcaaaaaaagcggggcacagggactcacacctataattccagcacttagggaggctgaggcgggcggatcacttgaggccaggagttcgagaccagcctggccatggcgaaatcccgtctctagtaaaaatacaaaaaaaaattagccaggcgtggtggcgtgtgcctgtaattccagctactcaggaggccgaggcacaagaattgcttcaatctgggaggcggaggttgcagtgagccgagatcgcgccactgcactccagcctgggcgacagagcaagactgtgtctcaaaaaaaaaagggcaaaaacaagcaagccattgtaacacctccctccaaccagcatgtggggcctgggctctgtgtgtgaaggctcacacactcctgtttagccgtccgaacaggcatatgtggtggatgcaattcatatccccttcttagagacaggaaaactgagcccagagacgttaagtaacccacccaagggtcccacccacgggtccacagctatcagtggcagtgctgtggctgaatcggtcagctggactccagcaggtgaggatgagtgttaatttctccttcggacactgactgagcacctcctatgtgaacttccccagagccaccctatgcggttaggttcccattttacagatgagcaaactgaggctctaagaggttaagcagctttgctcaggatcactcagcggtgccagggcaagaccccacgttcacatccaaacctgcacttgtttgccatgctgcctggaaggcctgtcactgtcccgagggtgggcttggatctaaggaggggccagagaaaggggcaagaaagcataggctggaaagagtcgaggtgcacaggctgggcccagtcccaggcctcaacagccccatctgttccatgggccgggtgaccgagtaccccagaggcctccccatctgacattctgtgaggctggtaagttcccttcccaataccggcctctctgctctccctgccgcctccccaagcacccctccctagagggccccatccctcttgccccagaccctacctgtctccccccgacgtctcctccaattgtctagaaaagggacacagctgtacaaacttttttaaaaacaaggttttgttacaaaaaacagttctgaacagttaacattgtaaaaaggtataaaaatacagggactctgagcactctgaggaatttcccgacacatgctcttaactaaggcggagagatctctgggaagccgaagtcagggcctgggcctctgacccctgccctgggcctggtccccctcctctttcccacgatcccatgctccagggctgaccagagacaagggctctccccaatcctggctacggctcagcctctcaaggaggaactttaatgatctacagtggctcatcctagaagaggggggctggactgcaggtgttgctgggaagcctctccaggcctggagctggagtacccgtcctcagcactgccagcagagcgcctcctcatcccaccccagcttgaggcccccaagggaccgggctctgggggggggggctgtccaaaa

SEQ ID NO: 12796 - DNA, 30271 bp, Human
tacataatctcccatatgtgatataataatataatttctgatacctatatatataaaatctaatttaattcatacaaccccgtaaggtgaaggcagtatttgattttcaccacatttatgtttttaatagataaggaaatgcaaggttatagaagcctataatatttcctaatctgaggaaagtagagagcgagcagcttttacacagactgcttaaagacagtttccaaaataattctccttatttagattggagccattcttcccactcatatctaatcacaaagaaccatacaaatacaaaagccttcgcattaatctcctgtgttttctatgtagacaatcctttaagaggcaagtctaagggaaatgtgtactccctcacccagtgctgcttctcttctctccttgtccaagctctgcaaggttctctgatccactcctggtggcccataataggggtcccactagaatattatggtcttgtttcagagctttcaaaatctgagtgatcagtctatctgtaattgatcagagttttaactattatgtaaagagtcctcactatctgtaatcctataactcatcctatgtatcttggtctcattcatattttcttctttcatctttcaacttcaaatacagtaaatataatacatacttattatgtctgcaagtcagatgttaagttccaaaagaagtaaaaataaatgagttgtgaaaatctgagagaaaaaatagaacaagtttccttctggcctagagcctagcactttgggtaagtcgctagacttcggtgagttattttcatggagattttgtttttaacgcctgatgacctatttcatagaattttatcaaaataaatttttaaagtataaaagattcaatctatcaatgtgtcaaagataaattctaagtcaacagaattataaaaacagtgatctcattaattggtaatttaagccagctaatgatagttgaaaatatctcaccagagctcagttagggtcacacttagagtaggtatatttcctgccatattcagtaacagctgtgtatgtagcaaaaccatcaaaagccaatttatgagtattatgggcatatgtgatggcccatccatcttttcaatccacagggagaatatcgtggataccatgactttcctcccaccttaaataaaaatatgcggttcccacctcattagagctatagctagtcatgagagtctgcccatgaactaggaatgcatgtttgtgtctccttccattatgcagaggaaacatgcatggaacatcacacagcatcctgttgttccttcagtgaaaacatacaagctggagatatccatggaaagtcctccagaaaaagaacagaagtgtttatatctattctaaatcccttatgcctcccccagtggtccatcaccactgcctaatctgagaattcactttcaccttcatatttagactttcagactttaaaagaatctatcgccagtctttctaaaatccagactgtggctaggaatgttgtcttaaaatccatcgctcactgcttccaatcatagtgtcaggtctaaaattcattccagactccttaatggctctaagaaccaacaaattaattaatcctaaattcctcacatcagactcattctgttggaccaattttataggcagaggagtaagtgggaatctggctttgaattctgtgatgaatgatgcaacagccaaactggagaaacagtgttagaagccctgaatccccatcccctatcaaatgcctataaagaaccctagatcatcctctgttaaattatttatgggtgtcaagaaatatttctaattatatccattcacagccacagtcagtgaatattgtgcaaagagattgccaaaaacggttttgccaagtaggttcccagctaggacagctgaggtggctgctgtgtttgcagaatggtctctataaaagtggagctgagatgcctctttcccatccttcctcaaaattcttgaaggtatgtatatgtggaagaacacttacttttacattcctgatgatgatgatttttcatttaagggatgtctactgcttcccaaattttaattattctttccaacattcttaaggacgacattgtagacaatatagttactagtattttgtgattaaatggggaaaaaaaagcatcccacattctcttttttctttcaacagtagttgtctgctttgagcctgccaccttcttcatctgataatacaagaggtaagaataatttattattacactctaaagaacaaaggaatctctatattgctacatcttaatgagctaccattttatttcctagtttagtattgggaataggatatcggggcagctgttctttaaaaatgccttctcataaaattttgacttttcaggccacttaatcaaacaaaacttaatgaaacttctctttcacatgttgttagaactacagaaagaatgcagccatcatatgtaatatttaatgtgaactactactccaacttaacccataaagatatatcagagagaccgcatgataaaatcaaggtgtgtttatctggaagtcgatatttctaggtgccaatccaggcttttcactgattctatttgcctgggtcaagccagttagcctttatgtatcttgaaatacagtgtgttgcaagtggaattaacaaaactgcatttagcggaacaggactcatgtcccagtaccgccacttatcacccaccactatgacactgaatgaccctgaacctttctaggccttagtttcctcatcagtaaacgaggaggctggattctattgactgctaaggtccttccagctcttgccaactgtgattgacgtcagtggttttcaaggactcctccacagaatcaaaacatttaatggaaccctgctaatggagaatcaaaactaatggaatcctgctaattgttcatgtggagacatgtacttttagtatgatgttaaggatatatataatcatgaaaacctattctacacttaagaattattttaaatgagtttatatttaacatagcagctatattcatttagaaaagaacagaaaacactgttcatgtggaaatgttccttccttaaacttgaggcaatgatcactgtgtgggtggattcaagaaccccctgcaacaacctgaggctctatgggggcttgatccccaagttgggaaacaattaatctataataagacaggagatgggaagggtagcaatcatctttctgtgtttcctggatacactgcattatagtaacctccacgtggtagtgtgttgttaattcaagttgcctggtgtaaaaacaaacacagaaacaaaatataatgtaatataaataacatttcttcttcaaagaaaaaaaacctgacattaaatgttccaatatatatcccctgaaaatatgtctaagtttcacagtgtcatcaggacacttttacagataagactgattttgaaaatagagtatgtggaaattccatagctaacattttaagttgagggaaagttaatgctgatgacaaaagatcaagactctggaaagcctacagaaggtggtggctattgctgttgtcgccatcattgctgtcattgtcattggcaaccaagacacttctgctccacagaggtcaccttcttttattctggccactcaccctgtccttgccatcaggacagcaggacttattttattttctcataattaatttgtcagtagggaaaattttttaagttcattttggcttgaaactttatactggctatccatttcagaaaaatatttagaagactggttggtatttttaaaaagaggagaagaaagaacgagattataaacctaagaaaataagaatcagattttaaaatatgttaggttgaaatccaactaaaaacaaagagaaatacagatcaacacatacaatcactataaaattttattaaaaattaagaagttccttttctccaagaatcttttaaagttgtttttggtttagatactacttctgactttcaaacaatttcaaaactaataaaggagattttaattttaacttagggcaaaattatatgttggatattcagctttcattgtagttattttttcctttacttacctaatacctgtcagttaactaggtgtttatttgtaatgattagatctggacttatgtccggaaagaacaggtgtatctgtctacattcaattttagtaaatctgacatccaattttaataatttgggatgagaggaaaatttgcataaagatctgtatttgagtttttaagacaggttcatttatattgtaaagccagtggaaacagttattgtccatttctttgtatcatcacgatgttaagagggggaagttggaaataagaaagaaaagaaaagtagcaagaaaaagaaaaaattctgaacatgcttggagcatcacaaatgttgctgattgaatgttgattcctccacatttctcaactaaggtttacaacatagaggatggaacttaggcttaaagtatcacaaaaattaagctatcaacatagtgctttcaaatcaatgagctgatctctcagctccttgacatagtatacaggagtggtccctaaaggcaggggtgaggaaacaagcatggaaaattaagcacattaatatgaaatcaacagaacaattctccaccccaaccctgaatcatcatttggctctgtttcttcctctaggtatacctagtccagtactgccatcaataacctgcagccatgagttctgactctgagatggccatttttggggaggctgctcctttcctccgaaagtctgaaaaggagcgaattgaagctcagaacaagccttttgatgccaagacatcagtctttgtggtggaccctaaggagtcctacgtgaaagcaatagtgcagagcagggaaggggggaaggtgacagccaagaccgaagctggagctgtgagtaaaaacacctggagctaattagactctgcctcattttgggttaatttaggtgatatttttttgacctggctttttctgctacttatttgatatgcacttgttttttcttttcttaacagactgtaactgtgaaagaagaccaagtcttctccatgaaccctcccaaatatgacaagatcgaggacatggccatgatgactcacctgcatgagcctgctgtgctgtataacctcaaagagcgttacgcagcctggatgatctacgtgagcaccctttcaacgctatttctcactcactccacattctacacatgttagctaaaataaattaaggggtttcaatacatttggctattgaactgttcttttatgaccaattgtttggttaatgttgtaaactctgatatgttttaaaatgtacatgtggaaaaccatttacttaactgaattagttgaaaaactgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaaaactgaagcattttgtgcagcagcaatgatggaaggaggcaacaaatgaatgaaactttatgagaactaacacagtacttaggtcctgctctacttgcccttaaacagtatttccaagatagataaacaaggtgattgctgatcgaggaaccccgtcctttcccacagacctactcgggcctcttctgtgtcaccgtcaacccctacaagtggctgccggtgtacaaccctgaggtggtgacagcctaccgaggcaaaaagcgccaggaggccccaccccatatcttctccatctctgacaatgcctatcagttcatgctaactggtgagtgagaattacaatttccatagccatttgtaaaatagttgtatactgatatcagaaaaaacatagggctagtattctgagaataactgttcagcacaaacatgataacagaaataataaaattagggaaatatatttagaataaaatgtactagttccaaacatagaagaagttttgcttagatttctatgctaagcactagttccaaaaatagaggaaattttgcttagatttctatgctaaaatccaaattaactaatgctagttccacctcaaaattaattaaatttaggcatcaactctgcatttgaattatagataatacataatctctcctaaaaagtaagttttgaagactcacagtgacaagttatcacaagcacagtacaaaactttaaattggacattgacataattttgtactatgaaccaggtgactggatgggacacaaaattgttattaatctgatattgatagattattctcatggacaaaatggtaaaatgatgcattacatagtctatacattagaaaggtaatgggattattaattagcacatctttgatacttatttttagaaaaaccttatgagaagcaaagcacaaattcatatagttatttttgcaaatggggagttttaaaagacaattttgagtttataagtactgcgttgacctatgtgttaagtgtgtttttctaaatattatctttggcttctcttttacagatcgtgaaaaccagtcaatcttgattacgtatgtagatttcgttactttctttctgttttgatcattgtagtggctactactaccttagattctgaccttttcttctgtttgaacttgatagtggagaatctggtgcagggaagactgtgaacacgaagcgtgtcatccagtactttgcaacaattgcagttactggagagaagaaaaaagaggaacctgcctctggcaaaatgcaggtgggcatgatattcatctaaggacagaataacagattttaaaatctaaccacgtgcacatcaacagtagactgtatacagaaaatgtagtacgtatacaccatggaatactatgcagccttaaaaaagatcaaaatcatattttttgcagcaacatgaggaggccattgtcctaagagaattaatgcaggaacagaaaaccaaatacagcatgttctcttataagtgagagctagacattgagcatgaatgggcataaagatgggaagaatagacactggagactactagatggggaagggtaggagggaggcaagagccaaaaaactacctattgggtactatctatgctcattacctggatgacaggatcatccataccctaaatctcagtatcatgcaatatacccatgtacaaacttgcacatgtatcccctgaatccaaaataaaggttaatttttttaactgactgtggtgcttcaaaatcatagcagccaattgcaagtgatgccagaatttggaaaataactcttggaagagctcatgagaatgagatgaatagggcaatgtattggcaagtataataggcaaaaattctcacaatcattttttaggtgcttttctgggcctgggggatgcagaaatcaagaccacatcactggagtgtcccactccccttcccgatttaccttctttttaactcattttagaaagcctttcccaaagttacagaatactgtgcaggggcaatggggaagggaaagaggtcaatgggaaattatttactgcaacttttttctttgtctgtcttattcatttctcttaaggggacccttgaagatcaaatcatcagtgctaaccccctactggaagccttcggcaatgccaagaccgtgaggaatgacaactcctctcgctttgtaagtctcttgatcttcattttcttgaggatcagcactgattcttgtgtgcatgtggtgtcaatattttttccacctgtttggtccacagctaaagaaatagtttctgattttaatgtgtataataatccctccttttcttttttaagggtaaattcatcaggatccattttggtgccacaggcaaactggcttctgcagatattgaaacatgtaagttaataaatattagtgattgagaatctttttctttgtgggtacatattagaaaatcttgtacttatttctgttgtgtgaaattttcaaacacttaatttttcactgtggcatcttcttttaaatgagcttaatctgacttccagatctgctagagaagtcccgagttacttttcagctaaaggctgaaagaagctaccacatattttatcaaatcctgtccaataagaaaccagagctcattggtaagacacatctttgatttatttctaccaaagaataacagcccttctaagaagcctctctgaaatgtttttgatgaccaaagcaatgctgtctatatactgttcttttccatgtgttcagaaatgcttctgatcaccaccaacccatatgacttcgcatttgtcagccaaggggaaattactgtgcccagcattgatgaccaggaagagctgatggccacagatgtaagtaataggtacaaagtagtaaaaagtaaattcattttccagtgtacaacactctcctctattagggtggaaagcagtggcagaaagactataaataggtaatacaaccctttgggctttcttacttttggaaaaaaattgtaggatatttcaataccctccccctacatgtgttaaaaagctttcactgcctgtaataaatgttgggtctttagtattccttagctagtaggctcctttcattctatctttcttattagtcatttttggttgatatttatgctccaatattaatgtttctctgctattttatgccacacctcacacccaagattctgggaaggagctgcaatattattacaactaaacatggaactcccactgttcttctacagtcacatgtaaacataagccttattttgaataaacctctgtgggccaatgatatatccctctctactccctaagcagcattagaagaagtgggttgtctacttcaaaaacactcattttggggactccataagcctttatatttatttttgaaacaacgcactctctccccaccatcacctcttttttaaggattattgctttttggcttactttctttatatgtaaactttatgtatatttcatgctttcttttgatttctgaataatcttccttatttttaactttaatatcagtgggactatcccaatacccccaagttagagttgacagtgcttgcaaaactgctttttctattaaaatattattttcaagaagtcaataattcatttgtgtggctttatattataaatatcagctttaactctctataacttattattatctttgtatgtccaaaagtgatagggagttaagaaacacaccctggtctgcgaggttaaaaaaatgtagcagtcttgctctaagacttccgtaataatgtctagtttctgtaaataggtagagttagtgagctggaagtggaagtcaataatctggggaaagagtcttaggtaagaatggtaaataaacatattttcctctgcctgctctgaatcctgcccccatttataagccttttcaaagcctatgtgggcaactaaaaaggtaatcaaaattcgatagagaaaaaagacacagaaatattatactaaatggcaaaattccttcttttcataaatgtctcttctctgcatgagaaataaataactaggtaaagtttgctaccccaggcatctcgtggtcgctgagctgtggcttgctatcagagaggcatgtggagaaagactcacaaccattgctgttctcctcataccctctttccaactttatcactcatgcccattagcaggggaaggtagactgggattatgcattaggataggacaaataggagaagaaggagcaacagagagactcgtgagactggagaaaagaaacaaaaatagccaaaagaccaagaggagcatgtgcctgagaagcaaaggggggctggggtggagaaaaggggcaaagcactggccttggcatcaaaagtcatggctcttagtcctggttcagtgagtgtggacaagtcacatcatatgctgtgaccaaatggactcatgactcaaatggaaagactgatgcatacctcttcgtgttgccatgtggatcaaaaggtaaagcatatgagtaccttttgaagatggcaaagtgctagtcaaatataaggcaaggcgtgatgagaaaaaagtgggagacagccccggtgttctgagggattcttccatggtgctaattggggatgagcaaattcaactcttttgacagagtgctgtggacatcctgggtttcactgctgatgaaaaggtggccatttacaagctcactggagccgtgatgcattatgggaacatgaaattcaagcaaaagcaaagggaagagcaggcagagccagatggcacggaaggtaccaccccctgttggtatcttccacttgacaaagctgacatagtgaacttttcagaggcagggaccgtgtttttactttctctgacctagctcgtgaagggcaaaagtattacgagaaggaaattacacactgcctgacgttttacattatttagcagatttgtgatttctgctcattccattattcattggcttttcataagctcatatttgctatttgactaaaacatattttatttcaggataatctgtgtgcccacaggcactgaaagaaacagagatctgaatatttctgtcactactcctctaggttagggtttctcaaattatttttatctgtggtctacttttgccaggttaaatatcacagacagcatcgattccccaacctccaatttatcatcacaagaaatgactaaaattagtgcaagtggtggcaatgcttttgaggcaatatgaacaaatgaaaaggtttcaatgacatttgcacatcttactttttgagtgaaaccttttttctttgtcatcatcatttacattttaaattgtgtaagccatggtcagtttcaccattctcaccttgttcacacagttgctgacaaagctgcttatctgacaagtctgaactctgctgacctgctcaaatctctctgctatcccagagtcaaggtcggcaatgagttcgtaaccaaaggccagactgtgcagcaggtaaacatgacttaaattgtctgatttatttgaaccgcaagtgactcaggagttcatcactgttttcaatttaaaaaactaaactatcacttctgttgaaggtgtacaacgcagtgggtgctctggccaaagccatctacgagaagatgttcctgtggatggtcacccgcatcaaccagcagctggacaccaagcagcccaggcagtacttcatcggggtcttggacattgctggctttgagatctttgatgtgagtagtgaactgacagaaaattagccagtgcaaatcctcttgttagagcatacaaaatcacatttacaaaatgtaccttacaaaatatacaaatgtaattcctactgaaaggagtctttgaaaagatatgaaaagtaaataggtataaataggaaaagagaaaattctattcttttgagtctagaagtctcaaaagttgatccctgagaggttaaaatagtcaaaatctatcctggatccaagcagatgagcatgagaacacctttttaaaattactctaaggaaatatttcagagtcctcatttaacagtattttgcctagtatgcatgatctcatgcagttacttggaaaataagtattcaaagaatcaattctactttgtttagaactatataataggaaaacaatctgaaggtttataatttaataaaccaaaatgccttaaattcagaagaaaatactaatagatactctgtagatagaatacttgttatgcgtaatttcctatatttatcttgttctgtagttcaacagcctggagcagctgtgcatcaacttcaccaacgagaaactgcaacagtttttcaaccaccacatgttcgtgctggagcaggaagagtacaagaaggaaggcatcgagtgggagttcattgacttcgggatggacctggctgcctgcatcgagctcatcgagaaggttcatatgacttttctagctttcaaaacatgaaaaccaaattgcttgcctccctgtgcttaatcacactccctgttctcaaagaacaagcagtgctgtttcctgacacactcgtatattctgattggttgtgaggtatgttccaagtgatctgttattaataagtagagcagtttgtagaaaaatgtttatcactcacacacatatggattcgcatttatccctctaaaaacttaattctccctcacttttcttcctacactatttcatgcatatgggagaaagggatgaaattacagctattcctctgggttgtgtaattaaccctggtgtacccatgacagtgtattgtgcatttatcatcatccctcatgtgtaacaaggcaggctatgtcaacacgtcttaaagattggaaggttagtccttcaactgttgcagtcattaagtctttccccgttcatgataactactgaataaacaccaaacctctgtatcacttacctagaaaatgggccctgaattccccattactaagggggtgaagcaatagttacatcagatctagatatgttaacactcatcaagcaatcgttaaacacttccaaaagtatcttgggagcttgtcatatacttattgatatcaataaagtgtatgtgtgaaccctaccctaagcagtgggaaaggaagcgtaaatgcaattgccacctaggaaaacttaaaatactcaggttaaaattcacaaaaatatgaaagataagagtttaaaagcagactaggtctgcacaatttggggaaaagatacgttaatctggtgatataatatctctactattcatgaaaactttatggtcttcagaaaaggcatttattttattctctagtatttcagtttctgtatcaccaaaatagtcttaggggtacaatttgtgaatttgttaaatcatcaatgttgaattttctttcagtctttcctatcaaatacattaagaaaaaagccaaactcttagaaagcaaaaccaaattactatcacttaactccacagtggtagagaatataggttaaagtacagaattttaatgatacaatataagatgcaatttcctcctaggaatggatcatttttagtccttacacataatctctcttcccttcatacttctgtcacctctagattcgaggtaaaggaagttatattgtcagtaggaaagaaagtagtcagatatatacatttatggaataaagaattcaattttgaagtgatgttttcagaatctgattttatacactgaacataaagtgtgccaaatagttcagatgtattttttttaactgagtctttctagcaagtatatttcccatatgttctgggtacataatgactgcttcacatgtcatgcctatttaatttatcattcaaagtcttcttttgaaacattgtattttcagttttccatcaattacatggagcataactttctgagggactcatcattatcatcccttttttcctattcttagcctatgggcatcttctccatcctagaagaggagtgcatgttccccaaggcaacagacacctccttcaagaacaagctgtatgaacaacatcttggaaaatccaacaacttccagaagcccaagcctgccaaaggcaagcctgaggctcacttctcactggtgcactatgccggcaccgtggactacaacatcgccggctggctggacaaaaacaaggaccccctgaatgagactgtggtggggctgtaccagaagtctgcaatgaagactctggctttcctcttctctggggcacaaactgctgaagcaggtcatgtttaatagcactaatatgttacaagagtcacaaaatagatatacactgttcaacagagacaaatgtagttacagcaaaacctgacacaaaaacactggccaatacatgcctaatgaaagaaagtgtatttaataactgtgatacagtcttacagtcacagactttcagagctaagtgacactatggagcatttagcccacagcctgatttcactcatgagaaaacaagaatctcagagaggttaagtgatttgctcaggatcataaaactcatttctatcattttaatagtattggttctttcaaggttctccagctaggctggagataaggaaatcctttgtcagggccctagtgcttggggaactgaagttctgttctcttaagtgttctaagaccagatgtgcaagtaacaccatggaagcacaggcaaatgggagccaggatttccctgcaggtgagcagaggctcacctacctgggaccaagtgtgcaactctgcctgttgtccaagtgaggcctgcactaacaaggcattactactctgtctccttggcccttccttcagagaacagacattgctgacttggagtaggggagtcccatcccctacccacatctaccccttacactcacaattcttttgttgttggttttttcatgaatgactataaagtcagccaaatcttagactttcttaatctacaattgagggaggagagatatggaaagaataggaatgatgcaagtgaatgagtgcaaatttaaattctaaagggaattttggcagtcctgatgtttatggatagtacttaaaaggcagttgcaaataactttatttttcccattttgttttttagagggtggtggtggaaagaaaggtggcaaaaagaagggttcttctttccagacagtgtcagctcttttcagggtacagtatattcttgaattacagataaatactttcattaaaaaactaaaccatcaaaacagaaaattttttaaaagatatttatggtgaaagtgaataaagtagtacagtatactttttagtatactactaaaggttttgtaaactttttaaatggcttaggaaaaaaaattagcacaaaaaaacaaactacatatctcttcacatcaatctttatgatacgtgaaccattgcccctgagccctacatccaagagatctggtattgtacaaatttcacatgaaatcaaatgctcttttaaaaataaccactgtattcaattacatctccttcatgtgacaaaaatcgcaatacaaagtttctctgactggtggtgcttgagaataacaaactgaaattaactgattttgtgtaatctgtaatttcctacctgtgctccacttatatgattcctctctgttatgataatttgtttttccttgagacagctcattaaaatgtgaaatgaaagacaaatattgatagggactctcatgtcgatgcaactagaaatgattttaaaacttttcatatggttccacaggagaatttgaataagctgatgaccaacttgaggagcactcacccccactttgtgcggtgcatcatccccaatgaaactaaaactcctggtaagacatttctgatatccagacaagctccagtgtgtgtgcgatagaccacgaagtatggcatgtggattcattctcttaggtgccatggagcatgagcttgtcctgcatcagctgaggtgtaacggtgtgctggaaggcatccgcatctgcaggaaaggcttcccaagcagaatcctttatgcagacttcaaacagaggtttgtgtctcattatttttcccttccaatgtcttagtctacacaaaatcactatataattccaacatttttaaacttttccttgaaaaatgacatgcaattatttgaaaattgatcataaaagaaagaagcttaggtttatattatcataagtttttcatcatatcttccgaagttttaaataaagcactgactttttaaatggcattttgttcaccaaaacttaatctatcatcttttcaatgatagctaccaaatgttctactgtttttttcagtgaagaaaaaccacatttttatattctttttattctgacagatacaaggttctaaatgcgagtgctatcccagagggtcagttcattgacagcaagaaggcttctgagaaacttctagggtctattgaaattgaccacacccagtacaaattcggtcataccaaggtatcaccagtccaaatttctatctgtcataattctatcacttttagactttcctgtaagtggaaataacatatttaacttgttctttcataaggttttcttcaaagctggcctgctgggaactctagaggaaatgcgagatgaaaagctagctcaactcatcacgcgcactcaagccatatgcagagggttcctgatgagagtggagttcagaaagatgatggagaggaggtgagagcccacacacaagtcttcctgctccacactttcataaatgaatccactgcagtcattacttttgttgagtgatgatcactttccacattattctccatttgcatctttttttcttttcctacagagagtccatcttctgcattcagtacaacatccgtgctttcatgaatgtgaagcactggccctggatgaagctgtatttcaagatcaagcccctcctcaagagtgcagagacagagaaggagatggccaacatgaaggaagaatttgagaaaaccaaagaagagctggctaagacagaggcaaaaaggaaagaactagaagaaaagatggtgacgctaatgcaagagaaaaatgacttacaactccaagttcaagctgtaagtattatacattgcagttcagccacatcttattacttttaacgttttaaaatgaatggtttccactgaaacatttgttctgattgtttgctgttcaaaaacaccaagactcgggcataaagaagcaatagatgcaaagtcacatatcatgctgcacacgttcatatgtgcattcacacacagtttggtcatcagtgagcaaattcataaaaatatcaatagacattttcctttatttatggaactttctctcagatcagattattctttctttagtgtatttttgtgcataaaatagaagttatgttgtttttatcagggcagagaaatggctaagttaatcccctcttaaatgtgagaaaactgagtcctacaatgaacaagcgatttttccaaagttgcaaaggttagtaaagtggcagatttttgccaaagggctagttttcctgatttggcctgccacacatgaatatctgaaggaaatttgttattatacttgatcagtagataacagtattaacattttgtctgtttcattttaaaagttagcaactggtatacatgttgaccaaacaggtagtcactgaaatttccaccttataataaattattgtgtgcttatagatatagctcagacaaatgaaaatgcttaatttctccctttaggaagcagatgccttggctgatgcagaggaaagatgtgatcagttgattaaaaccaaaatccaacttgaggccaaaatcaaagaggtaactgaaagagctgaggatgaggaagagatcaatgctgagctgacagccaagaagaggaaactggaggatgaatgttcagagctcaagaaagacattgatgaccttgagctgacactggccaaggttgagaaggagaaacatgccacagagaacaaggtacaaatcatgatccattttagaatatttataagcaccttgatactgaagtattttaattaaaaatttaatcttaagatgattgaatataaaaaataccactgtcataactatttcatctctttagtcttcaccacctcaatctacttacttgacctttacctcctattttttcagccattataggcctgggttagctcctggttctcattttccatcttacgctgacattatcctaagatactacagcatcatgtttttcatcaagataatacgttgtcattgacattctggtcatctgttctaatctaaaggtgaaaaacctcacagaagagatggcaggtctggatgaaaccattgctaagctgaccaaggagaagaaggctctccaggaggcccaccagcagaccctggatgacctgcagatggaggaggacaaagtcaacaccctgaccaaagctaaaaccaagctagaacagcaagtggacgatgtaagtgtgaaaaagaaaatgtttccccttgcaatgaaataaacaattgtgacatgaaaccagcactgatagtcataagcctttaacgcttggtctgtgaataaagttcttgtgctatttgttgtatctttaaatttttttcttatgtatctttgaaggctactagcatagggttcagtgcttaagagctgaaataaataaaatgcatcataaatttagcttgaaggatctctggaacaagaaaagaaactttgcatggacttagaaagagccaagagaaaactggagggtgacctaaaattggcccaagaatccacaatggatacagaaaatgacaaacagcaacttaatgagaaactcaaaaagtaagtatggtataattcagctataacctgcttgttgtatgtcaatgcaaatgaaacatacgctaaaaagatctccaaaatgttacatcatgacatatggaaaaaaataatgacatctttgacctttttatttaattaaactaatacaattattaatctgtaaaacattgtactactcactccttcaacaccagcagtataaaaaaagtcttagattatacatagaaaagaagattggtaagagaagtgattataagctaatgtgttgctcttctaataggaaagagtttgaaatgagcaatctgcaaggcaagattgaagatgaacaagcccttgcaatacagctacaaaagaagatcaaagaattacaggtaagttataacctccaccttttctgggcattacaggaaacaaaactgacataaattcacattaatgttgacatatcacaaccaggcccgcattgaggagctggaggaggaaatcgaggcagagcgggcctcccgggccaaagcagagaagcagcgctctgacctctcccgggagctggaggagatcagtgagaggctggaagaagccggtggggccacttcagcccagattgagatgaacaagaagcgggaggctgagttccagaaaatgcgcagggacctggaagagtccaccctgcagcacgaagccacggcagctgctcttcggaagaagcacgcagatagtgtggctgagcttggggagcagattgacagccttcagcgggtcaagcagaagctggagaaggaaaagagtgagctgaagatggagatcaatgaccttgctagtaacatggagactgtctccaaagccaaggtcttcattaacttgtgcccttttcatctttatttgcaacaattcaaaatgaccaagtttatatatgactatttttagccaaattacacaaacattagatggcatctgaagcttaaacttactcctagtacacattattgtattgaatcacttaagttctcttaacttctttgtagaaaacactttaacctttgatactattaccatgaaaaaaaatgtaattacaaaaaaggtttatctaaaaaccatactctaaatgatgcagaatttaaatgatgttcacactttcaaagagaatataattttgataatcatgtgttcattatttagccaaattaaatgcctctactactttatagccaccatgcaagattgatagaaaagtaaataaaaatcagcccctttccacaggtagttacagatctctaaatcccagcctctagaataaaaatgtattgtctcttcctgttttctacctctcaccccaggcaaactttgagaaaatgtgccgcaccctagaggaccagcttagtgaaataaaaacaaaggaagaagagcaacaacgcttaataaatgagttgtcagcccagaaggcacgtttacacacagaatcaggtcagtaaataaatagcatcaaccttcggagaggtgacgaatgaaagacaagcctttacctacctatcaaatacaagtaatttctcaagctctgtacattcatttatcatgtcttacttattcctccatctttttattatgagacagtaaaatgcaatgattctaagcgacaattggggaaaagaattaagctccctgggctcaggagattttttgtgactcagcattactcaaaagttctcgaattctaaaatatcaaagaaaactcatacattttttaaaaagcaagaaataaccttctcaacatcactgaaaatcttgaggggttttttcatcatatgaaataagagggttacaatgttattccattctttaaattattgtttacctagacaacagaactaaatcattgatgttttgtcttccacaggtgagttttcacgacagctagatgaaaaagatgctatggtttctcagctatcccgaggcaaacaagcatttacacaacagattgaagaattaaagaggcagctagaagaggagactaaggtgagaattctccagctgatactttcaatcacttgaaccgtgcaacataacacactattgaactttgcatagagaatttcaatgatcagaagataaacttatatcacatagtttttggttggtctaggccaagagcactctggcccatgccctgcagtcagcccgccatgactgtgacctgctgcgggaacagtatgaggaggagcaggaagccaaggctgagctgcagaggggaatgtccaaggccaacagtgaggttgcccagtggaggaccaagtacgagacggacgccatccagcgcacagaggagctggaggaggccaagtatgtgcttttagtgcaggggagcaggaagaaataaaagtaaaggcagtgaaggaaaaatagaagaaagagaatattccgggcttggggacacatgaaagacttcagcttattttattataggttggtggattccaccatattcttcttcttaaagcccagtgtatgtccactggagaatggaatgagaccagatccctccacccattcttgtccagaagcatcttaaatttctttccaccaagatggattattaattatcagaatattatttatgaattaaatagaattagtatcttttaatagaaggaaaaattgagacattgagactctctggtaaattattatgagtattacaattaacaataatcagtttttcctcagatggagtattgaatgtttatattaaggttgtcatatgctgtcattatttcaactaacaacctatatcaatggatgtattcactaattacacgtactgtttgcggactacaagtcatgagatttacagatttacacatagaaggaaaaaaagcattatactcctagtgaaagaagcctttctaaatttaatttatctcagtagttgttagaattaaacaggatgaaagagtttgtagcaagcatttccagagagagttctagataagagtgtgggctgggaaaggtcatgaattacataggttggtgaagagtagtagacaagattttagaggaaatttgggaaatgcaataatgcagtaatatttattatcaaaggccaccaaatccagaaagttactgattcattgtatgaccttgaacatatcactctgggccgcagtttcctcatttgcaaaataaacagaaccatactagaaaatgcttaaagatactactcaatgctaccattccttggtgatatgcttcctgttcatggttgccatttcttcctcaaagtaaataaaactcagcccttttccacaagtagttacagatctctaaatcccaggtttcaaaagagaaatgtactgtctcttcctgttttctacttctcaccccaggcaaagttcaagaaaatgtgccacactatagagggccagcttagtgaaataaaaacaaagaaagaggagcaaattttcacattgctcactcagctctagtgctaacttatattctctttctctcatacacacacatacacacacacacgtgcttcgtaaatatgtttggcaatacctgagatggataaaaataagaactcaacagggaaaacagaattctaagagagtgaaaatgtttagaaaaattcaacaacttgtagacaactcttggggaaatatgctttcctagtcagcagctttataaagggcactgtggtgactctgagtctgctcttggtcactcatactgacccaattttcaggaagaagctagcccagcgtctgcaggatgcagaagaacatgtagaagctgtgaattccaaatgtgcttctcttgaaaagacaaagcagaggctacagaatgaagtagaggacctcatgattgatgtggaacgatctaatgctgcctgcatagctctcgataagaagcaaagaaactttgacaaggtggtccacagtaccagctccccttgggggaaactgacatcattcttggtttcaaaggcttattttctatatacttccaggttctggcagaatggaaacagaagtatgaggaaactcaggctgaacttgaggcctcccagaaggagtcgcgttctctcagcactgagctgttcaaggtgaagaatgcctacgaggaatccctggatcatcttgaaactctaaagcgagagaataagaacttacaacgtgagtcactgtaatcattctatttcaaaaatggtagggagacatcttttcaatttttctttctacttaactgaaatttggtactttattattacagaggagatttctgacctgacagagcaaattgcagagggtggaaagcatatccatgaactggagaaagtaaagaaacaacttgatcatgagaagagtgaactacagacttccctagaggaagcagaggtacatttttcatttgcttagctctgcattataaataaattgaaaattaatagcaactgagatctctatcatgttgcaaatctttagggaataacacaagtaattcagtgaaaaatactgaattgtaccttgagaatgcagagctaataggctacattaagacgtatgatagtttatgggttttttaatgccttcttggggaaattatcataatgtgaaagaaataaaaagctctttaggtaacctaaataaatgttgcttttattaaggcatctcttgagcatgaagaaggcaaaattcttcgcattcaacttgagctaaatcaggtgaaatctgagattgaccgaaaaattgctgaaaaagatgaagaactcgatcagctaaagaggaaccatctcagagttgtggagtcaatgcagagtacactggatgctgagatcaggagcagaaatgatgctctgaggatcaagaagaagatggagggagatcttaatgaaatggaaatccagctgaaccatgccaaccgccaggctgctgaggcactaaggaatcttagaaacacacaaggaatactgaaggtatgctggggtaaatacacatagtgttgtacagtctcagtgctactgtgtaactcaaattttaatgttttacgaggactatgtgtcataaatcacctaagcaacatggtaatcagttcaaagttcaaagttatacacacacaactgaaaaagagcttaattctggaaggcccaggacagagtttgctttgttatctgcagagaagcactgtggtgaggggtagggagatagaggaagtgatgaaagagtttggctacatgccactgcttaaatcacttcattaatctggacttcatttgcttaatatgtaaaatagcaccactggactcgctgaagtctaaggatactttcctgatccaaaattttgtagagctagccatggtattttttaatgattcagggtctaaaataataaaacatcatgttcttttgagtagaactgcaaccctcagctacaaagaatttattattaaaggtacttgccgattgctcctatctaatcatactctaagtcattaagatcaaagagtgtacatgaccataagtttgcatttgctttaagtgcagcatgagtaagaggctttttctctttctgtgtaggacactcagctacatttggatgatgccatcagaggccaagatgaccttaaggaacaactggcaatggttgagcgcagagctaacctgatgcaggctgaagttgaagagctcagggcatccctggaacggactgagagaggcaggaaaatggcagagcaagagcttctggatgccagtgaacgtgtgcaacttctgcacactcaggtgaggttcaagactatggtttagaaaatgtactccctgaagctgaagataatttgagaagataagcttgtttataaagtaaaaagtaatcttcgtcccttcctggagctctggaaaatgtacagggtgctgtaaggatttactgggacctagctggttcacgagtatatttatgggctggcataatcatgttgagttgaaataatctggaattctagaaacttttatttaaaaagcacagaagaccatctacaaataaacatacacacaacatttgtagctgtcttgtcttatgcaactctaagctacaaaaagataggcaaataaaatagaggagaaaaacaaaaagccactaaataatatttacgtatcacatatgcacagaatgctaacctcatgggatacaaagagaagctctttagttcaaattcatggaggccattattaatactagttagcatttgttgtatatagtgaatttgttaaataaatggtggtatatcctcacaatggctaatatgtaaccactgtagtatgaatttattgccatgggaagatgtttatattatagtaagttaaaaaagcaacttaaaaataatataggctgtgtgatcttttttcccgtataaacatataggaaacatccagaaagataaataaaagtttatcctttatctctggtgagagcacagtaattattttttgtttcttgtctgctaatttgtatgttctactatcttttacaataaatatatagtactgtatacttcagaaagttgcactatataaacataactattatagaagtgttaaaattgcatgctttatataattttaaaatcaaattaatatgcaacatttttcttattaacagtatctgaagttgactattccaaacaccatcaacttgccaaaaacagaagggattcttggctcatttttatcccaacaagactactattttttttttttttttttttttttttgagaaggggtctcactctgtcacccaggctggagtgcagtggtgcgatctcggctcacagcaagctccaactcccatgttcacgccattctcctgcctcagcctcccgagtagctgggactacaggcgcccaccaccacactcgactaattttttgtatttttagtagagacggggtttcaccgtgttagccaggatggtctcgatctcctgaccccgtgatctgcccacctcggcctcccaaagtgctgggattacaggcatgagccactgcgcccagccaacaagacaactatttatgcatttataaatatggagtcaaccaacatgagttaatagctaaaaattactgattcattttaaatgagctgtggtgtggtgctccatggtacagcactttgagttttgtgggctgtgtttcatgcttacaaatggcaatggtaatagttgaatatgtttgacatcaaaaattaaatttagaagtttgattaaagagctatatatagaaaggagaaaaggcataaacttagaattatcttctaatttggtttttattctaaacatttcttatgatcaataatttttgcctgtgtacactaggtaaaatgacaatgtgagttgttataagtaaatgtgcttctcttctctttcattaatttgaaacagaacaccagcctgatcaacaccaagaagaagctggaaacagacatttcccaaatccagggagagatggaggacatcgtccaggaagcccgcaatgcagaggagaaggccaagaaggccatcactgatgtaagcaagatgagcatttgtcttactgacacatgcatgctgcctgctatcatcagaattcattattttcaaaatttatttgctaactaggctgccatgatggctgaggagctgaagaaggaacaggacaccagcgcccacctggagcggatgaagaagaacatggagcagaccgtgaaggatctgcagctccgtctggatgaggctgagcagctggcgctgaagggtgggaagaagcagatccagaaactggaggccagggtaggtctccacaacttcactcaattccttgtggccagttacagccaaactggtaaacgtctttgttcccttccaggtgagagagcttgaaagtgaggtggaaagtgaacagaagcacaatgttgaggctgtcaagggtcttcgcaaacatgagagaagagtgaaggaactcacttaccaggtgaccagtgttttcatatcttccaggcctatagttttcaagaaaatcatgagttgttttaaaataatggcaccatctacttgcacctctttcagactgaggaggaccgcaagaatattctcaggctgcaggacttggtggacaaattgcaaaccaaagtcaaagcttacaagagacaagctgaagaggctgtgagtatctccacagtggaaatgaaaggttcagatgcacatccaggttttttggggcctaaagtttatagaatttagggggttttctttaaattgggaatacataattaggtatgaacatgaatatttagaatgagaaaaatgaaccataaattactggagccttatagatttgagtttatttcttctgagacctctttaagcaattttccagacatgttaacatacaaatgtttcttagttgcaatccacttccctccctatctagaacattctacaacccccagcactcatatggacctgtgcaaatgagagtatgaattctaagcttcatttaacttcatgataaatccatcttgggactttttttttcaattcggctgcagttatctttttcattctgttaattctgaaaccttccttagggttcttggcaccaaatgccactactgcacctattttttaaagtttcttttttagaaacaagattgaattcagatccctgctactttgttcttccagttatcactgcagcctcttcagtttgccagaaagagagtcaagtgagagagagacttgaggagggtcataagcacattcatttacataggcgagtttgtgggatgccttgctctcaaataactatgttactaaataataaagcctttttctcttctttttttttttttcgaggcagagttttgctcttgttgcccaggctggagtgcaatggcacaatctcagctcactgcaatctctgcctcctgggtccaagagattctcctgcctcagcctcctgagtagctggaattacaggcatccaccactacgctgggctaattttagtaaagatgggggtttcaccatgttggccaggctggtctcgaattcctgacctcaggtgatccacccgcctcagtctcccagagtgctgggattacaggtgtgagccaccatgcctggacaacggagcctttttctttctcattcatgaggcaaatcctgaagtaacaaaagcaataacaatcaggaaatgtccaattttcttgttatctcaaatgcatctctgttctcaggaggaacaatccaatgtcaaccttgccaagttccgcaagctccagcacgagctggaggaggccgaggaacgggctgacattgctgagtcccaagtcaacaagctgagagtgaagagtcgggaggttcacacaaaagtcataagtgaagagtaattcattctaatgaaagaaaatgtgaccaaagaaatgcacgaaatgtgaagttctttgtcactgtcctgtatatcaaggaaataaaatctttagataattttgcatctaaaaatacatttgtctcttaattataagctctttagtgctattagaactaattcctttattcaacatttgtggagttcctaatatgtgcaatcagagataataacaaaaatgaatgtaggcagtgaacccaactttaatggaaggtaaatgaaataaggtgctctgagaagacatgaaggtgacaaacgcactctcaattccattcaaccaattttactgagtatcaactatatgtctggtacagaaatggacacgaaagatgtgacagttatccctgtctttgagaagttcaatccagtgtggaagacggcagttcaaaaagatatacgctgtatgtatgtgcaacatacatactctgacatgagtgtgaaaaacaaatgtggcaataacatagagtgagctgctaactttggaaatccagaaaggcttctcaaaggagactatgagctgattcctaaaagaggaccagacagttatcaggtgaaagagaaaaaaaattatgatcattctaagaaaagaaaacaagcatgagatttcagcatagttttagcacaggcttcatgagcaaaggggagcagatgaggccagatatggaagataaggcctgattgtgaagggtatgtcctcatatgtagtgctaaggaacaaggacacacatcaaattggtccaatttcttgaagaggagaattgacacaattatggcagcagtatggaggaatgagtaaggtgggaaagatcaaagccttcaaagactgtttaggaggctattaaaatggtcaaaattagagatgatggtgatggaaataaacaagaatgcagaaggaaagcacagttctaacacagtataaagaaaagggcttgaaagaatggaagaagttaaacagtttcacagcattcaaacatcccagttactttgtggttacagatttcatttccttttggaagaagttattttcctctgaactttctccttctacaagaaaaacagaactttttagataaatctttctgttgaccttctaattctacatacagttctgcttacttatgaggaatacttcacctaggccatgatgaagatgaagttctgtttactgtaaggtcaacagaaagatttatccaaaaatctaacggtatgtagaattagaaggtcaacagaaagatttatccaaaaagttctgtccatttttgctccagaaaaggagcctgacttttctcagtatcttgcatattttaaggaggaaccataaaggaaatctaattcttaatttcaaaaacagtatttccaaaattttatcatagccattgccatagtgttcttttctttgatattttcttagtttaaaattttgcttcttccaaaaataagagaataccaatttattctttatagtggtgctgtcttttcaaacttagtcttttctaatggaggagctgctttgggaaatctccttccccaatgtgggaatcctaactagtagtgagaagtttgcttcgtaagaggagaattttaaagggctagaaaataattatcaggaatacttcacccaggccatgatgaagactaatgaaatatcctccctagagcaagcatttattatcgctttttaattaagctctgtagagttaatctactgacctcaaaagcactgggcaattgctttattattctgactcctaacttaaataattgcttatgtagagagtcaagagtgtattctattacatatgggtcaattattacgggtttcctgattaaaggagcaagcatatagagtcacagttattctggtcaatattcttcctcatcttcctcacagactagctgatttatagacgtatttccttatctactaaaataaagccacacataataatctaggacagcttatagcactcttcaactttcctttaattgatacgaggtattagtgagatttggtgactgtttctaatctagtgctgctggatctgag

SEQ ID NO: 12797 - DNA, 35262 bp, Human
gttctggaatacagtattcagagggagggaagcaacagtcccatgctagtctttaggggtggagcacacctggagcattgtgtgcaagctggaaaaaaaaaagaggattactcacacacctgacactcattgtgatgtgagtacccagcatggtgagctgtgtctgtaggaaaaactcttaaaaagctgagactatttaggctccacaaagagaaagctgagggaggctgagtagctagtatttgaaatgtcatcatgtggtggaacattagacacgattggtgtagttccagaaggaaaaactaggctgcacatataggaaaatcagaggtagatttggctccacacagaaaggaaggtctggctgttatttggagctttttagaaatgaaatggacttccttgtaagacagtgaattccttttcactaatgaagaaactgaatgatcactaatcctgagcgttaaagacttaacgtatgtcaggtgtggcttcttaacgcttaatgggtattagaatcacctgggggaacttgataactactgattgccaggccttaccttgagaagagttgcttcagcagatctgaaataaggtccaagaatctgaatttttaaatttatttttattttttttttttgagacggagtcttgctctgtcacccagtctggagtgcagtggtgtgatcttggctcactgcatcctccacctcctgggttcaagtgattgtcctgcctcagcctcctgagtagctgggactacaggtacatgccaccatgcctggataatttttgtatttttagtagagactgggtttcaccatgttggccaggctgatctcgaactcctgacctcaggtgatccacctgcctcggccttccaaagtgttgggattataggcatgagccaccgcgcctggccaagaatctgaatttttaacaagaaacacagtgagtccagatcacatggtcactgacccgccctttgagaactggtgaggttagataaactcagatctcttccacttatcctacaaataaacactttagtaaaaaatgtgtagtcaacataatgactgctcaaagttgtcttaacaaattttgtaagaaatctaaggcaaaattccttaatatgttgtcagctaagttagagatgacatcattggaatgtacgatattaggatatggaaggagaacacttgattctcactctgtgttataaaagataagattataatagcaaaatagaaaatatagatccagtttgaaaattttaaacacttcaaatagagaacccactccacttatgccaaggagcaatcggatggagaccagattggcatatgaaaaagctgtatgatcatttcaataggcagcacctgtgtaaggtgaaacatccatcagcctttagggcccaggcttatataaacttcagcctcgaactcacgaacaggtgtgggtgagagttggaaacataagggatagtgcggttggtcttctaagtctcgcccacttttcttaggggctaaagagcttttgttggcaagtataatgtgtttgattattcctaaagcatgcaacttggagccacattttggaattactctctcctgaaatattttgctctttgttaatatatctttaaaaagtgatgcttgaggtaattactgtcccatatcaggatcttttttaagttgtagtgatgtttcatttattacttaagtgctttaaaattttaaaaagacttttttttttcctttgaaaacctttaaaactgggctatttgaggaattgctgttcttggctgttatgttgattgatagtgttcatgtacttacctagtttactaaggacttctttctagcagattttctcagttttaactttaaggtatgtaaaatttccaaatggcagttaaatattgataataagttaaaccatttctttctatttcttcttgcttccttttaatgattcagacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgagagctagtatgtgggatggcaaagggaagcaatcaccaagcaaccagccagctcctaggaaaatggagtgatcttgttttctgcatataagtaacaaaagttttatgggctcgagtttatttgtttgaacgtggaattgaaaggaggagacatagtagatgacactgtggctggaaacaacagagcaaagccccttatgtgaggtagattaaacaatttctaacttgtctttgccatgaaagataactaattttgtgacttagtgatgcaacatacattctgagccactgtatcaaaagttgatgatgtcttacttgtaagagtggagggtggaggaggctgaggggaaggaggctgaggggatgaggtgggagctatgtgtattggaacagtatgtgcataatgtgattctcctgctaaagtgtctgtcatcatgtcttcgtttcccttcgctttttaaaaaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtgagtaatctcatagtttgtgtgctgtgtgatacctggaaaccttaagttagacaactttacataccttcatgaaagatgatgccccaaagccttgagttggcagcagggatacttcttggttaagattttagatgcaaacttctgttagacaatgcagacttctattcaaagtgggtgaggtggaaagcacaatgattttgcaaaatatttgaaatgtggctttaatcactgcaccttattacaaactatagattggtaacagtatctattacaaactgtaggttgataacagataagtgttataggcaacatcagaaaggaaggagagttatctaccatgggacaattcagttcattaactgaatcaaaagaaactagtctttgtttttttctgaacaattaaccaaaatagctcttatagaatatcctaatttataacagtgtagtaggtgaaggtcataatgtccttcaattttttaaggcaatttcttttaaaataagttagcatattgtctccaggaaagattggagatcttgtagaaagttgaatcgctaattagcacttaaatttcttttcctacttaggtatggtgagaaaaaccatccatttacagttgcttcttttaaaggcagatgggaggaatgggaactatatcaacaaatcagttatgcagttagtagagcctcatcagacgtttcctctggcacttcctgcgatgaagaaagttgtagcaaggaacctcgtgtcattcctaaagtcagcaatccgaagagtatttatcaggtcaagagtgttccagttcttttctatactttttttctatctaattctaaaaagaatgcactcattatgaaaacaaagaagcaaaaaaacatggaaagaacaaaactgtagatttttaaaagccagactcttaatattttggcaaaactttttctgtctccttcactgcacaatgtattccctacacttggctgagcttttaggatccacataatcttttattgtcctatttcttcatacagtatttgaagatacacaggtttccttccacttaaattcctacagaatcaaagattaagattagtgggatttttttttttctgtcaattgaaaataccacggcatttatagaaaatttggatataggaaaggtcaaaggcctataaattctgccactagagcagtttttctcagctatttttttcttctttttaaaccataacccattcaaaatatgtatatttacatttaaaaagtttcatgaaacagtgcttatctttactaggagcaatgctcccaatgctcccaatacttccaattaaattcatttgatttcaagtatctaaattgatttcatgacccacaatttgaaaaacactgatctagagagaatttgttaacactatatgtatatatttgtttgtatgttctcttaatcacctatgtattaaatgttaaagcaattaaaattttaatattcatttgcctcctttgtaacttattattggcagatattctaggctgtttccacatggttgtaatatttttttaaaagctggtaactcgtatagtgatgcctgaattttaggttgtttcttgagatttgattctcaagcacagaactactgggtcgcagagtatgaacattttactggtttttaatatgcagccgaaacaccatgtagaaagttgtatttatttgtagtctcaccagctgtatgtaaaagtgccaactttgccatttttttctagaattggctattctcatttaaaaaacagataatttgattaacatgatatgcatatataatacagtattagtgaaattaaacattaaaactttccatgtgcccaaatgttttagcacctactgccctacaaattttctcttattcagccattcattatttgaagttctaatgtattattgtaggttctttatatgccagaacgattttaaccccttgacatatttctggcaaatgttttgtccctagttttttaaactatgtgtgtcattgatagtttcttggaaacagtgactttaagtaaaatgatgtatgacaaagccatttttttcctcagtcttataaccaaactatgttattcaaagacctgctatatgtcatttagcttaaaattagtttccaataacctatcgaggttgttgagtgaggatttacagtatttgcccttaattctatttttatttttagaaaggtcttcttccatttggggatcagacctgtaatcagctatattcttttacagcaatgtcttttcaaagtgtgatctgtaaaacatctgtatccatcatcttaggtgtttaaaatgaagatttctaggctgtggccccagagatcatgaacatgcagttttggattgggttggcagtggtgaggtagggatggaagagggacaattcaagaataaacataaacttgaataagcatattaaaaagtttttagttgaattaattaactttttaaaaaggtacagtataaagtgatttatgttcccgccaagtgctagaaatttttttcaaagatggttatgcactttcaattctattcatttgtgctccctatgcttttgaagtgcctgacttttgaattatgggttcatatttagtccttacagctagcttattagagatctttatactttttttttccaggttgaaaacttgaaacagccctttcaatcttggttacaaatcccccgcaaaaagaatgtggtggacggccgtgttggcctcctgggaaacacttaccatggctcgcagaagcatcctaagtgttacaggcctgctatgcaccggctggacaggtaccactgggtcaacacacaccgatgacgcagcgactgggcacgtggtgggcaagagctcagaggagtgcctttattctctctaaaataaaaatgaatttaaggttgagaggcccatgaaacaaaaaatgaccatattagggactagggtacacaatggtaaatcctctcatacagatcatcactgttcttagctgtacttttaattcttatttaattttacatgaagttttatgtaacatcagtgaatgtacccagtaaggtaacagaatgaagatgttgacctctaataagactcaatgaattatgaaaagtaatggtttaaataaacgtacagtgtttttaatacttcttagttcagtttgttgcaagaaacaaacttttaaaagtttattttttgtaaagaaggggtctccctatctttgtaaaggctggtcacaaactcctgagctcaagcaatcctcctgtctcggcctcccaaagtgttgggattcaggcgtgagccaccgtgcccggccaccattcattctttctcccctcaccctctaccacttgctagagggaaagttgatgactctgcagtccatgtctctacaaatttgatagcagtgagaattgttttggctgctacttttcaatgtttatggtatgaggaaatgcccattaggctgctgctggtgaattttatctttgttagattttatagattttaaaattaggaagggagattctacaatccagcttcactttattagccaaaaatagtttgactcttctaaattctgtgtctctagttgttagaaaattcccacaaccttgttgactggacccattcctactcatgctgtttgttctcagccaggtccttgctgttgtttggcagatcctgttaatctccacttaagccatttagtagctgtcttctcaatctctttttactccaccctcctgtgctctcagcaggggacttgttctttttgttttctcctacttcaaaactttatccctcccttctcctctctcatctccattttaaggctttgctcttctccagccgcttgtatcttctccctacatcttggttttcttgctgagtttctgctgttaggtgattctggatccaggaagctggtagcattggagcagtcacagcttggttctcttgtgagtagacttgtgctttgggccagtggctctgagtggatacaaaaagttgtgaccttgagtcccaacttgggtacgacatgccagcagtcatgctagtgctgatgaagggggagggagcttgattctagcctcattactttgggtgcagctcttagtaatcattttttcttttttttctagaaacgatggttcattagggcacatagcagcattattttgtgggacaaactcacctacccttaatggcatatgaggtcaagtttctctgctgaaaagtgagtttgtcctgtcttgaagagctttctactatagtgtgggagttgttgtgaacctccctagatttctctcaaggcaaccacaacactagtttactggcccctcagcaaaccatctcctggaggtggttgtgatgtttgccagcctccatacgtgtgtgggtgaattctggtctccagataatggggcagaaacaagactaccagcaatgggtgtaagtattaggctttaggatgctggcatgtatgtgaatgtactttagtttaatccttaaccatcaagttagaatttctggtaacatttcattttctctgcctccctaccttctgcccttgtgcaggcaattgtcattagttacctgattattgcaacagtctactaacaacagtaactgtttctcatcttgttccctatcctaaggtaatctttactctccagtttaaaatgtttcaatcaggaaattattcaaattctagaatatgacttctggtcttaatgacttgagttcttgcatatcttttcagcctaacctcgactcttttggactctgtttgtttgtttgtttgtttcctttgagacagagtctcactttgttgcccaggctggagtgcagtggcgagatcttggctcactgcaacctccgcctcccaggttcaagtgattctcgtgcctcagcctccagagtagctgggactacaagcgtgcgcccccatgcccgggtaatttttgtatttttagtacagacggcatttcaccatgttggccacgctggtctcaaactcctggcctcaagtaatctgcccaccttggcctcccaaagtgctgggattaccggggactctggtatttgagacttcttgattgggatacttctcaccttgcctcattgttctcccttccctcttgatctttgggtatcacttgagatgctacctcttccaggaagacttcctgatccccaagtccagtttacagtcatatgttaggggttccttacagcattctgtctgcccctagaagagcacttatctattataattgtttcatagttatcagtatcctcccaatagactgagttttcagagtacagatacctcatattcccatttaatgttggcatatagcagtgttcagatttatagactgaatgactttattggtgattaaatgcttgcctaatatataatctgatacacggcattaaataatgcttgttggttgatcattctctcagcagagtaagaagtattgtgttctaggctgggcatggagaactaatcgctgtaaaaatctgaagctgtttggtctttacatgtacaatttagtggactaaaaaaagaaaaatcaaccatatataatagttgctagataaaaaatgcaacataatatttggatatgacagaagactgagtgatttttcaagaacctttacacagagggttttattaatagtgtcccttgcagtttgcaaggttggtttaaaaacatttcttccagccagcagaggtgacactgtacccctgaaccccatgctgctgatggacactgctagtcaatcacagtgttctgatttgggttcagagattgcctcataattcttgtagcacagtacttgagatgaccattataattaattgttccaaattggtactcaggaagaaaccaattccacaatgtgctagggtttggctcagaggcagccatccatgagcatatgatccctgtgtaatcctttagagcctctcaggaggctctgagcaaatgtgtaggggaaaaaatataatcaactatatatttttattgtgataaaaagtagtcaatatacttgaaaagcccctaaatatattaatgtcatatctattagtctatttgtataataaccaaattagatcttcctaatctacattttgaaaattttctatgatgagtatgtaccacttatttttcttttcttttctttctttctttcttttttttttttttttgagatcaggtctcactctgtcacctaggttggagagcagtggtgcaatcatagctcactgcagccttgactccctggcttgagtcatcctcttgcctcagcctcctgagtagctgggactacaggcacctggctaatttttgatttttagtagagaacgaggtctcgctatgttgcccaggctggccttgaactcctgagctcaagggatcctcccgcttcggcttcccaaagtgcagggattacaggcatgagccaccatgcctggccttctctttttagaaaaatttttatcttgaggtaattataaattcacatgcagttgtaagaaataacatagattgcatgcattcttttacctagttttcccccttggtaacattttgcaaaactttagtacagtatcacaaccagatattgacattgctacagtcaagatacagaacacttccatcaccacaagaattcctcttgttgcccttctatagttgcacacacttcctccgactcccatccctttcttaaccccttggcaaccactaatcttccccctgttcttttaattttgtcatctcaaaaatgttataaattaatcatactgtaggtaaccttttggaattggctcttttcactaagcatagttctttggagattcatccaggttgctgcatgtattggtagtttattccttattgttgctgagcagtattccgtggtatggatacatcacagtttagccatttacctgtcaaagaacaaccgattgtttctggttattaggaataaaactgctacaaacatttgtgtagacaatgtgtgaacataggcatttattccagagaaataaaaacatatgagtgcaattaatgggtcatatagtagttgcatgcttagtttttaaagaaactgccattttatgttcccatcagcaatgtatgagtgattcagcttttccacacacttaccagtctttggtattgtcataattttttatttcagccattctgatgggtgtgtagggtatcttagtatggttttaatttacatgaccctcatggctagtgatgttgaacatcttgtgctcatttggcatctgaatatcttgtttgatgaaatatctgtgtaagtcttctggccattttctaattgagtgcgttgtttatttttccactgagttttgagaatatttgatatattctagacactggtgctttgtcagatgtgtggcctgaaactattttcttccagtttgtaccttgtattttaaaaagttctttatttttaattattatgggtacataatagttatatatgtggagtacatgtgatgttttgatagaggcacatgttgtgttataaatcatggtaattggggtattcatcacctcaagcgttgatcatttctttgtgttaggaacatctcaatttcactttcagttttttatttattttttttttatttttgagatggagttttgctctcgttgcccaggctggagtgcaatggcatgatctcagctccctgcaacctctaccttccagtatcaagcgattctcctgcctcagcctcccgagtagcacgtgcccgccaccacgcccagctaatttttttttttttttgtatttttagtagagatgggatttcaccatgttggccaggctggtctcaaactcctggcctcatgtgatccacccactttgacctcccaaagtgctgggattacaggcatgagccactgcacccggccactttcagttatttaaaaatgtacagtaacttatcgactatggtcatcctattgtattactaagtaccagatcttaattattctaactgtatttttgtacccactaacaatccccactcacccaacccctccctgctacccttcccggcttctggtaaccaaccattctactctatttccatgggttcaatttttttttttcactcccaagtgtgaatgagaacatataatatttgtctttctgtgcctggcttatttcacttaatgtcctctagttccatccatgttgttgcaaatgacaggattttattattttttatgaaggattttattcttcgtaaatgataggattttattcttttttatgaaggattttattctttttcatgattgaataatgttccattgtgtatatgtaccacattttctttatccattcatctgttgatggatacttaggttgattccatatgttagctgttgtcaatagggttgcaataaacatgggagtgcagatatctcttcgatatactgttttcctgtcttttggatatgtatctagcggtgggattgctggatcatatggtagttctatttgtagttttttgaggaacctccatactgttctccatagtggctgtaggagtttgcattcccaccaatggtgtatgagggttcccctttctacacatcctcaccagcaacagttattacttgtctttttgatgcaagccattttgatggggtgagatgatatctcattgtagttttaatttgtgtttctctgattagtgatgctgaatatttttttcacatacctgttggccatttgtcttttttttttttgagatggagtttcactcttgttgcccaggctggagtgcaatggcatgacctcagttcgccacaacgtctgcttctgggttcaagtgattctcctgcttcagcctcccgagtagctggaattacaggcatgcaccaccatgcctggctaattttgtatttttagtagagatggggtttttccgtgttggtcaagctggtcttgaactcccaacctcaggtgatctgcccacctcagcctcccaaagtgctgggattacagtcttgagccaccgtggccggccttgtttgttttcttttaagaaatctctattcagtaccttctgagccaaataaaaacaaagagaacaaaagaaatgcctgtttggattttttgtccaaaaaaattgaatttttttccctattgagttgtttgagcttcttatctattctagcagttaatacctgtcagatgggtagtttgtaaatatcttctcctattctgtgagttgtctcttcactttgttgattatttcctttgctgtgcaaagctttttagtgagatgtgatctcatttgtccatttttgtttcggttgcctgattttgaggtcttcccaagaaacctttgcccagaccaatgttctagaacatgttcccaatgttttcttctagtagtttcatagtttcagatcttatatttaagttcttaatccatctttactggatttctacatatggcaagagatagtggtctagtttcattctttcgtgtatggatatccagttttccccacactatttattgatgagactgtccctagtgtatattctttgcacctttgttgaaaatgagttgactataaatgcatggacttatttctgggttttctattctgttccgttggtcaatgtgtatgttcttatgccagtaccatgctgttttggttactatagctctgtagtataatttgaagtcaggttacataattccttcagttttgctcttttttgcttaggatggcattggctgttctgggtcatttgtgattccatatacattttagaatttttttttatttctgtgaagaatgtcattggtattttgatagggattgcattgaatctgtagactgctttgggtaccatggacattttaacactattgattcttccagtccatgaacatggaacgtctccattttttgtgtgctcttcaatttctttcattaatattttatagttttcattgtggacatcattcacttttttggttaagtttattcctaggtattttatttgtagctattgtaaatgggagtagcttcttggtttctttttcagattgtttactgttagcatatagaaatgatactgatttttgtatgttgatttttatatcctgcaactttactgaatttatttttcagtttcaatagatttttggtgtggagtctttaggtttttctaaatataagactatatcgtctgcaaggaatgataatttgacttctttctttccaatttggataccctttatttctttctctcatctagttgttctgggtagggcttccagcaccatgttgaataaaaatggtgaaagtgggcatcgttgtcttgttccagatcttagagaaaaggctttcagttttcccattcagtatgatcctagctgtgggtttgtcatatgtggctttatgattttgaggtatgttccttctatacccaatttgttgagtattttaaaaatgaagggatgttgaattttgagtgctttttcagcatcgatcaaaattatcatatgaccatttgacccaggaatttcattactgggtatatacccaaaggaatataaatcattctattataaagatacattcacgtgtatgtttattgcagcactattcacaatggcaaagacatggagccaacctaaatgcccatcaatgatagtctggataaagaaaatgtggtacatatgcaccatggaatactacacagccataaaaaggaaagatcatgttttttccagggacatggatagagctggaagccattatccttagcaaactaacacagaaacagaatgtcaagcactgcatgttctcactcataagttggagctgaacaatgagaacacgtggacacagggaggggaacaacatacactggggcctgtcagggaggaggcggggggagggagagcatcaggataaaatgctaatgcatggggggcttaatacctaggtaatgggttgataggtgcagcaaaccaccatggcacatgtttacctatataacaaacctgcacgtcctgcacatgtatcaccaaacttgaaataaaattaaatatttaaaaaaatcaattaaaagcatgtggttttgtctttgattctcttaatgtgatatatcacattattttttgcatatgtttaactatccttgcatccctgggatgaatcccacatgatcatgatcatgatgaatacttttttaatgtgctattgaattcagtttgctggtatttcactgaggatttttgcatctatattcatcagagatactggcctgtagttttcttttttctgttgtatctttgtctgggtttgatatccaagtaatactggcctcatagtatgggtttggaagtattaccttctgctcaattttttagcccaattttttagaatagtatgaatagtatgtatgtgtgtatttatttatttatttggagacagggtcttactctatcacctaggctggagtgcaggggtgtgatcttggtgtgatctgcaacctctgcctcccaggctcaagcaatcctcctgcctcagcttcctgggtgctatgactacaggtgcacaccaccgtgtctgattaatttttgagtttttgtagagatggggtttcaccatgttgcccaggctggttcttgaactcctgggctcaagtgatccacccaccttggccttccaaagtgctgggattacaggcatcatagttctttaaatgtttggtagaattcagcagtgaagcctttaggtcctgggcttttctttgatagaagcagtagtaaaaagctttctatctcattacttgttattggtctattcaggttttggatctcttcaggtttcaatcttgacaggttgtatgtctaagaatttatccatttcttctaggttttccaatttattgatgcatagttgtcctgtggtatcagttgtaatgcctcccttttcatctctggttttatttgtttggttcttctctcttttttcctttttagctactcctacaggaaagatcttttttcttaatctggctaaaggtttgtcaattttgtttatcttttcaaaaaaccaacttttcattttgttcttttgtatttttttaaagtctcaatttcattcacttctgctctgatctttcacttcttctactggtttttgagtttggtttgctcttgcttttctagttcttcaaggatgcattgttagattgtttatttgaagtttttcttattttttgacggaggcatttattgctataaactagcactcctagtactgcttttgctgtattccattggttttggaatgttgtatttcatttgtttcaatacatttttatattttcttaatttcttcattgacctcatggtcggttaggagcatattttaaaatttccatgtgtttgtacagtttccaaagtttcctttgttattgatttctagttttattccactgtggttggaaaaagtagttgatatgatttcattttttaaaaaatttttgagacttgttttgtggcctaacatatggtctgtccttgagaatgttccatatgctgaggagaagaatgggtattctgcagcagttggataaaatgttctgtaaatgtctgttaggtccttttggtgtgcagtacagattaagtccagtgtttctttgattttctattggggtcatctgtccaatactgaaagtggcgtgttgaaattcccagatattgtattgaggtccatctctctttggctccagtaatattttctttataaatccgggtgctccagtgttgggtacatatatatttataattgttatatgcttttgttgaattgacccccttatcattgtataatgacctcctttgtctcttttacagtttttgtcttgaaatctattttatctgataactgtagcttctcctgcttttttggtttccatttgcatagaatatctttttcagtctatgtgtgcctttataggtgatatgagtttcttgcaggcagcatgtagttgggtgttttaaaaactccattcagccactgtatgtcttttgattggagaattcagtccatttaaatttcagtgttgttattgataggtaagaacttactactgccattttgtttgttttctggttgttttgttggtcctctttccttcctgtctttctttgtgtaaaagtgattccctctgacagtatgtcttaatttcctttttttgtgtgtgtgtatctcttacaggtttttgctttgccattaccgtgaagcttgcaaatagcatttattaaccaatttaaaaatggtgacaatggtgacaactgtgattacaaagaaaagcaaagcaaagataaaattaaaacactacacttgaactccatctcctccctaccccctgctttcactttttgatctctttatttatctttttatactgtgtatctattaaaatgtagttgtaattatttttgatagatttgtcttttagtcttcctatgaaagatacaagtggtttatatgacactgttagtgcaactatactgttagagcaactacagtgttagtgtatttatttttctgtgtacttttacgagtaatttttatatcttcaaattacttctttttcattaacatccctttttttcagattgaatagctttctttagatttcttgtaaggtgggtctggtgttggtgaaatccctcagcttttgtttttctatgaaagtatttctccttcatgtttgaagaataattctgctagatatgatattctaggttagactttcttttttctttggcacttcgaatgtcattccactctcttggcctgtgagatttccatgaagatgtctgctgccagatataccagagatcctttctatgttatttgcttattttctcttactacttttaggattctttatccttgttctttaagggtttcattattgtataccttgagatagtcttatttaggttgaatctttttggtgtcctatgaccttcttgtacttggatattcatgtctccaggcttggaaatttctgtcatttctttgaatgaactttctaccctgatatttctctctgtctctctttgtctgtcctctttaagggtaataactcttagatttgctgttttgaggctattttctagatcttgtaggtgtgcttcttttttattcttttctcttctctgactgtctgttttcatgtagcctgactcaaactcactgattctttcttcagcttggtcaatttgctgttgattctgatgcatttttcagtttatcagttgaattttttagctccagaatttttgcttgatttaaaacaaattatttcaatctttttgttgaattttctgaaagaattctcaattccttctctgttatctttttatctatgttgctgagcttcctcaaggtggtgattctgattccctgtttgaaagatgatatcttcatcactgtgggattggtcactggtgtctaatttagtttatttagtgaagtcatgttttcttggatgttgttgatgcttgtggccactcatcaatgtttgggcattgaagaattaagtattccaatctttgtaatctggatttatttgtacctgcccttcttgagaaggctttccacatattaaaaggggattgagtgttgtgatctaagcttgtggtcactgcaggtgtatcagcactggggtgtaccctaagcacaggaatgctgcaatttctgctggctccttgaggaactgccttggtgggctgggttattttggttcttgcgaaggtgctttcttgcatgggtagttgttcaatttggtgttcctgtagggggatgcttgctagagggttctattaggccatcttgctcagacttctacgttgtgttttatcctcttaatgacgtctttcacagatcaaaatcttttaattttgatgaagtcgaattcattcatttttctcttatagatcatgatttggtgtcaagttttagagctttttgcctagctctagatcctgaagtttttttttttctaaagttttatgttttacatttagtttgccatctattttgagttaattttttgtatgagataccagacttagattaaagtgcttttttctcctctatgaatatccacttactccagcaccatttgttaaaatgaaaagactatctttcctccatcaaattgttcttgcatctttgtgaaaattcagttgagtatatcactgtgggtgtatttctgtgttctgtgttcttggcctgtgtgtttattcttctgccaacaccacacagttttgattactgtagctgtgtaaatcttgaaactggatagattcttcccactttattctttctaaaaattactttagctattccagtttctttccctttccatgtacattttggaatgatcttgtctatatctatgaaaaatcttgctgagattttgaaaggaattgtattcaccctatatatcaatctggagagaaaggatgtctctactatgttgagtatttcaatttatgaacacaatatgtttctccatttatttagatcaatttcttcgtgtgtgtgtgttatacaactcttgtacatgatttttagatttatatctaagaatttcattttttgatcaattataaatggtgttatatttttagtttcagtatccatatgttcattggtaatatatagaaatacaggtgatttttgtgtgttttccttttgtcctttctagatgttgctgaacttagttattccaggaattttttttatctctgtgtagattgcttgggattttctgtattgacaatcatgtcatctgcatagggatagttttatttatttctttcccaatatggatgcattttatttcttttttttgtgcttttcatgggtgtaacttttggctctatgttgaataggagtgctaagaacagatatccttgacttgttcctttttttgggagaaagcaatccttcaccattaagtagatactcatcaattttgtagatactaccttttaaaaaaatcaaattgaggaagttcccttctagtcccattttttgagggttttaatcataaatggatgttggattttgtgaaatgctttttctgcatccatttatataatcatataatttttcttctttagcctattgacatgtggattactatgatttttttaaaaaatatactgaaccagctttgcatccatgaaataaacccaacttgatcatggcatataattcattttatatattgctgaaatttatttgctaatatttcaagggtttttacatttatattcatgaaatatattggtctacagttctaattttttgtactatctttggttttgttatcagagtaatactataaatatatagtacaatatgtaatttattatatacatactgtaaacacttcataaagtagatcagaatgtaatgctcttctattttatagaagaaattgcatagagttgatgttaatcctatttttaaatgtttggtagaattatattatgaagctatctgggcctggagacttcttccttggaaatcaaaaaattataaattcaatttccttaatagttttaggattatttaaataatatgtgtcatattgggtgagttgtaatactttgtgtttcttaacaaattagcctattttatctctgaaatttatgcatgtggagttgtttatagtgtttccttattatccttttggtgtctgcaggtctgcagtggtatccctacattcattctttatattggtaatttgtgtcttcactttctttttaattgtcagagggtttaattctagagggttgtcaattttattgacctttccaaagaaatagctctttgctttactgtgtttttttctattgttttgtgtttagtttcatttatttttgctattacttcctttcttctgcttgctttgggtttattttactctttttctagatttttggggtagaagctaagattattgaattgacactttccctcttttctaatgtatatacttagtattataaatttgcctctcagcactgctttagctgtgtgttgtaaattttgatatgttgtattttctttgatattcatttcaatgtatcttttatttccctaagacttctttaaccattggattatttagaagtattttgtttagtttctaagtgtttggagatttaccggtttttgttatttatttctaatttggttctgttctggttggacaatacactctgcatgttttcaatttaaaaaaatttgttgaggtttgtttatgccccaggatatgatttttgatgcatatcctgtgggcacttgaaaagaatgtacatcctgttgttgttggggggaatgtcccataaatgttaattagataatgttgattgatggtgtcgagttcttttatatccttgctgattttctgtctagttctataaattgctgagaggaggtattgaagtctccaactataattgtgatttgtccgtttctctgtgtttcacatgtgttgcagttctgttgtgtatataagcatttaggactgctatgtattcttggtagattgaccctttcatcattatgtaatgttcctgtttctggtaatctactttgctgtgatgtcggctttatctgatattaatatagccattcctgctttcttttgattaatgtttgcatagtatctatttttgatctttttattttcaatatgcttattttattatattcgaggtgagtttcttgtagatggcatattgtgtcttatttttagttcactctaccaatttctgtctcttaactggtgtttctagactatttgcatttattgcaattataaatatgttaggcctcgagtttaccacttagtttttgttttctgttctttttcatttctcaattttctgttccttaccttcttgtgggttacttgaacactttttagaatttcattttggcatatctttagtgtttttgagcatatttctttgtatagcttttttagtggttgctctaggtattgcattatatgtatgtaacttgccacagtctaccagtgttattttataagttcaagtaaaatataaaaaccttacttccctttgtcttgttatcttcccccatttataatatacttgcattaaatatttcctctacatatatttagagctataatagaccatgttatagttttcacttcaactgttaaacataatttagaaactcaagagaaggaaagtctatcatatttatccataatttcacttcctgtgttcttccttcctgatgttacaagttctttcttttgtttcccttctatttagagaacttcatttagccattcttttaggtgagttatgcttgatatattcttagctcttttttaaaaatagagaacagggtctcactctgttgtccaggctcgtcttatactcctaggctcaaatgatcctcccaccttggcctccagaagtgttgggattacaggcatgagtcactgcacccggcttattcttagctttgattcatctgagaatgtattgtttctccttctcattcttaaagaatatttccctttgtatagaattttgggttgacagctcttttcattcagcattagaaaaatattgtgccacttcttcctggcttcctggtttctgatgagaaggttgctgtcattccagttgtttttcctctagtggtagggtgtcatttttctctggctgctttcaagattttttctttgctttttgttttcagaaatttaattatgatgtggtggtgtggatttctttgggttttcctgtttgggattcattcagctttttaaatctgtggggttatatctctttccaaatttggaagttttcagctattctctgagtattttttttcagcctacccctttcttttctctttctgagtctttgattacttgaatgctccatcttttgctatagtaccatatgcccctggtgctctatgcattcatttcctcagtctttttttctctttcattcagattaaataatttttgattgttctatctaaaaacattgatgatttttcctctatctcttccgttttactgttgagcctattcacgaagctttatattttagtttttacatttttcatttctaaaacgttcatttagttctgtcttcgatttttttgctgtgactttaccattcgttgctgagacttatctcatttgtttcaagcatgttcataatcgcttgttgaagcacttttctgatgctcctttaaaatctttgtcataattctaacatctttgtcatcttggtgttgtaatctgttgattaggttttctcctcactctttgtttatctttctggtttttagtgtgatgaatgatttttgccaaacctggatgcttttgataccatgagacttgggattttatttaaactttgtttcaactggtttcctttgaccctattccagtgggggagagaagggagtgctgctttgctacttcctagtggaagtaaaagtccgggtttccctcttggcctccattaatacccaagaaagggtctctcattactgctgggcaggtataggagttctagctccttatgtggcttccactaacactgaggccagggtggcctcattatcactggacaatggcataagccctaactctctacttgtcctcctctgattccactacagcagggaggtggtggtggtgatggcagctgcagggaggggagaggttattactgccaggtgtggggatgtctagactttctatgtggtttctactgataccatgaggtggaggagggtttgaactaccctgtggggatgaaaattcccagttctctgctcggtcgtctctgataccaacctagcaggaggctgggatgacttgatccatactggcaaagatggagctctagactccccattcaacttatgctggtgtgggtagggccagttttttcttgttgttttgttagtttataggatttattgttaaagttttcttttttgctgcgctgtccctttcctggtcctttcgctaaagagcaggcttttgtggtctcttttggttggttaccattggtatttatgggttgctggcttctttatttccaagtctggaatatacgatggggaaagaaaatctttagaactcacctccatatcttcccttggaatctgaggttccctagccagtctgccttcttctctacacctttcagagtcttatcttctttcttttatgtgtattgcccagggattttagttgttcttagtgggaggagtacagaaaaaacacctatcccatcttcctcaaagatagaattctatgtatcacttttgaaataataaatcttaagacaattgaatatatttttggaaaagggtcttttttgataatagttggtaaatatggcttctacatttattgaggttttcttatctgttttctagtcagtgggctgtgtgtgtgtgtacacaagcttgttccttacagataactagaatgtcgattttaaaaaagaacttgctattgatttgattcagcaataaaaacgcataatgcagcagtaaggagaacatgatccctgtcttgtaatctgtggcatttccattaaaaagcatgtgcttactaaaagcctgcagctgttagtgtattaatggaaataagacacagagcccaagaagtcagccaggaaattaataggatcatgtcctggtagatgccttgatcagccaagaatgaggaatatagaaaaaaggtctttaagttctgtactactttttctttgccacctctcccaggggccctggactcgtggcttaactatcctaaatagtcttgtgtgtctggcttaattaatcttcactctgctttctgggaaatacatttcataatttatgtgggtagctaaataaagttcttgaagacacatacccaatattaaatcaaactaagacttgccttcttcttaaaatactagagagtctttaatcttataaagttatgcattggtttgagggcgtgctctgtttaagaattccctgttaatggaataaatgggaggacagctccctcatagcccgtcttatgggcaatgactattttaccattttattagtatctgtgccatgaaagcacgatttcaatcaaaatggtaactaatgaggtatttttaaggctgtctaatttggtacttacctgatgactaatctaactatgtgagctgaattaagatgactaagtagccaattctaacaacaaaaaactcaaaatagaggagttagatgtagtgacttgattctgagcagatgttcctgatagcttgatttaaaaatccttgtttaacttaattgtaaatcttcttttcatgttatttcactgtttttattttattttcttgaaagtaatctaccattagtattttcatcagttggattgacagctaaatcctcagccatgtatggatgtctcttaattatgacaaaagacctacagagctaaaaatgttgaataccagatggacactgaattcataaattagtcatctttcattatctacccaaataatatttttaaaaagaaagctttaattctttagtagtctatcgtctatcttccttgcattgcttaggagacttgttaacaaatgttttattttgtgtgtgtgtgtgtgtgtgtgtgtgtgtatctattctggtacttctcttggtgcatgatatggtttggctgtgtccccacccaaatctcaccttgaattgtagtaatccctatgtgttaagagatccttccttggggtcgagtggaggtgattgaatcatggggggtggtttcccccatactgttcttgtggtggtgaataagtctcacaagatctgatggttttataaatgggagttccgctgcacaagctctcttgcctgctgccatgtaagatgtgactttgctcctcatttgccttcagccatggttgtgaggtctccccagccatgtgggactgtgagtcaattaaacctctttcctttataaattacccagtctgaagcatgtctttattagcagcatgagaacagataaatacagggcatgatacagaattatccatgtgagaagcagtttgaatttcaagcattggctttgtaatctgagcagcttttgagttgaagtttgtatctggattttttttaacctaaattcatgtgatggtgttgtatctcctgatcagcactccaaaacttcactttcagatgactgcttatctctttgtggtgtttcaaccagggcctccaaagtgaattttgtgtgacatggcctatattttaagtacacattctagatcaccaaatattatatatatatatccatctactttgtgattcagtaatagacaaccttagcctgattgaataatgacatatacaagttttacattcccagaaagttttagtcaatatctttaatacatattttaataagatacgtgatctaatgatcttttagtcacactgaaaattttagtcacagtgagcaggggtcctcaacctctgtggcaaatattagcccctattatatatacacttaaaactatgatacacatttatgtgatttaccatgaatattatagattttccaataattcttatcagcttcatcagatgttgtagtgatgtatttaagaccttttaataatgcagactgaaatgagattaccattttctttctagatctaaaaataaaatggaaaaaataaacattatatagttgttttataaagacagtccacaaaatgggggaaatagttgcagaataaataattcctacaaatcagcaagaaaaaaaataggcacaatctaatggaaaatgggcaaaagactggattaggcactttacaagagaaggtatctaaatggtatatcaacatgaaaaacactcagtttcattggtcatctgggaaatttaaaactacattgagataccacacaccagaaaaatgaaaacagtaaaaaagatgtaaaatactaagtgctgatagaaatggaaagcaaccagaaccttcactgttggcagtaaatagtttggaactctagttggtagtatctactaacactgaacatatccatgtcctaagacccaagatttctagtcctaagtatgtacctggctaaatatagttatgtatcatcaccagaaggtgtgcaaggctgttttgtaataatcccaaactggaaaatacccacatatgcatcaacagttgaatgagtaagtagtaatgtatctacacagtgggatagtttatagcaaagagaatgaacaaactacaactacctcccacaatgtgaatgaatctcagaaagtggagcaaaataagcaataaagtaactcatatcttatggttccatttatatgaagttcatgaataagcgaaaactattgatgatgtttgaagtcaggatggtggttactctatcttggaacatgtgactagaaggaggcataagctgcttctaaagaactggtgatgttctatttcttgatctggggctggttatatgggagtattcacattggacaactcgttgaggtataaatttattatctgttcacttttaaagctgttattttaataaaggtttaaaagttttcatcccagacactggcaataactttaaataaagtggattggggcccaggaggagtcagtgcctggttatttctctaggttgctagtttctgatcttgatcttgacatgataggtctctactgtgcatggggaagatgaagactttggggttctctctttgctaatattttccattgaccttacaaaatattagtgatgatttggaaccaaaacgtgtgatttttaaagatacaacattttaaatgcttaggattaaaaataaacttttgtaaaacagcagttggtatctttgtggtgtagtggaagaaaccctgaatgagaagacagtggacccatgttctagctactttttgttctcctccagcttgatgaatgggggcaagtctaatcctcagttccttctctctaggattaatatgttacctgcctaaagggaaagggataaactatgctttaaactacaacttttttactattttcatttttctggtgtgtggtatctcaatgtagttttaaatttccctgatgaccaatgctctatgctctcttggatcctttctgaaatataagatccaccctctgttgttgtgggagaagctcttaaaggaagtgatgccacttattcataccatcactcatttccaaccttttattctgtggacatgttcaattataaatatggtccaaacacaataataaataatagttggcatatagctaattgttatcttaatgctattgatcataagggtatctcaccttatcttcactcccaaattgatttcttggttttcttaggatttgttgttctgcagcgaggatgctttttaggaaatgttccatactggtgaagagcagaagatctttgtttttatgaatatactgtagagaatgtggaagacagagttaatactcttgttaccatttattttaagtgcccttggatcttgttagccagaatgtggacctgagagtactatgtacaattttgcttttaaattaaagcaatatctcttcatagggggtggttagcagaggactaacattccagctccacaactattgctatgtcttaggcaagtttggtgtttttttttttttcacttctaggcctcggtttcctcatccataagttaggaataagagtggcttccaccttataagagcatgagaagattaagtgagatgatgtatgtaaaactctcaatcataacatggcatgtagcacatggcaaggtaataaatgtttgctattatctgtcttatagttagctcaggtagattgtggtttcagtatattgcatcagggcccatataaatctacttgttcattaacacagtaaatacatctcaagcctactgtgagcctggcacatggcctacatcaggaaatgaaacaaatctctctgccctcatggagcttacattccagctgaggaaggaaagtaataacaagtgtaagtaaattatgtagtgtgttaggaaaggatataggaaaacttaagagaaagctgctgagtagggggaaaagagttgcaaattaagattggatagtcagggaaggcctcattgagaaggtgatatttgaaccaagataagaaggaggtaagggagtcaggggtagaccaggattggcactattttgggatgagtaactctttgctctgggagctgtcccatgcactgtaggctgtttagcagcatccctggcctctacccactagttgtcagtggcaaccccttctcctgagtcatgccaatcaaaaacatctccaggtattgccaaatatcccctgggggacaaaaattcctcctgggtgagaaacactgccctaggggaaagagtattccaggcacagggaaccctcgagagaagtgtccctagtgcttgaagaacagtgaggaggaaagtgtggttggagttgagtgaatgaggggaagggtagtaggtaagagagtgagatataaggcctcatgacaatattatttggcttttgctctgagtaaattggggagacacagcagattttgagcagatccaatttccattttgaaaggatcactttgctgtgttgcaagtaggctgaagagaaacaagggtggacttgaggaagccattagtaaggattatagtaatccgggcaagaggcaatggtggccttttcacaagggtggtattgtagttgatgagcagtggttggattctagatatgctttgaaagtagaacaacaggatttcctgatggattggttgtgggtgtgtgtaacagatgagtttcaagggatgctttggcctgaaaaacctgaagaacagtttctatcagttgagatgggggaaggttttgagtggagcaggtttggaaagaaattaaaaattgcgttttggacatgttgagtttgaaacagtcaggtggagatggccaataaacagttggaggtatgggttagagaattggggttgaagatagaaatttgagggtcattgacatatagatgagatttaaagctggaagactagaagagaccttcaagggcagaaaatatagactggagaaggggacgggactgagtcctggccctccaacattaagaggccggagaaaagagcagggatcagcaaagaagactgagaaggaacaatcagagaaggaggaaaaccagaggaggccagtgtcttgggagccaaatgaaaaaaatatgtcaaggaggagaatatggtcagatatgtcaaatgctgctgatggatgagcacagaaaatggactgttctctgtgatttgtgggaattggggtccaacagaattctgtggtctggattaccgacatcattatcaaacccacaaaataaatctgccttagtaactaatagagattcaatgatggagatatgtgtacgggacaattacttagcaggattcaggaaatctagaatctagtctcagatccaccactacaaatagctttataactttgggcaaattccttatcttctttttcaataatgtggctaaaagtatagacactacctactttgcaggattgctgggtggatcgagtgacactatatataaaagtggctttgaaaattatagtttgatataaatattgaaacatgatatgttcttgttcataagaatgaattaacctttagtgcaggatgatatttttcttatcatagacttaaattttatgatttttatttttaatagttaaaatgctgagatactttcaaaaaagtgttttattgtattttttgagataggatctcactctgttgcccaggctagagtgcagtggtgtgatcatagctcactgcagcctcagcttcaaactcctgggctcaatggatccttctgcctcagcctcctgaatagctgggactacaggtatgtgccaccatgcccggctaatttatttttattttatttttgtagagatggggtctcactgtgttgcccaggctggtctcaaactcctgggctcaagtgatctttctgcctcggcctcccaaagtgcagagattacaggtgtaaactactgcacctggcaaaagtgctttaacaagatattaagaatatcattatcaagcttgcacagaaaacagcacaccataagtttgggtaaacatgctgccacttgggcatctaaagttagtatgagtcacagttttacagatgggattctgcttaattattgataatacattagtgagacatgaagttagcccacatttgtactcctcatgactcagtcatgtaactactgtctgccctgtagaataggatttttattgtcatgaggccaggtgccatggttcatgcctgtaatcccagaactttgggaacactgaggcaggtggattgcttgagcccaagcattcaagaccagcctgggcaacctgacaaaaccctgtctctacaaaaaattatgaaaatttgccgggatggtggtgtgcacctgtttggaagggtgagatgggaggatcgcttaagctcagcaggtcaaggctgcagtcagctgtaatggcatcactgcactccagcctgggcagcggagcgagatcctgtctcaaaaacaaaacaaaaaatattgtcatatgtggcttgaggtcagaaatatctgaatacactgaggcatttactctgtgaagaagtccattttagtcaagaccatgtgatacacatgataaagttagttacctcttctagtgattctggctccaagggagatacatgcttcatttcaatgagtttagacagaagatccctttctctgtcagagatgggctgctcttccagcaggatagcacttatgctttggtcaagtttactgtccctggaaactgctgccattctcagtgtgatagggaatgcttccctgaaataggcctccaggcccttggtcaagggaagagaaggcaagggggacagatcagtagggcttctatacaattgctgttaaagctttaaaataatagttgaaagaaaaatggggcttgagagttctcatctttacttgccctcaccatgggttatcattgtctttagcagttctggtgcagtttatgtgtgaactgttaaacagccacagaaagctgagatgctgtgctcataggaaaaccacttctgtgaagcagtggtacgtgcattttgtcatatgctgccacgggaaatctgattaggaaaatcctcttcctggccaggcaggaggaaccaaaggccacaaggggactcaagtagatttgaaatgttgcaaagcctaaagcatttattctcctggggaacggggtctgagtcacagagaaagagaagcaaaatgccctgtacatgttataaataccttgtaaaatgaccccagaaaggcagggctggagtcctggtggggttccccagcagtgatgtgggccaggcagcggatcagcagcagaacaaagcttcccacagaggccaaacattctctcccaatgaacagtgtgttttcagcactgtgagaggagaaaacacccaaacacagagatgtccgcccctgggaacattcccaccgcccgtttctttctcagggtttatggcacatggtctaaaacaatactctctggccctaatggaaatttgctgaagggaagattcagatgaccggggaaaaattgtttgagttcaactctctgaataagtcatttgctccactgtctcccaagttttcctactgcctccatcttacagaaaacaaacttagaaattcagagttacttgtgtatctcttttgtcaatatcctccaatcactgtttccttaagcagtggttttcaaacttttgtgtaataagaatcacaagggggtgattctgttctcgagacccatccccaaattcctggatctgtggggtctatgtgcttccatttttcccaggttccccaagtggttggttcaggaggtctaaggatcacagtttgagaatcactgccttagagggctctcaaggctttcttcatcttccatgcctttattgtaatcaagttttcaaatcgcctctcttgcctgttgatttgaagtaactctcttgttcattctcttaagagacagtaggttggcatgaaaaaacttcaggtagtttggaatcagacaatctgagatctatcctttgactcagctgtgagtggcagctgcatagactcatggttatgagtttttggtgtcaaacacacctgggctcgagttttaactcttgctaactctgtgatcttggggaagttacttagcctctctgggcttcaatttcctaatttctaaaacaaagataacaaaagtaccccatagtgttgtgagtcgtaaatgagaccatgcctgtaaggcacctggctgagttcctggcacacggcacttgcaccacaacctgagttcgtttacccatccataaaatgggattaaattctcgtctatttcatcgagttgctttgaggatcaagtgaaatgtgtggagagtaccatatgtgagtagtttctggttttattaaaccccccaacaacctactagtcaagtataaacctttttctaaccctccagtatcgatgagcagtttctcctctcagaattgtttagcaatagactgtcatcagtgtttaaggcagttaccagcaaggcacttccaatctacatatctgaagaactgccaggacaggaacaatttagatccttttctgtagaaagatgctgattgtccaggattttctgaagctggaaccatgactcttataggaaataccagcctggaacctctggctttgataatgacagagatctattaaagggcaccaagctattatgcttctctgggcacaagccagaacatattcattttactgattagagaaagctcttacactgtgacatttattatgccttagctaaatgacttatttccaggagggaataaaatatgtcaggattttaggaaaaaattataaaatttgttctttttgctttcatttatctatactggaccccagaattttataacccacatctgggaatgaatttgcagcacctggtagaagaaggcaccttggaaggcactgccttgggcttccatggcaggaagatgagaagaaatcttcagggtgatttctggagcctgaaaagaataaaaaacaaaaccaaacctatccttttgctaaaaaattctcatgcatctcagctacgtggcatcagccaaattgatgagaagtaaatgcattggggcattaatttaaattgcaacagggtaagtaggcttagtatacaggaaaatggaaagagtaactgcatatttaatatttatgctaaatatgacaatcaatttactacttttctaaatagaacttgactagactagagagatttgagccatgatgcctagattttaaccttggctctgcctttttggctgtgtgatcttgggtaagtttatgtaaccactgtgtctcttctgctcaattttaaaataggaaaaataatagtatctgtctcatagggttttttgaggattacatgagttaattaatggaagttattagaatattttctggcatgtagaaagtgactaattcattctacctgtgattaatatcattcgagagattagactttggattggtaaaataactcccataaatccccttaaaggagagactagaaagtttgctgttccaggtgcttaatcctagggaatatctgccatctcaaaggcttcttcctggctaccctgaccttctaggctccatgagtaactgctccatagagaggccagaaacaagacttacatgaagctgggggataaggaggtgcaggatggagaggccatactggtaaaccacaaactccctggcagaaaggtcagtgggttgcacagttatcaactcttccttctgcagtgtctgaggttttagaagatcctgcagagagctctttgggtctacagagatcaggagaaaccagtaataatttcactaacttttctgtacaataatgatatgttaacaacacaactcaatttaggaaaaggtttattgcaaccatctatcatccatccatccatccatccacccacccatccatcctcctgtgctatatatgcatcatgctacatggtcttctgtccacctttatggaaaaaatgattttcagtcaataggaacagaggggctaggacagaatgagggtccacagaagatggcaacagattttcttcttctatttccttgagttgcttggagcattaaatgtaatatactcagaacagtgtctagtacatagaaagcattcagcaaatgttaaatatatttaagaatcttacttccctacaatatctgtacggaatgtctgtaatggccttgagtatttaaaatttctatttttttaattgtttttgagagaacaataaagaatggattggtagcaaagtttagggaagactgctgaagtagcagtcagaagacctgtgttctggcccaggttctataagaccccaagaaagtcactgaacttctttgagcatcagttctcatctattaaaaagtaattaataaccttctactatcttctagaactagaagatataaacaagataatgtatataaaattactctcaaaattacaaggccagtataatggcaagacgaaggttgaagtggggctgggaacccttaaaggagagctcatttctctgccattcccttcctagtttcacccaaagaaaggaggaattaataatgagattggtcaagttctctggagtcagtaaactttttttttctggaaagggccagatagtaagtattttaggctttgttagccaaaagccaaaattagggttcaaagttagtgttccctttcctcacggtagaagcatggcctcattctcctacaaagccttctcttgcttctctggtccagaaaagcaagtgatctgccctcctgggaactcaccaaaatgtgttacctgcatcttcttttggcactgccttcatagtgttgaacaacttttcatttgaggaagcacgtgaggagcacagggtctggggaaagactcttggggattgaattccagctgaactactcactagcaatatgatctttgaatactttcttgacctatccaggagcttcagttccctcatctat

SEQ ID NO: 12798 - DNA, 45183 bp, Human
cttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcagcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcccacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgaaccactgaaagtgagtgatggcttttatggtactggagagacctttgtttttacattctgtccggagtttgaggtaagaaccactatttcaatattttatttataaagaggtgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattagagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcagagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatgggtatttctgcagaaaattgtagggacccctcaagttttcaggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccatccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttctttctttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaatgagtttggatttattgaatactcattttcttaacaagtctttgattaagcctactactatctttttttttttaatgcttctaatagcttacattgtggtggtggtggtcatggtgttaggagtaatagtgataggagaatgcattcaattagagggagcattacattttttaaaatggagatgggagaaggcacttgacacatgggaaagtgtaagttatttgatatttttaaagtacattgttttcattttgggtggagaatgcataacaagctaagccccttatcataaacagttatgtgtgtgcaatgccaagaaattttgatattttgtatcccgtaggttcagttaacatttgagaggaggaatgacatgatcaggtgtatactttaggaaaatatctgtgaaaaatagatgagtagaaggaacaactagagacaaggggaaaacaagccttttataaagtccagaaaaaaaatgattaggcccgaataagaacagtggtaatggtaataaggaagcatggatttggaaaggatttatgagttaggatgaacaggagttgattattgattggatgtcagaaaaagttaaagatagctcccaggattttgatttaagagtttagttgtattatttattaagatgggcaaggtacatagaggaaaaacaaaaaaaagcaggtggcaaaatgaagttagtcgtggactttatgagagtatgatgtgagaaacaggagaataaactttttgggagtaggacattttatatactattctgaaagatgaactttaaaagtcaacaaaaaacaataaaactctttcactttttatatgcaaacaaatatgaaatttatgtattaccatttgtaataccattgaaaatatcagatatataacaaagtgaagaccaaaataggaaggatataccatattcattactggcagacaatattgattaaaagatatcagttctcttaaattatattgacagtgaaaatctcacccaggcttattttttggaaattaaactgattgtagagtttatatggaaatgtaaaatcaaagaatagctaagccatcatggaagaattgagtgtctggtcttcagtatcagataatcatgatttattagaaagctgagtaagaaagacaatatattggtcaaa

SEQ ID NO: 12799 - DNA, 68719 bp, Human
cctcaaggcaatcccaattcaggtgaaaagctgttcacgtacatcatccaatgacctaaaaatagtcttttatgtaagtctctaagtatttaattcaacgtatgatcttaccacattcaacagaggcagaaaaaaaatgaattaggttttctatagcaaggccaataaagatgaaatcatagttttcctctaactcatcactaccccctcaacgtcagccttccaataactccattccacagctctcaaattcctgaacttggatctttaaaaaacaacgaatcgcaaaaagtaacatttaacaggccagaggcaggcgggggaggagggtctctcccggtgctctcagcaatctttaacgtagccaaaggaggaaaaaacgaaatcaagctcccagacggatggtgcatgcgacgagaggggagggggcagacgcggttcagacggcaagtccccatcgaaggaggaaagaaaagttgcaagaacggattggtcaaagggcagaaaagaaaaaaactgagcagccgaaccactcacaacccccaaacgaccccgccagcccacacgttcgcgggctccccagccgcggcgcgaagggagcaggcagggagccacccggctccgtcccgacgctgccggcgaggctgcgccgatgctcccgggtgcgggagcgggctgaccgtgtggacccggcaggagccagagaagcccctcctgccccggcctccccgcgtccagctcctccaggcttcactttcccccgcaacctcccagccgcgcccgggggcgtccctcgcggcaggtcccaactttccttcctctgggggcgtcgcgctccagggccgccgccgagggagggggcagggccggcagggggcgcgcggcaccggcggggcgcgggggtggccggggagctagtagccgcccgggcgggacgaaccgagcgcaagagccccggcgcggcgccacccagaacccgcgccgccacccaagaacccgcgccgccccgcccggattcccccgggtcagcgccctcaacccgcggcaaccctggtcccacagacggcgcgtgagtagaagacaaccgagcggacgcggacagccgggccgctgttacctgaggggcgcacacgccgccgcggcgaccaccatcaccgtccgtcccgtccccttcctggtgaccacggccgccgccgccgagcaactgacactgactaacaacaactaactaactactcgccgcggccgagtccaccgcgcgctcccggccgctcgccgcccgcccagcccaccagcctgcccgcctcctctcggccccgcgctccgcccctcccgcgcgcgccctcgcccgctcgccgcgctcctggagccgtgagcacgcgcgcgctcacgggccccggtcgtctcccaggtctccctcagccccagcgggaggagtcaccgccaggcccctcctctctgccttccaacctccagaggacgagacctaaagggtgcctgattggctgcggagggcggggctaagacaaggggcggggctgccgagaccttgggcccgcgtgagggaaaatttgggttcgattaagccgcagaggaaaagaccaggggagtctgggcccatttgggcgtcggggcccgctaggtcagccgtcatcgaatacagaatatgttttcgaggacgctaatatgtagtcatgaccaatttcagttcttctactttctgcgggccttcgcaataaaaaaaaaaaaactacatctcccagaaacctccacgaaaataaggctcaccttgcgtaaccacgtagtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcaggtcagtaagcaaggcgagcttgggggtggccccagtcgagatgcccttcaccccttgaagatcacccctcttttggtggtggtggtactggtttgtctcagttggaggccggctgaatgggggcgcctcaacttccggttgggggaggggaggaaggccgtcctggggaggggggacaccctcacttcctgtgggggggtggtgatggtttgggggtgtccgacccacttccagtgctggtgagggcttgaaaaggtggtgcttggtgccattcgcggagacattatcttgcagcttggggattgtgttttatgtgaaaagttagattattccaagttgtgctgaacaccaacctgcagtcagaatttatgagtttgcttccacgtggaatatggagcatttcctccccagcaaaattgtctgtgttttcttcaaagaattcgaaagcccttgttaaaaatctctatgcacctttgcaagacgacatagcttgtgtgactgatgaattgccaacacctgcacccctactcaagtccagccttggctgggtgaagtgtggtgccctctgccttgacatgcaacaggaaatctagcttctcttttaaggagataactttttatttaggggactgaatattttacataaaatctggggcattttcatcttagcagaatgaaagtatcacactgaagtactcaaatttgaggttaccttaactgataaaattgacatcttaaattattaggactgttgattttgggctacaggttttgccctgtgcctgagaacagcttcttcagccttaaaaattcttatgtgtagcttacacgtaacatttttgaaagttgtattttattacattttcctcctttgtaatttaattcatcactgatttttaaatggtatctgttctttgtggttttaaagtataaagcaagggtcatgagactcagctcagattctaaacaggaaaaagttggctcacaaaggacaaaaggtcaataagaactttctggttttcagtagctcatttttaataaactatatgtgaggcggtaataaacactcaataattttgattccttggttctgttgtcagataacacaatacttagaagggtgtgtgtctgtgtattgaaggaatcaatctatttgaagcttactttgtgaaatctgaatgttagtaattttagtatatatatcagtgaacctagaactgtattgtcttgcaagaatttttgaagtaataaggcctgtgtactttttcttttgggattgtacttaatctagcctcagactctgcgattattttaattctataatagtttttttaaaaagctgtttggtcacgcctgtaatcacagcactttgggaggcctaggcgggcagatcacgaggtcaggagttcgagaccagcctggccagcatggtgaaaccccgtctctactaaaaatacaaaaattagctgggcgtggtggcgtgcgcctgtagtcccagctactcaggaggctgaggcaggagaattgcttgaacccgggaggcggaggttgcagtgagccaagatcgctccactgcactccagcctgggcgacagtgagactccgtctcaaaaatagataaataaataaatagctgtttgggttagggttcattagaaaatatgttttaaaccaaatattacagtaaaaaaaaatacatgttttaatcttctgtggtcacttttaaaaaagaatctaagaccctaaaatcaagtatgatttatattttgaaagaccacacgattgctgcagtagttgactgaaaaagcaagacaaaacattgtctttgtggttattaataggttaggaacatgtagactgcccgaagtaagaattaattgattaaagaagaagtgttcactatcttctatattaatgtaatatagaagaaaatataatatggtcaccctgacaaatgaaactgtagtgttaggaattattgaagtatggaaagattgtagaactaaatgaaaaaaatagagaatatcatgttaaaatactgattgagatagagtaatattgccttttggaaactgtctttattaaattggtctttatggtactccatggaagaaatacagtataatagaaataagaaaaattgttgcagctgaaagacttgagcagcttgaagaactatctgtttagaagaaagcaatatataaaatacctatctgaaagaaggtattttgtgataagtggcagttattcattggttccatcaaagaagaaatattagaaaagcttgtgaaaaatagagagggaaggtccatagaacctgtttttattctttttaaaaatgtttctttagagaggcttgctgtcctccaaaggtttttttttcttaatgccctttgtgcagttttctttgcatgtttaatagaaatatagtatcaaaatttaaagaattaatatttttgtacatgtactgttacttcaagttaatgaatttgagatttcattccattacttgccatatatgtaacaaagaaagtgtcaaatctttttttcaaatacttggattagataaccattttcttttccaaagacagtcattggatacactgctcacagcagtttgaaatattaaaaccgtaggtcacaattctggattccatctgactgaaattagattatccacagagatgttatacataatacagaagtgtcttttcattctttcatctactttactttgtaaaatcaggctaatgttttgcaactgttgctttccttgtttgtcgttttggtggtggtttgtttttgttgttgtttttgccgtagggttgaggattaaagaaagtatcttaagaacctgaatggtttttcaccttactgctttgctgtctctatttcatagccttcacaggtattcaaatgagaataccctttacgtgacttttcattatttaagcaaaagtttagagtgtctactatatgccagtcactgttctcaggactttgaatacagtaaatacggccaaatattcatattctactgtagtttactctctaatttacaaattaaaactagaattttgctcccttggtattcctaaataagatctatgttatgatcgttgttcagactgggtaaagaagcagccctaaacttgatctctcctggtcttaatctctaagccattctaaacccagatttgaatgtttcagcctaatttttctccagaccatagaagcccctgtgttaaatatgcagtccctttcattgatacatgtatcattttcctaccattctagcttcttttgtattgtgaaaacaaatgagagtgaacagtggggaaaatatgggatcagataggcccaaattcagcactggtctctgcattttactggctgagcttactagcttggtaaccatgagcaatttatttgacctccctaagcctcagttttcctaaatccaaatggggttgtttggtggaatcagaatgttgtatgtaaatctcctggtccaatgcctggtgccagaagcttcattaatgcaattatcttacccccaatcttgcttctgctactctggctattgtgatttgcccacatgtctgttttaagctttacattttccccacagtatgggatgcagtggtagactgactgagcttcagccttgtccccctatcagcatgctcacatagttgtcaagatttaattttttttccttgtgggaaggagaaatcactaatttccatgattagaagatatacaaaatagaaaagtttcaagaaaaggaatcttaatcttggcacaaatcactaaggtaatttgaattgttacaggcagactttcaactcattctcctaaacttatttaaatacgaaaaccaaaaatgacctttcacactatgatcatacctcacattattcatctacacatccaaacgggatcgcctctggggggaaaaaaatctgtactgcacccagcattaatatttttttttgctcatgctattttctgcctgaaacactcttttttcctaggaatccccatctatcaaaatgccactttctttgaggtcgtttctcaagtaccacatttaagaaatattttctgatatccatcctcttctacactctcccaaactgtacacgttctgtccattaactctccagagcattatacctttcttacagcacttactgtccagtgctcctcttgtttgtttttattgcgttgttgtaggtagagtttatgccttccctaaaaggctgcagactaggtcttattccactctgtgctgtcatacctggcacaagaccattcacatcataggtattcagtaaatatttgtggacgtgagctggctcttggagtatgacaaaactgatcaataacttttgtccacaattatgcccagcatcagcacaatggctatcatacattagacactcaaatatctataaaatgaaagagtgaatagtaagtcatcattctctcatttgggagcttcttagggtgtcagataagcatatattaagcacctcctatataactggagctgtaagaactgatctctgctcctcaatttaattggaaaaaagtaaattgttactaatatctgcagactttgaagatggtaggtgtttgagtagggatggcatggagagcttaatatagaattgtttgcattgtgagagataccctctgctacctgaactcagaaaccaaatagatttttatatcaaatatttggacacttaacttgtatttccactcctaggtatatatccaagagaacttaaaacatgttcacacaaaaacttgcacacaaatatttgtagcagccttatttgtaaaaggcaaactcaaatgtccattaattattggatgactaaacaaaatgcgatatagccatacaatggaatattattcagcaacaaagagaaacaaagtagcaatacctgctgtaacatggataaaacttgaaaatattaaagtgaaagaagtcacatacaaaaggcaacctattatgtgattccatttatttaagatgtctagattaggcaaaactaatagagacagaaagtacattagtggatgggaatgggagtgactgctagtatggagtttcctttggaagtgatgaaaatgtgccagaattagatagtggtggtggttgcataaccttatatactaaaatatcttgtatactaatatacagttgacacctgaacaatgagggggttcggggtgctaacccctgtgttgtcaaaaatccatgtataacttctgactccccaaaaagttaactacgtaaatagcttactgctgactggaagccttaccaatagcataaatagttgattaacacatgttttatatgttacatgtactatgtactgtattcttacaataagctagagaaagaaaatgttactaagaaaatgataaggaagaaaaaatatgtttactatttattattcgttaagtggaagtggattatcataaaggtattcatccttgtcatcttcacattgagtaggctgagaaggaggaagaggaaaggttggtcttactgtctcaagtggtggaggcagaagaaaatcagcatataagtagactcatgcagttcaacccatgttgttcaagggtcaactgtacaaaaaaaatcctgaaatatacactaaaggggtcagttttatggtatgtgaattatatctaaaagagagagatacttagacttgaagaatagagaattttgaatggagccagaagaaagaagcaagaggtgtgaaagcaaggaaatgatcattctttctcagatcctagagagaaatataagcagctaggtacagggctaaaggtatgttaaggatcaggtgaggatggatatgaggatagcttctgggtttttgtcttaatgtagcagggattttggtaaatacttagactacagaggtattaacaaaggagaaaaacatcttatgaccttgaaggaagcttcagatttcttcttgattaggtcaaggatgtggtatatggtctttttggtttctgtgttacggtcagctgagtttaaagagtgggagtattctaaggtaaggagtctagtagcaatcaaaacaaagttactggggaagatgggagaatagagactagacaaagatgttagaatttgattctaaagctctcctcaggtaataaaaatagataaatcttaatgagaaggaaccaagggcagtgatttggagaagtcagtacaaataaaggtattcatttgaagaaatatttgagtgccttttatgtgccaggcactattaaataaaactatagctattttccttatttgactttttttctgaagataaaatcttatgagtgtgattaatggttctacaagcatgggtagttctagatatgatacctacatttccctaaaagattgtactgatttttaatgataacagcaatgtataaggatgttgttttcaccacgattttaccagcaaaaatatttggctagttgaacacacataaaattattgttctctttgcttataatctgataagtgtttccataccttggaacctggatctgttggaacatgaaggaattcaggacccttatacatgttaccccatatggcttctttaaaggatatggatttttgaggatcctagaaatcaaaattctctaattttattcagctcaaaaaaaaattttattcagtgctgctgtccttattttctgaataatattcagattcagaccacactgagccataattccaattcccacttgactaacatttatgtagtattgtgctaggcactacatgttatcttaattctaataatttggcatttttccatatgagaaaaataagatttagaaagattagattacttgcccaaaatcacttaaccagtaagtggtagagacaggatttgaatgcagatcctctaaggccagtgtttattctcatactgcatgatccctcagtatcactactaaaatttactggaggataatggaaagtggaaaatctgaactggaacttgggacaatcaagcactgacttacctgtgttcataatgaagcatttagcagagatgttgtttgttgttttgttttgtttttactggggaggctatagtacataaacagagcgaaagatcttggtatggttaaacccacattttcaaggccttctgtgttctccctgatgatcaggtacctactaccccaaaatctgtgatggtaacaaagaaggaggaaggcagctgtagaaaagcaacggcctttgggtatacccagtaagatttatgtgattgtagaaagagcaggcaaatggcttggccttcagagaatcccacaaagtaaagtaaccttttaaaatagtaacttaaagtctgacataagattcttaacaggatattcatcacaagataagatattcaaagcatagcgtgtaagacattcaaagcatatcagcaaaaaaggagagattccttcatttttattgaagtatggtatactcacaaaacaaatttaatatcaggaatataaaacaagagatacgatgttccaattctggctttagtcggatattataaaatttaatcccaatttatagataaggcaattcaaggctcgagattacacaccaaataagtggactctaggctgggtgtggtggcttctgtaatcccaacactttgggaagccaaggcagaaggatcgccttagctcaggagtttgggaccggcttgggtaacatagtgagatgctgtctctacaaaaaaataaaaaatagccagacatggtggtatatacacatgtggtcatagctactcaggaggctgaggccagaggatcgcgtaagcccaggagttcaaggctgtgagctgttatcgagccactgcactccaacctgggctacagagcaagactctgtctcaaaaaaaaaaaaaaaggaggggggagcctctagaacataggcctttaatctgtgtggttgttttgcaatttatatgtataatttttaaataatatgttggccgggcacagtggtttgtatctataatctcaacactttgggaggctgagacaggaggattgcttgaggccaggagtttgagactaacacaggcaacatagcaagaccccatctctactaaacaaaataataataatttaatatggtgggtttttttgttttttttgtttttttgagacggagtcttgctctgtctcccaggctggagtgcagtggcgctagtgagctcatgcaattctcctgcctcagcctcccaagtagctgggattactagcgcttgcctgcttcaaaagaaatgatttccagcaccccattttttcttttccagcctcaaaattcatatctcctttttttcccccatgtccacatgtccttcattcctatacttcatagctttaattcctgttctcttgatacaaaccttcatgtttgttgcttgatggcatcataattatcataactttttggcttaataacagtagcagttatatcaacaaataataaaatgttcatacttttgagccaataattccacatatagaacttcattctgagaaaatactttaaataagaaaaatagttaaaggcacaaaatgttaatagcactgatatctatactgtctaaaacttgaaaccttctaaatattcaacaatataataatgcctaagcaaattattgcctatctactcagtgggctgtaagacattcatttttcacaatagcgtctttaagaatacattgaaagatgttgtaagaatgtttttgcaaaaatgaaaaggagaaacatcagaagaaaaagtagaaaaactaatgtgattggtgtctatttctgaagcatttatattttctatataataataatttacatttactgaccacttacttgtgtcaggaacaatactcaagcaacattatagaagcaacaatttgtagttattgaaaactggtgttctagaatcaaatctgagcttcatcacttactaatatgtggtcttgaaaaggaaatggaggataactatgtctacattaaattattaaatctatataaagtatttggcacatacaaaacctacaataagaatgtttttgttatcagacattttataaatatgtctcatttaatcttcacatcctcacagtaacctcattagatagtgttaacgttcattttacatgaaagaaaattgaaacttcaaatgtttaaatactctaggttaaataacttgccgaatcacttaactaataagcagtagagtttttattcagagcccaagctatggtttccacttatgactctgagagatgaggttgctgcagactaatgcttttgctaagaacaggaaagatgagaattaaaaagaaaagtgaaggcatcagagacctgctgaggcatccaggacttaagaaaccacaaccatagaaccaaaggagcttcagagaagtgggctgatgttccatgcttctcttttttcctaggaatttgctaattcttagagcatgacaagatgctgtgaaacttagcagagggtttcttctaaaagcagagaagctgttagttttatggggcggagcagacaaaacttggattttagagatctccaggtagctagttcttgggtcaagatccctagagaaggacagtacccagaaacttttttaaaacttgttttcccctcacagtgtttgctaggcagagtctagaactgtaagaaagttaatttgtattgctttaagccaatagctttggataacttgtgacagcaacaatatgaaactattacagagacatgaggaaatgatgaagaagtctaacatacatatgactggaggagagaaagttagaagcagtaatattttaagagacagtgattgagaattttctaaaaccgatgacaaatatcaagccatggatttgaaaagtgcaagaaacgacaagcagaataaatacaaggagtaccacactttcattcttcatagtaaaaataaaactgttgaaagtaaccagaggaaaaaagacacataatcttcaaaggaacaattagactgacatctgacttgtcaacagaaataatgggggccagaaaacaatacaatgtaacttttttgtttgtttttttgcttttacctacttggtttatttattttttattttattttattttattttgagatggagtctccctctgtcacccaggctggaatgcagtggcgtgatctcagctcactgcaacctttgcctcctgtgttcaagcgattctcctgcctcagccttccaagtagctgggattacaggtgcatgccaccacacccagctaatttttgtatttttagtagagacaaggtttcaccatgttggccaggctggtctcgaagtcctgacctcaggtgatttgcctgccttggccttccaaagtgctagaattacaggcatgagctaccatgcccagctggttttttttgtttttttaattgacaaaaattatatgtatttatcatgtacagcatgatgttttgaaatatgtatacattgtggaatagctaaattgcgctaattaacatatgtattacctcacacaatttatgtggtaaaaacactgagcatctactctcttagcaattttcaagaatataatacattgttattaactatagttaacatgttgtacaatagatatctcaaacttattcctcctatcaaactgaaattttgtgtcctttgaccaacatcttcccagccccaccccacccctggtaactaccattctactctatacttccatgagttcaggttttctagattccacatatgagatcatatggtatttgtcagtgccaggctaatttcacttaacagataatgccctccaggctcattcattttgttgcaaatgacaggatttccttcctttttttaaagctgaatagtattccattgtgcgtatataccacattttctgtgttcatctgttgatggatactgaggctgattccatatcttggctattgtgaataatctggcaataaccctgagagtgcagatatcttttcaacatagtgatttcatttcccttggatatattctcagagaatgcaacctttaagttccttaaagaaaataactgccaatctagaaatcacgatggcaattagaacacatttacaacagcgtgattatgaaaatacatgtgaatcagttaaagatatactcaatgaaaaatttatagccttaaatgcatatattagaatagaaaaaagtaaaaaatcagttatctaaatacccatcaaggtaggaaaagaacagcaaattaaacccaaagtaagtagaagaaaggaaataataaaaaaatagaaatcaatgaaatagaaaacaaattgttggccagtcgcagtggctcacgcctgtaatctcagcaccttgggaggccgaggtgggtggatcacctgaggtcaggagtttgagaccagcttggccaacatggcaaaagcccatctctattaaaaatacaaaaattagctgggcgtagtggcaggtgcctgtaatcccagctactcaggaggctgaggcaggagaatcacttgaaccctggaggcggaggttgcagtaagccgagatcgcgccattgcactccaacctgggcaacaagagcgaaactccgactcaaaaaaaaaaaaaaaaaaagacaacaaattggcattaggaaataacaagaccaaaagttggttccttaaaaagattagtaaaatgcatagacctctagcaatattgataaagaaaaaaaaaagagcataaattaccagtatcaggaatgaaaagggaaaatttctttacagattctacagatgtcaaaaaggtaggaagatactatgaacaaccttacatagacagatttgaaattttagatgaaatggacaaattgttaaatgctttattaaaattggcatataaaaaattgacatgaagaaatagaatatctgaatactgtttttatctgttaagtaaattgaattcagtatttaaaattttggctgggcatggtggctaatgcctgtaacatcagcacttcaggaggccaaagctagagaatcatttaagtccaggagttcaagaccctgtctctacaagaacattttaaaaattaaccgggcatgatagcgtgcacctatagtcctagctactcgggaggtaggaggatcggtttaggctaggagttcgaggttacagtgggctgtgattgtgccactgcactccagcctggatgttagagaccctgtctctaaaaaaaaaaaaaaaaaaaaaaaatttcttcaaagaaaaccaggtctacctgacttcactggtgaattcttacaaatatttaaagaagaaataaccccagtgttactcaaactcttcaatagaatacaagtcgttttatgagatcatctaagccttaatgccaagagctggcagtgatattttgagagaagatatttacagagcaatctctttcgtgaacctaaatgtgttacttgggaatataggaactctaaaagaatctatagacaaactattagaattaataagcaaacttacacgagcaaccaacagttagaaagtgaaatttttaaaatgccatttacaatagaatcaaacaaatcaaatttaagtcttgtaagatctttacacagaaaactataaaacatagagagaaacaagatataataggtagtcatagattggaagacttggtattgtaaagatatcatttctctccaaattgctctatagattaaatggaatcctaataaaatctcaggtgatttgtgtacatgatggaaggagggacttacaagttgattctaaaattcacatagacatgaaaaggactaagtagtcaagacaaacttgaagaacaaagttgtaagactttatcagataacaggatttattataaagctacagtaattacaatgtggtaatggcgcaaggatagacagatctgtggaacataattgagagcccagaaacaatcccatatgtatgtaatcaatttatgacaacagtagcatccaccacagtaggggagggatggatttttcattgaatggtgcctggttttgtgtggaaggggcagggaatgaatcttgaacccttacctcacaacatatacaaaaatcaggtctagttggattatagagctaaatgtgaaagaaaaatttagggagaaactggaaaacacctttatgatcttggagtaggtaatgatccgaaaaggaaggagtttatgaaattaaaaacttcataaactcatgaaattggagtttatgaaattaaaaacttcataaactcatgaaattggagtttatgaaattaaaaacttatcttcaaaagacattatgagagtgaaaacactagtcacagagtgagaatacatatttgtaatacatgtattcaacaagggacttgtagagctcttacagataaataggaaaaaacaaataatcaaattttgaaaaggacaaaatacttcaataggcactccacaaaagaaactatccaaaggccaatatgcacccagctattttatttacattaaataagtgcaaattaaagccacagtgagatacttgggacctctcagtatcttgaggcctctcactacatccccactgaaatggctaaaattaaaaagattgagaatatcaagtattgatgatgtgaagacactgaaactcatatgtttctggtaggtgtgtgtatttttacagccattttggaaaacaatttggccgtatattccaaaggtgatcatacaccctctgacccagctgttcctaggtatacacccaacagaaatttatatgttcaccaaaagacacaaatggacaagaatgttcatagtagcatcattcttaatagcccaaatgtccatcgaaatagaatgggtaaacaaatgtttcttgtatctacatggatgatcaccaagcataatatcgagcaaaagaagccagataagtgcatgtaagtacaaataattacatagtatatgaataaagttcagaaacaagcagaacaaatcttagaagtcatagtaattacttttacagggatagtgaatgggaaggggcataaggtaggggatttctgcttgttgtaatattctgtttattctgataaggctacaggtgatacagtctatgaaaagttgtcaagctgtacacttaaaatttgcataatttttgttttatagtctatttattttggagacagtcttctctgtcacccaggctggagtgctgtggcgcgatcttggctcactgcagcctccgcctactgggctcaagcagttcttctgcctcagcctcccaagttgctgggactacagatgcgtgccaccatgcctggctaaattcttttattgtattttttttaagtagagatggggtttcaccatgttggccaggctgctctcaaacacctgacctcaagtgatccgcccgcctcggcctcccaaaatgctaggattacaggtgtgagccactgcacccagccatttgttttgtactttaagtttacttaaaccctccactccctcaatgacttgaaggactgtattatttttctctacattccctatacacaaaccatgtaggtggtatgcttctaccccaccattccatcaaaagggctctactaggttactaataacttccatgttgtcaaaaaacttgggcatcttttacattctcatttaacctcagtaacatgtaggtgcatcttttttttttttcttgagatagtctgacaccacgcattcctggctctctgcctacctctgttcatgtcctttttgcagttcctcctctactcatcttctaactgttgagttcctcagaacacaattctaactccttttaacctattatctctcctgaggttatatcatacattcatgctttaaaatactatctactatacttgctggaaactcctaaactcctgtctccatctcagacttttgttctgtatacagagtacaacttgatattttatctcaaaggcatcttaaaatgaacatgtctaatcttaatactttttctacttctacatctcgagtattccttatctccataaatgacaactcagtctactaatttcttcgttaaaaatcttgggctcattcttgagacctcttactaatccccttacccgttcaacacacacacttacacacccccctatccagaccactgcaagattctattgattctacctcctaaatatatctcagatccaccctctttgctacatctccactgttgttatccttttctaagccactgtcatgctatggtggactggtggactattgcagtaactacttccctactgatctttatagatccattttcttttttttttttccctcccccaagatggagagtctcactctgttgcccaggctggagtgcagtggcatgttctcggctcattgaatcctctgcctcccaggttcaagcaattctcctgcctcagcctcccaagtagctggggccatgggtgtgcaccaccatgcccagctaatttttgtatttttagtagagactggatctcaccatgttggccaggcttgtctcaaactcccaatctcaagtaatccacctgcctcagcctcccaaagtgctgggattcaggtgtgagccaccacacctggcctctagatccattcttacacatctattctttacacagaagtcagaatgaacttttagaaagcataaatgtcacatcatgcccctccttaaaatttctccttaaaattcctcagaggtttactcttatactttggggaaaacccggatttctgacatggccccagatctgttctggatttggttcctgtctacctgtctttgttgctttcctctctggctcatttttctccagccacaagccgcctttcacttcctccaaagcatcaagttctctctcacctctgggtcctaataagctaattcctcagtatgcaatgtgcctacttaacatttagctctcaggttatgtgttccttcttcaaagaggtcccctgtctaaatgaagtctcccctgttattctatagctttctgttcttttccttcagagcattttaaacaaatttaaagtttatttattggtatatttgctgaacgtctttcatctccaactgtagtttttcatgagggcagagacaatttgttcaccattgtattgctggtatcttaaccatgtacctggtacatattactgaaaatatgtaatgaataagaaaatagatcatgccatcctaggtaaactataggtcgggaagtacttcataggtgtgtgctgtgccctgagagcatgaaggagttgcttgtttcctctggtttttgatgtttttgaagtttttgatgattagtcttctcagtgctaagctaaattggcagtgtgtgcagattttatttaagcccccacagaggaatacacctacccacattttttagattgaaactttttttttgttttttgagacggagtttcactcttgttgcccaggctggagtgcggtggcgtgatctcagctcacagcaacctctgcctcctgggttcaagcgattctcctgcctcagcctcctgagtagctgggattacaggcatgcgccaccacacctgactaatgtttgtatttttctagtagagatggggtttcaccatgttggccaggctggtcttgaactcctgacctcagatgatctccctgcctcggcctcccaaagtgttgggattacatgtgtgagccactgtgcgcagccctaagttgaaactctttaaaagtaaagatagagagttctcaatagcagtcttgactaaataactttgtcttcttttctagaactgcaattttgttcgtttttttgagacaagatctggctctgtggcccaagctggagtgcagtggcatgataactcactgcagccttgaactcctaggcaaaagtgatcctcccgcctcagcctcccaagtagcttggactgcaagctcataccaccacaccaagctaggtttttagttttaattttttttttttttttttttttttagagacaggatctggctatgttgcccaggctggtctcaaactcctgggctcaagcgatcctcccaccttggcctcccaaagagctgggattacaggtgtgagcgactggacccagccaaactgcaattttaaaaaaatacataagggccctacaaagaaaagttagtctaatcgcatttggttactcctgagatttacaatattgtttgtaaatattattaactattttagtcacataaatatgccataatgcaaccacagtaagtatatgacatgtcttttaatcagaataatcagaataaagcaaaaaatgaccatatttcacaatattaatgtattcacgtgttttataggttatacacatctattatgatttgatattacaagatactctgcattttcttatatagcttgggtttgctttctccatcttagatgtagtttttaattattgtttttgaagctggttttaatacaataagatgcttaattgtacgtttggtagaaaattataagcacaacaatttgaaacagctttcaggctactagcatttcccaaaacccttgaaaaaatgcctgtttactaccaattttaaaccagataaatttcatttcaagagaaaatgttttcaagtttcttttttttttgagacggagtctcctctgtcacccaggctggagtgcagtggcgtgatctcggctcactgcaagctccgcctccctggttcacaccattctcctgcctcagcctcccgagtagctgggactgcaggcacctgtcaccacgcccggctaatttttttgtatttttttagtagagacggggtatcaccgtgttagccaggatagtctcgatctccttacctcgtgatccacctgcctcagcctcccaaagtgctgggattacaggcgtgagtcaccacgcccgtccgtaggtttggagttcattataaagaataactttacaattgtcagagctattgagaagtggaagtagacattcccaagagaggctttcaggttgggggctgagccttggttgtatgattggactcagtgatctttgtgggaccttctaatcttggaattctcatcttaaccaatgctgctttttttcttttactttttaaaactgtggtacatacagtaaagtacaaaaatcaatgaatttttacatagatatatatgtgcctgtgaatattttcgtcactctaggaggctcttcagtcattaccttctctctccccacgagagataaccactattctgatttctgtcactatacggttgttttacttgttattgagcttcatataaatatattcatagaatatttattctcgtgggtctggcttcttggctcatcattatatctatgaaattcatccatgttgcatgtagcagtagttcaatctgtatagtattccactgatttcattgtaggactatatcataacatatccatgctactgttgatggacacatgggttggttccactttgaggctattatttaaaaagctgctatgaacattcgcatacatgtcttctgttggttatatacactcatttctctatgatatattactaggaatggagttgctggttcataggataggtgtattttaacagatattgctaaatagttttccaaaatgattgtccccatttagattcccagtagcaccgtcagagaatttcagttcctctccatccttgctaccactgtgtattgtcatttttttttattttagccattctggtgggtatataatactgtctctttttctatagctattgatcatttggatagtctctttatgaagtgcttgctttgtatttagcccccttttttaaaaaaatgggtcatttatttttaatcttagtgatatttaggagttcttcgtatattctaaatatgagtctttagggaatatatgtattacaaatataatttcccagtctgtggcttgcctttttactcctttaacatgatcttctgatgaacagacattcttaactatagtgaactccaatttgtcacttttctctaatgtggttagtgctttgtcctctttaagaaatctttgcctagcctaagatcatgaagacatttagaccaacaattcttaaattgtggtattaaactagataatagtgaacttttgttggtttacacacacaaaaagaagtaaatggatagaaatgtactgttttctcccataatttattttgaaaccttgggtattaactataaataagtagataatgatgttacttaaatctgaaatttattaactgagaaggtgtcagttaggataggctaggttattgctatttatattgctgtggtaataaacaaccacaaaatctcagtggctttcttttctcacttatgctatttgtccaaagtgagtcaacatggggctatgctatttgtggtcacttagacaaccaggcggatgtaaactacattataatatatacttccacagtcactgtattcaggggaaggaaacatggcaaattgcttatagactcagattttctgcccagaagaatcatatgtcactcactttcattgcccatgagttacatggtccttgtgtcttctctgaggcagtgaggaagtttcctcttatgtttctgaaaggagatctaaatatttttgaatagccatagtgactatcacagtaaacatttgtaagttacttaacccctctgtggatcagtttgttcactataaaataggtgctaatgataatatctacttgatacggcagatgtgtggattaagtggtatcatacacgtatagctcttaaaatagtgcctggtacttagtaagcaataaattcttgctgcaattattgctatcattattgttattaggctcttactatatgatgacaccatactacctgctttatttacacagattacttcttgagataacttctatatagtatgtactattactcttctcatttataggataagaaaaccttggtttggagcttttgactagcttgcccaagttccacagctaatacgtaaaagatgagattggaatctaggcagtctgactccagagccctcagtataaactgagactccctcccagatagcaaataaatatgaacagaattcagaagtgcataccatgcttagagaactctgtgtttgtttgtgtacatatatgtttatggttgtgattttatattgaatttttaatatattcctattttctgctagtttgttagtgtttctagttcatataattaaatatactgtttctcagtattctatgtagtctgacagctaaacaaatttgaagttgattttgttcttcatgaacaggtgaaaaaacttgagccagagtcatttagtgatcccagaaaccagttagttggtagtatatcctgaactcaaagtcagatttcctgacttcgattcagagctcttcctactgcctcaggttgtctccttgtagtttatgcagcatatcatcctttatcaaatatttgagatgctttttgtctccaaattttgagtgaatttgttgtagaaatcacagttaagctttttttccctcatagctcacattactacatcttgattgtaatttatcaactttgtcttttaaatattctaatgttactaaacacccagggccaaattaaatatttggacagagtttctagtaagaataaatgcctccagagaagcttctgtggaaaaatattgtaatgatgagcttgagagtaccaataacttttctttttcgtgtaaggcaatttagagtccaatttctgaaggcacagagatgccagtggaattagagatgaatcaaacacattacattttaggtttatcttaaggtatattggcaagaagtaaaacaacaacttaccaaaagcttgttacttttcctgccagtgacataagaatgtacatataacaacctcagatatattgtaattttcagagttaaacctcttaaggaaatgctgagctcattttcctggtctgttttcccataattaaatggtattcttgtttgataatttcagtgtattttcatgtaacttatctggaaagttaataggacataaattgagttagaacttctcaatatattgctatatagtggagatattcaataaggaagtcacaacacttttttcccctcagtatcaaaatatgtcagttatctgtcaagaaaatgaactgaatctgtgctgtgtgttattgcactcatggggaaatactgttttgaggctacatgatccttgtcctggcctcgtgcaatttaaaacattaattcttgtgttaaaataaatactgctttataaaactgactgcagaatttaagggaatttttaatataaagcatgaggtttataaattgtgcccttactctccctgctagacatgcgtactcttctctgccctatagtcctaattctgatgagagagagaaagaatatatcattagcaactatctttaaggcatctttcagcaataagctagaaactccttgtttgtttgtttttgagatggagtcttgctctgtcactcaggctggacttagaaatccttctaatggtgtttttctggaaaggggagtatggagagtctggcaaaaagggaattttagctctacgtgtagccatattttttttacaaaaaagaaactaagtattgcatgtgaaattaaaatttaattttaaaacatctgtgatccttgatggcacttttcctctttctttaaagtaacaaaaccatactgctgaaggttgagtttaaaacaaagattggaaagtaattattcataatttcaccaccctgacataactactttgaactttttttttttttttttttttttgagacagaatctcgctctgtaacccaggctggagtgcagtggtgtgatccctcatcactgcaacctccacctcccaggtttaagcgattctccttcctcagcctccagagtagctgggattataggctcctgccaccataccgggctaatttttgtatttttagtagagacagggtttcaccatgttgtccaggctggttttgaactcctgactttaagtgatctgcccacctcggcctcccaacactttgaacattttgatgtgtttccttccaatctttgttcttatatatctattttttatgatgatgatgatgatgattattattattattattattattattattattattattaagttagggtctcactctgtcacccagactggagtgcagtggcacgatctcacctcactgcaacatccacctcctgggttcaagctattctcctgcctcagcctctggagtagctgggattacaggcgcccaccaccatgcctggctaatttttgtattttcagtagagacagggtttcaccatgttggccaggctcgtcttgaactcctgacctcaagtgatccacccatctctgcttcccaatactttgaatattttgatgtatttccttccaatcttttttcttatgtatttatttattattattattattacgacagggtctcactgtgtcacctaggctggagtgcagtggcacgataatggctcactgcagcctcaacttcctgggctccagcaatcttcccacctcagcccagcctccctactagctgggatcacaggcgcgtgcccccatgcccagataatttttgtatttttggtagagatggggtttcgccatgttgccccggctggtctcaaattcctaagatcaagcaattcacctgcctcagcctcccaaagtgttgggattacaagtgtgagccaacatgcccgacctgtatctattcttttaatatacttataatccatatactttctcataaatgtttcattgataactttgtaatataatttttaaaatagctttcacattcttttattgtatgcagagcttgtaaagaaatatttgatcctcacggtagccctttgaggtaaatagaataagttttagccccattttacatataagggtattgaagcagatgctcatataacgcctctacttggtactgtggtagacttctgttcatgacagaagtacttgctaacacaggcaaatgagtgcatttaatgttgaaagaacaaaacaaatcgttctgtagattcttattccctggacttagtccttccttcctgggctaagtgaacccttgaacagcactaggcaatgctgaaaatacagattttgtcagattttagtaagtgctctaaacaccaagaatcttgaagtgatataatgaaagttacagctaatgtagttttaaacttgttttttctttgttatttcaccttgaaaaaaagaaacaatcagtagcttttaaacaaaaaagattaaatctaaccacttgttctgaattactatggtagggtgagaactgaggctctgtgtatggaagttgaagttttatcatgttgagtaggttatcaaaggagaaatgttcctaggaaactggtcttgtagagcttaaatgtgtcaaatttgaattctatggctatgtgtaactttctgaagtcctgagcattgttattaggtttcaaaggcaaaatatagcaaaataattctgagtttttcaatttatttctgtttaaactgtaaagcatgttacagttgtgcctattcatcttgtgaagaaaactctaaatttcatcttactgttcagagtagtaaagaccactaactgctttgcctccctgtaactaaagttttctgtcttcagcttttggctgaggaaattcctctgctatcgagcatcctctgtttttcttttaggaaatcttcctaggaagaaaatttaatttgtaagtcagttgattaaaatgaaaaacactttgatgggattagtttccatttattacactatagtttttataaatgttcttcaattttccttctgaaacatgtcatcctttacttgcagtcttcattggcttttgagagggtaaacgatttaggatttattgcctgtaaaaggaagaaacattctttctacctcctctcttcagcgttgtctcacagctgcaggtttgagctgaagagctgtgtaaaatgtaagaaaatagaggaacagtgttccttgaaccaataaggaccctttccctggaattgttaactatgaattttatgtttgggttcagatactagggacctttgttacttctgctttctcatacagtagttcccctttatccatgggggtacatcccaagacccccggtaggatgcccgaaaccatggatagtaacaaatcctatacatatggtacacatgaatttctccttcttcacaatttcacagatttatctttactgtaggtcttagcaacctcagcatttgtgatttttttttccttttgttaagttgggaacttttaccttttcacttaaagaagcactttacagcttctctttggcatatccatactggcagcctcacttctcttctgctttggggccgttgtgaagtaaaataacaccagccctgcgatactgcgacagtcgatccaataacctagaaggctgctaagtgactgatgggcaggcagtgtatacagcatggatatgctggacaaggggaggattcacatcctgggtgggatggagcaggacagcatgggatttcatcacactactcagaacagtgtataacttaaaacttatgaattatttctgaaacttcccatttaatatttttggactgcagttgaccatgagttaacacactggcaaagcagaaccacagataaggggggactaccgtctatgctgattgagttgcttttcgcagactccagccttgaattatattgttttagagctacctaccttagtatgaatctggattttcaaacgtgtaaggacccagagctgtgtggtccttctcaggtgttttctcagctggtgttttctgtttccttcagctctccagtgcatctgtgaatgtattaggataattaacaattaccttagctggttacctaacccattcaattcttctttctctgtttttctcatatatttgaataaataccgttatacacatcagccattaccctttttccacgtcccctactagattatgaactgtaaaataataagtgttgttgggatttttaaatcttatttacctctgtatctttgatgcctaacatagtgacatatgataaactgaaaaacattgtttttcaactttaaaaaaaaaactcgtgtctcctcttgataaatacataaattcccttttctgatataccctgcatgtgaatcaccaagatgtgagtaaaaagtatacatatgtggctgggtgcggtggctcacgcctgtaatcccagcactttgggaggccgaggcgggtggatcacaaggtcaggagatcgagaccatcctggctaatacagtgaaaccccatctctactaaaaatacaaaaaattagccgggcatggtggtgggcacctgtagtcccagctactcaggaggctgaggcaggagaatggcgtgaaccctggaggcagagcttgcagtgagccaagatcacgccactgcactccagcctgggtgacagagcgagactccgtctcaaaaaaaaaaaaaaaagagtatacatatgtgtctttaccaaacaagaacattaactttttgtgctttgtgtacttaaaacaagcttggttttgttttttgtttttttcctccaaatagaaaattgactgtcactgaaaacaccttttcatatatcacaggccttctagagggagtaaggctttaccagcattccccatcccagcttatatggacccacctttttaccgtttcatagtacacccatgtcccaggaaataggggaagtactctacactaaggaaataattccaggttttattggattactttaactcttagttcaggcactggtccagaagttgtcttacttgggcaatcacctccttgtttactaataataaaagcagtgcttagattgcctctgtaggaagggcaacttgggaccaacaggcaccatgaaaaagccaacgaggtggactgtgacctcaaaaggcaacactctgcttgtaaaatgacaaattttgctttggaagaggaagtgttttttattttccctgcgttatcaccgtgctttacaaaaactgatacaaaatactattcttagatgttttggttttgtggagtttttttcttcacaacacattttccgtcctaatattgacagttctccatcaaggttccattgagggggcaaaaggcatatacagtgatccaattgtctagcaagaaatctgaactgtgccagtctcttttgatgatctagtacttctgtggtttttaagaagatatctgatttaagtttctaaatttttacttcaaaaaaacatgtaccatcacataaggaatttggagaaaaaaatcataaagatagaagtttaatttttgtttctaactctggcctctttttctccctttttatttttcgaaaacagagtctctacaaggaagataacggactgtaaaattctataaagcaaagctacacatcacttgacaccatacaccatcttggttacataatgaaggtgatcaacaaatgtttgttgaaatataaactctctaggcatttgcattagatggagcctggattatttcttttgtggccaaaaaaccccgctatatttagcttcaaaaaatttgcaaatagtatattgttagtacaagtcacccttttttactaaactgattacaagactacagttaaagtatatgcaggccacagtttatagattctagtcctgatgttttttccagttattttgaacttagaaactagctttaccttcaaaatatattaagaatctgaccacttctcaccatctctactactgctattctgatctaattcttccagctgttttgttgcagtcgcttcccaaatgatttccttactttcccttttccctctccaccttcattcagtctgttcttaaaatagcagccagaatgatcctataaacttgttaaattttatgccttatctgctgaaaaccttccagtagccccggttagctttcagacctcatctccttttcccactagttcagtccagccacatttgccacctcctcagtcacaccagggggacttctttgcactagttgtttcctctgctagggccactctttcccccacatacatgcatagttctttcatctccttctggtcttttcctaaagattacctcagtgaagcctttcatggcctctgtatataaaattgcagacaccccatttccttgaactgttcctaacctctttccctgccctgttttttcttggtacttcaaactatgtatcattattcattttacttattttatcttgttttttgtctgttccagtacactgtgagctctataagggcaaggatctttgcctgttttggtcattgctgtattcccaatgcatagaaaatgcccaggatagtagataatatttgttgaatgaatggatcagtttctctatagtttggttcctagggtagcctaccaacattttaaaaatcaataataaggccgggcgcggtggctcacgcctgtaatcccagcactttgggaggccgaggtgggtggatcacaaggtcaggagttcaagaccagctggaaaaaaaaaattagctggacatggtggcaggcacctgtaatctcagccactcgggaggctgaggccgagaattgcttgaaccaggaggtaggggttgcagtaagcagagatcaagccactgcacttcagcctgggcaacagagtgaggctcgtctcaaaaataaataaataaataataaaataaagatcaataatagtcataggagcctggactatcaattttaggtctagagagccatattttctgtccacccccaccccagtgcccagccaaacacacccctccttatacccttctcttgaagcagcaagccttatgtttagaccctaattgcctctccctacctcaaccctcccctaaaacctaagtacttaattactcctaaattgcctcttctctctcctcatctttttccctctcatctcacatataaaaacctatggtgaaagagtttttaactgaatttcacttaactgaaccccagttaactgcctggcaggattagccagtgttctcattcacactgtaaaacatattgattaatgtccacagcccactgattgcttttagctaaacgttcacagctggtagactactctctagtaagcctcttttccttcctccagttaaattgtatgcatatcaaagtcagttgtgtttattcccaaacctctttataccagttctctggcataataaaatacataattataatattctaaatatataatatggcaattttaaaatgaatgaatgttatattttagagcgcttttagattcacaacaaaaatgagcagaaaatacagagacttcctatatattccctgtccccccacacacacagcctccccaactatcaatatccctggcaccagaatgctacatctgttacaatcaatgaacctatattgacacataatcaccatagtttacatagtgtccatcactcttggtgttggacagtctgtgagttttgacagatttataatgacatgtatccaccattgtatcacgtagaaagtttcactgccctaaaaatgccgtgttccacctattcatcctactcccctggcaaccactaatctttttactgtctccatacttttgcttatccaggatgtcagataggtggatggattcacaacatatgggttgagtttcccttatccaaaatgcctgggaccagaagtgtttcaggtttcagatcttttcagatttattttttatttatttatttttttatttgtttttttgagacagagtcttgctttgtcgcccaggctggagtgcagtggcacgatctcggctcactgcaagctctgcctccagggttcgcgccattctcctgcctcagcctccccgagtagctaggactacaggcgcccaccaccacacccggctaattttttgtatttgagtatttgcatacacataatgagatatgttggggataagacccaagtctaaacaggaaatccatttatggtgtatccatttaccttacacatggcttgaaggtaattttatagcaatgattttatttattttgtgtatgaaacaaagtttgtatacattgaaccatgagaaagcaaagatgtcactcagccacccacatgtacagtctgtgattgtttggcatcaccattattcctgattcagaattcatgtgctaccaataagaatcattctcttacacttatttgcacataagtacttaacagtaaaaaatgtgacataccattaatacaatgaaaaaataatgtgttcggggtaagcagtacagtagcatcaccagtgcacctgtgccagctgttaacaacaaacaatggcaagttgaataaactaattatcgtgtgccagtgtttttattgtgacccattacgtgaagtcccatgtggaatttttgtattttgtattttcatacaatgaaggagagttcttgttccacatccttgccagcatttggtggtatcagtgtttgggatttagggcattctaataggtgtgtagtggtagctcactattgtatgaatttcctcttgggtcatcaagtgggcactcaggaaatttcagattttggagcattttgaatttctgattttcagattagggatgctcaatttatatagccttttcagattgacttctttcacttagtaatatgcactaagtttcctccatgtctttccatggcttcataactcatatctttttagcagtgaataatattctattatctgaatgtatcacagttcagccactcacctactgaaggacatcttggttatgcccaagttttggcaattatgaataaagctactataaacatctgtgtgcaggtttttgtgtggacgtaagttttccattcatttgggtaaatattaaggtaagaagtgcgattgctggattgtatggcaagagtatgtttaattttgtaaaaaacttcctgtcttttgaaatgtctgtactgttttgtatccccacataatgaaggagagttcctgttgctccgcatcattgtcagcacttagtggtgtcagtgtttgggattttggccattctaataggtttgtagtggtagatcattattgttttaatttgcagttatagttggccctgtgtatccttgggttctgcatccacaaattcaatcagtttggggtggaaaatacagtattcaagagacacagaacctatggatacagggccgactttttgtaatcatgggttctgcagggccaattgtgggcatctacaaattttgagctcgcagtgtactggaacagacaaaaaacaagataaaataagtaaaatgaaaaaagatacatagtttgaagtaccaagaaaaaaacagagcagggaaggaggttaggaacagttcaaggaaagggggtgtctgcaattttatatacagaggccatgaaaggcttcactgagcaaaattgatgttaaagattcaatacttagacatgaatatctaacgtgaatggaaagttgaaaattccaatacagaatatacatcaatcggccatgttcactaaagtagacatgaacactgactctattgtttgaagatagtctcactccttacaaataataaaggagaatgcatatatgaggaaacatttagagaatatattgagtgtcccccagtttcagagttaatccatttaaaagacacataatctgcaaaagtgccttgcttgagcaataaataaatactaattgaatgaggagcctccttcagttgaggggtatggtgtggctttaggcaaagtctggccacaatattatgatgaagctgtgaaatacataattgtatttgctcatcaaatgcatatttaacaaatgcccatgatatgctcaaaaccaggctgggggaaatttaaaggtaaacaaggcactgtttataacctaacaaaacatataactaagggttagaaaagacaagtgtagtacagtgagtcaagtattatgatgggtgtttagtacagaatgctctggtagtacataaaaggggcatctgatacattcttgattgatccaagaacacatgctgaaagaagacacatctaagatgagatgtgaaggataagaaagtataattggccaaacaagagagactggggtactaggaagtattccaaccaaagacaacaaatggcagttgcagagatgtagaggtcagagaatatggtgcattttctcagaatgaatcaaaggcataaatgttaagagctaaaattataaagctcttagaagaacacataagggtaaatcttcacaactttgattaggcggtagtttcttaaatatgacacctaaagcacaagcaaccaaagaaaaaaaaaagataatttgtactttaaagttaaaaacgtttgtatttcaaagaccactatcaaagtgaaaagacaacccagagaatgggagaaaaacatttgaaaatagtatatctgataagtgtctagtatctacaatataaaaagaactcttgcaattttgcaataacaatacagttttaacccaattttaaaaatgagcaaaggaggctgagtgtggtggctcacgcctataatctcaacactttgggagactgaggtgggtggcacctcttgaggccaggagtttgagaccagcatggccaacatggcgaaaccctgtctctactaaaaatacaaaaattagctgggcatggtggtgcatacctgtaatcccagctactacttgggaggctgaagcacaagaatcgcttgaacccaggaggtagaggttgcagtgagccaggatcacaccagtgcactccagcatggacaacagaatgatactctatctaaaaaataataataataatacaaaacacaatttgaaataggatttgagtagacagttctccaaaacagataaacaaatgcacaatatgcataagaaaaaatgcttaacatcattactcattaggaaaatatgaaccaaaatcacaatgagataccacttcacatctactaggatggctctaataaaaaagataataccaagtgtgctgaggatatggagaaattggaaccctaataggttactggtatgaatgtaaaatggtagaggtgctttgaaaaacagtttgattttctcaaaatattaaacatggtggtaccagatgttccagcagctccactcctaggtatatgcccaagagaactgaaaacatgtccacacaaaaatttatacacaaatgttcataagcagcagcattcataataaccaaaaagtagaaacaacccaagtctatcaactgatatgtggatcaacaaaatgtgcaatagccatccagtataatattattcagccataaagcagaatgaaattctgatacacgctacaatgtgaaccttgaaaactttatgctaagtgagagtagccagacacaaaaggccacatattgtatgattctatttatatgaaatatcagaataggtacagttataaagacagaaagtaggcaggcatgatggctcacgcctattatcccaacagttcgggagactgaggcaggaggattgcttgaggctaggaattcaagacagcctgggcaacatagcgaaaccctatctctacaaaaaaaaaaaaaaattaaaaattagccaggcgtggtcctagctactcaggaggctgaggcagagagatcacttgagacaagcagtttgaggcatcagtgagctatgattatgccactgcactccagcctgggtgacggagcaggaccctgtctcttaaaaaaaaaaaaaaaaacaaagtagattagtggttgcccaggcctaggaggactagcaggaagggagaatggggattgtttgctaaaggatattgtgtttctttttggggtgatgaaaatgttctaaaattggttagggtgttggttgcacaaccttgtaaatatattaaaaaccactgagttgtatgtagtaaaggggtgaactttatggtatatcaattatatcttccaaaaaaagcaatttagtatgctttttgtcgtgagttggggttgaggaatgtgaaaagataatgctgactgagttggaggatttgggtgagtttggttgaaaaactttgacagagataacatggcagttgggaaatatcctaagaacatacaaagtgattactaagagcatagagggcccagttgtgattggataccatacatttatagtaatactctttattttgtcatttttttcctccaccatctaaagccaaaactcagagttgatctacttctagtgtatagaaagatgtagtgcaagggaattgagtattggcaaaagaacatttgcaatgtagccattgaatctaagctggacagagaagggaaaatcaagggccaatgaatagaggtttgtatggttcaaggtgagttgtaataggagaattaagagagctgaaatgataggagatggtggtaagagatttttgggtatgaggttgatataaccaaggaacctgatgttttaaaggaaccaagggttttgcataaaggctgtagtatggaaaatgaggttgagatgggcagaatcccacctctcaattatgaggtgtatggttggagagggagtggtgcagaaggaatatgctgcatctctatgaaaagacttagggaagtggggttagcatgtgtaaagtaagaaaagggcacttgaaaagagccaaccccagaaaccagaagtacaaatatgcttccagcactgtccaacacatttggaataacatagtcacattggtgtgatcatccctattattgggaaagattactagagcaatcttagttgaggaacatttcttaagttccacctaatttcctttgttctggccatatattgaccatagcaatgttctgattatgatctggcctactagatgactacagagagaaaatgtgttcactagtcattaaatatctagtacgcttaatataattctcattacaatctttataatcatcattaaaatattttaaattggcactcttttatatgtcaggtttttttcagtgagtggttagtgttagagggaattttgggatttccaaagctcaggtccagaccctggttcaaagtgttctaagtggcaaagtaataccatttttgtgaggcttcctggtagaagccttcactggataagtcccctctactaggtaacatctgcatgatagacctgtttgtataaagtgcagtgaagagccaaacttgtatattgctttgcctttgaacaaatttctcttctttcctcatttagagcagcattcattacatttcttaagtgctttgcataaaatttcaaagttcagtgtgacctctgtactgggacatcatcaggcacagatgctacatgtgaagggcttttggcaatcagtggcttggtagccgtgattccttttgaatcactccctcatggaccatatgaaatgcattctcccaggatcccagacatattcttgggaatcattgtattttccgacttactggactagtttagaggcctttgggtttcactgcacttttcttcatttccttcttttgttgatcttggccccttaaccttccacccactttattactcatttcttagggacctgactactcagtaacactgagaaaatatatctgaaaccatatgggtttgaatacaacaaacttaagagagggaaaataaaaaaggaaaaaatgtgtgttctctgaacttcctttgtttatatgatctgtttatatgttgttaaggttatgttatccagctgcctccccacgtttcagaaatgactaaagatatctggaaaacactctaacagggtcatgttggcatagtggatgaaaagacacttcatttgtccctcaccagataatatatcttcttttgaggcatgggagcaatgccaggagctttaaatgctgaatctcaaggttcttgaaaggccattgacttctagggatacttttagaaagaagccagtcaatcccaggcgtagtggctcacacctgtaatcctaacactttgggaggccgaagtgggcggatcacttgaggctaggagttcaagaccaacctggccaacatggtgataccccgtctgtactaaaaatacaaaaattagctggtgtggtggcacgtacctgtaatcccagcaacttgggaggctgaagcacaagaatcacctgaacctgggaggcgtgggcaacagagcgagactgtcaaaaaaaaaaaaaaaaaaaaagccagtcaagtgagttccctaaggtatatacctggccatttgaatgtttgctcactatggttagtctgtatggtatctaacagatattacagttttcttttggtaaaatgaacattgacattggtgtgaggtgatgttagcagcccaggctttaatctcgcctttgtattgtataatgtgaattaaaacttaagtacacttgagtcagggttattcagtaaaacatgtggaatggaattttgtggtatttattagagctattccacttgtaaacaccttatcttgaaggaactgaaaagaggttgcaagcattcctgcagtagaataaagtgcttatgatggttgagtgagaagttcctctctaccttccatgctctacctactgtaatgggtaatatttgtacagagatgtgtttttcccatcaagctgtttatggaacttggcctgctaaataataaacttagaagtgagaataagtaagaataaggaataaaacatcagtgttatcttttggaaataaatcactccattgaacatggagaatgtggtcctcgtgtcatcggcattttcttcatatttccacctcagtggagtgatcctggctctgctttgccgctgtgctttccttttaattgctgtttcaccaggtctccttagcagcagcagcgcctgaaataactcctgaggaagctcctaagtgaattctcataatttgcttctcaattctcccaattgattgaggcactctttcttgagtgctttgcagttctgtgtaagtggctgatgtttggggtcactgctgaatgttttgtttgaatatccctttcatgatgaagggaagactgctgcttttaactacatggggtgatgccctttgtggtaagccttgaaaggcaaaaatcgtttttcatagtgatatgccaaatgaaattattctctttgtcactttgtccttttatcctttcagtctgataacctcagttcttgtgatttgtttgttttcttcaattaagcttagttgtttcctgtacccaggtgcatgctatttctgctcttggttatgatggtgtgtggagcatatttctgacctggaagtgtggtttctttgactgagagccacatcagcatgccttccatcctctacttcctttgcattatttccttttggagggctcagtttgccatcatttaatctatagatgattcatctgggactgagaactggtaatgctgtaataacaatatctttctttatataatactcaatgcacttactaccttagattttctctgtttatggagcactttcattttaatctctcacaataaccctttgggttaagtcagcaattttgtcttagtctaagatggtgaaattgtagctcaaagagcttaaatagcttgctcagagtggcagtgcttctgagttaccctgcttaacaatttctacaggaaatgaatacttttgaagatactctggataaataaaaaggaattttccaaaccacatcccatttgttaaaacctaacttgttttcagtctggtcagttgataagaccaaggttaaaaggcccatttaccatacagtttaaattgatgtgtccaagtcaagaaaataaatatttaggtcagtttttattctgttgcttatatgataaagttcaagaaggctggctcttaaattagtggaacttgaaatggaagtaattaagccattaatttttttttattctcttttcctttcagagagatggaaaacttgatgactagctccaccctaccgcccctttttgcagatgaagacggttccaaggagagtaatgatctggctaccactgggtaagcagctgctttaggacactggacttctccataggcctcaaaacaaagcttctagcaaagtaagaggtcctaaagaggcagttttatatcataagaatagacggtgcacttgtttcactttgcaaagagagtgacagccatcataaaccactttgtaatctgcattcaattatcttttgcagtgctctggtttttgtgaactggtacaacaatatgtggaatctagcaaacactggtgactccagttaagaaaattatatagtcaccattaaggaaatacctgccacagagctagctctaaaaaacaaatgcattttttctgttcaaattaccacagatattaaaatagttttttcccaaagatcagattttttaatgtggttctttattcaagatgcttagtaactttagctgacttctgttcctttccccatcccacccccttctcctttctgtgggatcttttgacaaatatttaaagagatatagaaaagggttaataacagtagtccacctcttcccttgaaaatctctgttccacttgaatttttatcttttctagatgtttagaagttatttggcaaagagaaagtgtgttcactaatagactgaagtgctagctaatccctaagatgaattattttaatattctttagagctgtttaaaaaataggctatactttgtaattctgtttccttccctcacatttatgtctcacctcgttgatatccgcctttgacctcactactcagatgaaagtgttctccaagacttttctaaaggctgcttagttactatattcattcagtaaaaactttctgagtatctgctatgtgtcattgttccaggcattagatagaaagcattgatcaaaatagataaaaatcataggccttttaaagttcaaattctacttgttgagtcagacaataaacaggataaataagcaaaacatatactatgttgataagaactatagtttaaaaaaagaaaaaagtggagaaaagggataggaagggtttggggatgcagttttagacaggatgggccagaaagtgtttaatgagaaagtgacttcaataaagacctgaaggaaataaggcaactggcatgcagttttctggggaagattatcctagacagagggagcagtaggtgcaaaagccctgaggcaggagagtttccatcttatcgaaatagccaggaggacagtgtgactagagcagcacatagcagcaggagaggcagtagaggactacatcagtccttctcaaacatatgaattgccaagagagctgatgaaaatgcagattctgatttagaaaatcttaggaccagagattctacatttctaacaagctcccagagaatgccagttctgctggtatgaggcccatactttgggtaagaagagactagatcatagggatcaaaatatttagagatcaaaataaaccctttaacttttactctgaagtgggataacattggagggtttcacacagaattatatgatctgacttacggttttataagatccctctgactgttgtattgagaatagagtgaagggagcaggggctggaacaaggagaccagttagggaggctcttaaaataattcaggagacagatgatagcctgaagaaccatcatctggtgactttcacaagagtgtttttggtggaatagtgggggtaaaaacctcattggagtgtgtttcaaagataatgggaatgaggggtagtgagaagtatagaattctagatatatttgaaggtataccaaacagaatttgcctgaaagaaaggatgagcacaatgtaagaagggagaaaaaaagcagtcaaaggcaactcaaaagttttggccaaagcaactggagggatggagttgccattagcttagatggggaaaactgaacaagtgtgggagggaattgtaggagctcagttttggaaattttacattaaagatgcttattagatatctaagtggagatgtcaaataggcactttgatatcaggttctgctattaggggaagtttaggcgagacagagaaagttgggacttatcagcatataacattcaaagccgtgagactgaatgagatcaccaaagaaatgagcactctgtagatggaagaaagaagagctctaaagcctgacctctgggatactccatcatttaaaagtcagacagaggccgggtgcagtggctcacaacctgtaatcccagcactttggtagactgaggtgggtggatcacttgaggtcaggagttcaagaccagcctggccaacatggtgaaaccctgtctctactaaaaatacaaaaatcagtcaggtgtggtggcacgtgcctgtaatctcaactactcgggaggttgaggcaggaaaattgcttgaacccaggtggcggaagttgcagtgagctgtgatcgtgccactgcactccagcctgggtgacagagcaagctccatctcaaaaaaagaaaaagaaaaaaaagtcagaaagaataggaagaatcaacagagtctaaagtgagttgctagaaaggtcgcagaaaagccagaagagtgaagggtcctagaacccaagtgaaaaaaaaaaagtatttcaagggaggggaaaagatcaactgtgtcagatgcttctggtacatcaggtaagatgggggctgagaaatgacactggatttagcatgggtgtcattggtggctttgacaagagttataagcacatatctcctttgaagtggacttaagggaggagaagtcaataagtataaacaagttatttccaggggttgtgctataaaggaaaggagaaaaattgggaccttaactggaagtgggatggagtttttttcttttcattttgttttgtgttaagagaattaatatcatacgtatatgctgattggactgatcctgtagagagaaaagaattggtattgccagaaaggacagaattgctgaaaatctgcccctgagtaggcaagagggtgtgagatcaagggtgcaaatagaagggttgtgggctttagctaggaacatggataatttattcatggtaacaaaagatcccccttttttccagtcttcatccaacttgtcatcaagaaggcatgtgatgcctttggccattcctgtccacttaagtcagggattcatgggattgtgaattcccatgtgaattcccaagtgattcctgtccactgaagtcagggattcataggattgctactctttcccaaacctagttctcatattttaccaaaataagaatttacaagaattagtaacttaaaaattgatggcacagttgaaatgaaaatgacagtgaaagaacaagttgcctaacacatctaaaatgattgaaatatttggaaaacagcactgcagagatcaaactggatctcgatggtacctcttttcagagaaaatgattggcattgatttcatagcttcttttacttactcttttttaaaggacctcaaaaatgtaggaacctcctgctaaaatcatctattatgtttcctagaaagggtcagaaaagtttaatttctttcagtcccaggacagtctgcttcctgttttcatccatttctcggtccactgtaatctggaatttattctcataattccactaaaactatacttaactaaaattgccagtgaccttcaggtcttcaaatttagcagacactttttggcctatcttatttaacatctgcaactttttacttgattagccactacccttctcaaaagtcttcctgccttggcctctgcaatcgtcttctctccagttatcttaatgcccttctcagtctcctttcctagtttttctaccttgctcatacaatgatattgcttcagctgagttctatcctgacttttccttcttctcactgtctttctggagaatatctagcactgcccattatttccatgggctaatgcttctcgagtctatctttatgcccttttgttccacttctgttctcctggggcatgtttccagttgtctgtggtacatttctacttaattatgctacaggtgtttcaaatttatcattttcttgtgtgtctgtccacacacacacacacacacacacaccctgtttttactttgattaatattaagtacataatcatcaattggaaacctcagaattatctttgactcttcctttctttcactattaaagtcaatcagtcattaagttctctccattctacctcttttttctttttctttttctttttcttttttttttttttttttgagactgagtcttactctgtcacccaggttggagtgcagtggcatgatcttagttcactgcaacctccccttcccaggttcaagcggttctcctgcctcagccttctgagtagctaggattacaggcactgccatcatggccagctaatttttttatttttagtagagacggggtttcaccatgttggccaggctggctttgaactcctgacctcaagtgatccacctgccttggcctcccaaagtgctgggattacaggcgtgaggcaccacacctagccattctgcctcttaagtatctcttaactgtccttctgctcagaatcctgcctgcctttgtgtctcacttaatctattacagtaacctcttgatagtctccctttctccttttataccaagttctttctatctggaatcgtgttgtttaccttgatgaatacgtactcatcttttaggacctcctctataaattctttcttaacatccctccatacatataaaattcatcataccctctaccatacctctatggtacttttaacaagccattattttagtacttacgttgcattgtaattattccctataatactatgggttgtgcattctttcagaataatgactgaatattactctattatccatctttctaccgctcttgacttcccaactcctccctcgatcaaaaacaaaaacaaaaatactcactagcacatggtgttacctttccttctattccttcgtccacatgtaataagataagtccatctaagaccctaccattatctgtaccttcttgtgttcactcttcagaagggtgaaatctggtttgctaactcatctggaatagtatagtgggagcaggaagtaagtacatctgtctgatttattaacatgtatacctgaacttacttaacttgatagtattgttcttagatgatctgattgtcactaaacgctataatccaagaagaaatagccaatgaaatgtaccgttaagagatttttcttacaccctttaagacctcttttgtgatagttggcaaactgcctctacaactcccattgctattcacttttttcattaatagtgttttccctttacattggagatacatgaaaggtagcatgtaaaagtcagattctactgcatattcagagctaaaacatgaagtctgtgttgagaggagatcatctttttggaagaagattatagttgtttttggtaggagatgtcttcatggaactgacctggtttaatcaagcactgaaaccagtttttttaaaacgccctgtaacgtctgtgaatacgttgtttacatttatacagattattgggggaattaattcaaggactggcatgtgcttttgctggcagggaaatttatctagaaccttagtaaataggtggagtttttgtgttgttgatacttctgcctattattcaggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgaggtaagctgaagtatctccttctgttcctatcctctgaaacttctgaagaagcagtcacaaggaaggtgtgttgatcaaggtgttcatatgaccttcttatattcttaggctgatacctgcaaaattttgttttctatttcttgttttatacggaaccatattaataattttaatgacatagacaggtagactcttttttccctgttccctaagaaatgtatacttacctcatattagatgttgaacaaatacttgttgaatgagtgaatgatttaatcattaataagtaactaatgagaagtgtacatgcccttgctcaaggctctgctcagcaagccctgctgcatggagccctatgtgcccaaaggattcatactacttaccaaatctttcaccctcccatagggggtaactttccttaactcacacaaaggcgtatgagcctgggcagtcatgcccttgttggactttcagtgtttcttacaaataactgattacattgtcagtgttttaaggcactcttttttttttttaagccaataaagagtgccaccattgatttttgtcttttttcttattttaaaaaagctggccgggcatggtagctcatgcctgtaatcctagcactttgggatgccaaggcaggtggattacctgaggtcaggagttcaagactagcctggccaacatggtgaaaccccgtctctactaaaaaatacaaaaaattagccaggtgcagtggtgtgtgcctgtaattccagctgctcaggaggctgaagcaggagaatctcttgaacccggaggcagaggttgcagtgagccaagatagcgccactgaactccagcctgggctacagagcgagacttcgtctcaaaaaaaaaaaaaaaaaaaaaaaaagaaagaaaaaaacaactaatttttttttatctatcctattggcatttttaaagattataatgaatgcttaaagtttcttaaataccttgaaattaaattgttctgttgttttttgtttttttttttttttgaggtggagtcttattctgttgctcaggctggagtgcggtggcacaatttcagctcactgcaacctctgcctcccaggttcaagctattctcctgccccagcttcccaagtatctgggattacaggcacatgccatcatgcccaggcaattttgtattttcagtggagatggagtttctccgtgttgaccaggctggtctcgaaattctgacctcaagtgatccgcctgccttggccctccaaagtgctgggattacaggtgtgaaccaccgtgccagcccacagtagctttaatgtaactaggtttaaaaaaagaaaaacctaataccaaatacataatttgcccagtggtgaattataccattttatatatatttggaggagtagagtactacaattagtatttagatatttttgtccttgtttatttatatttctcttgtctgaaataagaattcttgtatccatgaaatattaactgatacggctgtatttgtaaaattatgaagtaaaaatattatgtaccttacatcttatttaaagggccaagaagaaaggctgtggtgaaacatcagtggtacctcagtccttttcatttctttagtttttttcagaggtgattcaatcttttgatttacctggtaactcaacatataaagacctctgactataaaatgtacatctaggccgggtgcagtggatcacgcctataatcccagcactttgggaggctgaggctggtggatcacctgaggtcaggagttcgagaccagcctgatcaacatggcaaaaccccatctctactgaaaatacaaaaattagctgggtgtggtggcacatgcctgtaatcccagctacttggaagactaaggcaggagaatcacttgaacctgggaggcggaggttgcggtgagccgagatagcgccattgcactacagcctgggcaagaagagcaaaactctacctcaaaaaaaaaattaaaataaaatgtacatctaaaggaacaaattgtcaagccaaagagctcgtcttcatttcagatatattatacttactaaaatttttctgagacttagatattaatttagtatctatctgctatgctatgctatctgctatctgctatgagaaataagctagtctttgaaagttatcaatgagcaactcccattgtgagttatttttaatttctgctacaacttgtttcttcttttgcctggtgcacgtgacaccatcttactctcatctgacaatgtctgcctccctgccacaatgctgcatgtgctgctgtatttcccatttggatactctcctgtcaggaatcaggacctgacagttgtctgtgggacagtcatatgcatatgaaggtcaaagctgagtgatcatggcacctcttattctcatacattgagattagcacaaaaatagccctttagtgtaacattttgtagtgtgatacataaaagaggttgcaagtgaagcatctggagttcctcaaaaattgcattgctgtcatttgtatattacctacaacagatatggagagctttgaatatccagggccaaattgcaactcttaatcctgttttgtttgttgttgtttgtttttgttgttgttgggttattttgggagatggttgttgtttggtttttggttttttattttgttttgttttgtagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacaggtaattgttcctattcctgactctttgtttggttttgattatatctcagaaataacttatataagaaaagcaaagaggatggacagttgattctgcagttttgtcacagtgcctaggagaccagaatagcagggtccatcatagcaattttctctagcctagtgatttttaaactatttgctagaggggtgtgagcagggaaggagtctaggactcccctcaaccaaagcaacaccactttttatacgctgagttcacataagattgttttaagtggttcagtattaagaaatctgtcaataaaatgtattccactgagttaaatgaaaagtcgtgaattaaatgagaaaaagtcacttgacacaattctgcagttcacataagatttttaagaaaaaatgttactgctttaatactttttttaactagagttctggcaaattaacctactattgaaaataaagcaagaacaacttgaattctttctcctctaagacagaaactaacctgatgggcaaactgaaatgaatccgttcattagagagatttgaaaggaattaaggacaagatagccatgagctggttgaagtaccactaaagctgagcagtggtcatggttgtgggagctgctttgggttaaaagttcccagcattcccagcatctgaaagatatctgtatttcttttacgtcttaaactcttttatgacttacactttttaaaaaggattccagacacactaaaaccaaatggagaaatactctcctgggaattaattgaattcagaaattttcaaagagatcagattcagttgcaacttttgaagctctgtgtttgtggtagcaagctagtagaaagcagtgaatatcatccattgttttggcgctactgtataaaaggatagtgggctgtacatactatgctattcttttcttttttttctttattttaaaattaatatgtgctcattattctcttttcagagaatacagaaatgtataaacaaaaatgtaaaaataacagtgcttatttcttgggataaccactattacgtaggacaaaggttttgtgtttgtttttgtttttttaactttttttggaaataatttcaaatacacaaaaagttacaaacataaaaataatacaaagaacatcccaacactctttacccagattcacctattgttaacacattttattccatttctccatttgcatatgcacttatatgctcagtctttcttatacttttgcatgctcagtctttctctctctctctctctctctctgtcacacacacacacacacacacacacacacttgcatgtgtacacccagacacacacaaaattttgttttaatcatgtgaggataaattatatacattgtagccctttacccccaggatatttcagtgtgtatgtcaaagaatattttcttatataaccatagtgtagtcatcaatttcataatttttcattaacagtgctttaatctgtcatctatatgttgactgaatgtcatttctttataacatttttcccttccaaaacaggttccagtctagggtcaggttttgtgtttagtagtcaagtttctttagcttaaactgggatatttccataatctttctttttcttttataacattgatatttttttaaaatacagttcccttctgcttcccccgctgcttttacctttaacagaacattgctcattgtgtatttttcagatgtttccttgtgattagattgaggttgcgcattcttggtgggattacttgcataggtggtggtgtgttctcaatatgtcacatatgcaggcacacaatgtccttttgtttctcactagtaatgttaattttgcttacctggtacattatttaaattctcctttgtcattaataagtaatctatggggagacgatttaagaacatacaaacagcctgttttacatcaacattttcccctagatttagcatccattgattatttttgcctgatttaatctttatcattatggttacaacgtgatgatttttccaactccagcactccctttacatttaccaggtagccttcagcattctaatctaagcaagatcttggcttactgcaaccttgacctcctggtctcaagcacccctcccaccttagcctcctaagtagcacacaccaccaaaactggctaattattttatgttttgtagagatgggatctcactttgttgcctaggctggactcaaacatctgggctcaagcagtcctcctcttgccttggcctcccaacatcctgtgattacagatatgagccaccatgcccgaccccctacccccatttatttatttgtttgtttgtttgtttgtttgttttttgagatggaatcttgctctgtcgcccaaactggagtgcggtggcacactctcggctcattgcaacctccacctcccaggttcaagcgattctctagcctcagcttcccaagtagctgggactacaggcgtgcaccatcacacccagctaatttttgtatttttagtagagatggggtttcagcatgttgaccagtgtggtcttgaactcctgacctcaagtgatccacccacctcggtctcccaaaatgttgggattacgtgcgtgagccaccacgctcagcctctacacccatttattgtatttgtatggtaacaaatcattggtattgtgtctgttataaatcatactaataatagtatgaagttttttctactagtttataatttattactgtacttaattattttggtgcttaaattgtaccagatttggccagttgagtatcccctacatctggctcttacgcgggacaaagtgtttaacataatttctgagtgtgttttctgttcatttagaagcagtatttttatactttcttatacttcattttgatgaatgaaaagggcaaagcattaaacaaaataatcctggtagatcaatgaactttgtttaaataattaatagcacaaagcaatcaaagcatgtagatataggttctctcagagtagtccatttttaggtccataggatgaggtcattatttttatgttctttgtgtctcccagcttcattgctccaacctcctggctcttaaagggccaattgatgtatgacatcatcccctcaaaatgggctggagacagcaaaacaaagtaatattctgttccttcccttgggaagactaagtgtgcctatgtggtgtgcacatctcatgaggatgactctagtggccatatagagttctatctatagagttagaagaataactctaatcatcttcatgaattttttataagaatgatctcaatagaacttgtcttcattaggttagaaaaggcaataaatattctaaaaactcataatgacctatttacttttataattgagaggttatattttattctattcatacaactcttgtttttctgattcttttttaaggcatattccctatattcttttcttcccatgttctaattgtcctgttttcttcaaataggtaatttaattttatttaaataggatctcattttcttgaaaataattctgtatttctttcctagcgctaccttgatgaagcagacagagataaggagcgttacatgaaggaactggaacagtatcagaaaacagaggcctacaaggtcttcagtaggaaaacccaggaccgtcagaaaggcaaatctcataggcaaggtatcaaaaccagaaccaaatgtatttgtagtttgttgtgggtgatggagtgtcataaagccaactgttaagagtggtaactataaaagatgtgtttctgttttttctccactatccagtattcacttacaagcattatcttgaaattttattaaaatcacattgctctcatttagaaatttcaactgggtttccgtgtctattatcaatgattttgacttgtcctccgagacccctgttagttgcctgcccttcttttcctgattcccagtttaggcatttctctgcctgtaagcaagcctatctacaaaattatatcagtaacttgcctttaacacttctaagcctttcatgtgtcatttttgaagcaccatccacaactagcctatttttccttagccattgcatcttctctatacttgggcatctagcctgctaaaattatagatgttgtataagtagtctttggtttgtgtcttctgtccactcttccacccttttctccctaaagttaagaactgtgtctgctgtttctcttatgcctaattatgaattctgtaggcatggggttcccttacttttgttggctgaccgattaataaagccttaaggaaaaatatcatatgttatgagaatctacatatacaagcaggttttatagtttggcagagtcgtatacttgggttttgttattgctttctttttaaatgtaatgttctcttattcttttatatttttagatgcagcccggcaggccactcatgatcatgaggtaattagccatctgtctacatatcatatatatgtatttataataatgttgctttttgaaatgctattggatttttttttttttaatgaatggcaaagtatttcctatctcgtaattcagattaaatgagatactttagcttgggggttcttagcatatggcagacacttacgttgtgtgtctgtcattgaactacagcccctaacctcaatcctttcctgtgatctgagaattttattggctttaaatgccaaagatggctggaatttggaatgaagtatagaaatgagggctagctgaaagctataacatgaccatagtttatcatcaccaaatacttaaatctgactctcagaaaagttgttatttaaagaatccagcatttgcttaaagcgaactgttcaactacaatgtcgatagagcacaagcgacagtatctcaggtttgttttttgttttgttttgttttttgtttttttgagatagagtctcactctgtcgcccaggctggagtgcagtggcacaatctcagcccactgcaacctccgcctcccgggttcaagcaattctcctgcctcagcctcccgagtagctgggactacaggctcgtgccatcatacccggctaattttctgtatttttagtagagacagggtttcatcatatgagccaggatggtctcgatctcctgacctcatgatccacccgccttggcctcccaaaatgctgggattacaggcgtgagccaccacgcccggcccagtatctcagttctcacacctcctttcctattccctcacttcactagcacatgtttgtgtactggcttctttcctcccacttggttcagccccattgttaggatttaggcctgtgtttctgtgtgtgtatgggatttaggtgtgtgtgttgtttcaaattctgttttctccttcaaacttttcttgtttcctctaacttcctttaaccctcatggctctctatacttgtgttatgtgcttagctgatctgacctaggggttttgaggtaattcaagggctcacactctttggttgtaatgtctttgtggacatacacagtctagtttccatctttatatccaaccccataccacctatcatgatacctttgccttgagaaggtattccacaaatgattattttatggaatctattcaaagttgacctgaaataactgagaatttgaacaaaaagaattttctgatgtactcttttacatgtgtttggttttttactaaatcaaggaaatgttggttaccttaaaacatagagaaaagattcagattcacaggtcaaatagacgttattaccatctatgaattataaagtgagaagcatagtaaatatttacattttattcttcagataaatcctatataaatgtaattatatatgacattctatgctctaattaggatgaaatgttatgttgttttgctggagaaactttgtatgtattctttgtattttaaatcataataatattgtaaacttttcatattagcagacatttgtataattacttctctctttctttgcctgtgtgcccagctatcaatatcatgaaattcctgtgcttctttttttctctattttatagcttctctatccttaacagttaccaaagagaatttggacagtaacctgaaacattagatctcacattttctagtcagtcatctgaataggtgtcagtcatctgactcatttcatcactatgaattttgctggccaaactatatgtagcatttttgtcttcagtaaacttgatagttgcagtcagaaaagatgtagatttagtctgtatcatagaacctgctgctgattatttgagaagtgaaggtgtttattcagatacattagtgtgatatgaatttctgtaatttctgtgatttgcaaaaagaagtgagtctctgtatttccctgttacaggattagacacatgttaaaccaaacaaaaaaaaggagtgagtagatggagagccagcagttgtttcttaaaaggttatacagtaggttctgtaaatccatgtgttggtatggccacagcaggataaagctcctttagtaagcgtgttgacccaattaatgtcccttacttcatccatttttatttttcactgaataatatgtttcctaaattagataattttagaacaattgcagtataaaagaactgatttgaaagttttaaaactgtttttaaacactgttacccagtaattttcttacatataacttcttagtataatagaagttcagaaaaatagcactatgggtgaaaagcagccgcagaaggagcccatggaaaggagtaattgaatcaggacttaaaaatgacctaggttttgtgggcatctcagggtgggtaaaatggcttgagcagaggtatgagtaagtttttaataaaagagcaaatatcttgcagtgtctaaagaccatagatcctaaatacatacttatttccctttacttatcctatgaggagtaaaacactgagactcagtgatcctctcaactgaccacctcattttgccagtgaggaaagtgacttgcctaagacagtatatagaatggaaagaatttacccagaatcacttactgaattaaattagaggcagaattgtgacagaaacccaggccttctgtgtcatagtctaacattcttgacagcacagtgccatgctacatagcataaattacagcgttgaaagtaaaaatgggcctcgttgcccaaggtgtcagcaaaatgtgttgccagttaagtaaactatttggtttgtgtatagtaaagaaacctattgtattcctaaatgaaacttggatccctaagtcattgttaccaaggcaggtactggagagggcatattagagctaaagaaatgctgacctgaaagccattctgcatagcagtggggcacttcaggctggtacacaatgttaagagcatttcccaaagtaaaagtctcttgagagaagcacatatcacactctttgaaattctggccctgagcctagatcacagcaaaataggttcagttcaaaagggcctcttttctcttaacctccactcaatatatagaatggaaaccaaagtgaagaatattcttgctcctctcaaatcgaaagccagcccactagacccaagagttagcgagtattactctcaagaaagtgtctatatctcatgtgaaaactaagatagaaacaataattttgtttctcctttaatttatgagaaatgacagaatgacactcagcttgaacaaattagaccctttcagtgaaagggtaatcagatccttatgattttaatcctttgagctatccttggagcagcttaagtacacccaagcccccaggaggatcctctccatgccgtgaaatgtgctcagtaatggaagagcgctgatggtttttattaccactcttccattaagtagaatttctctgttacctttcagagactgaacagtttcattgaattgctttaatgtttcttattttgtgctctgagaatctgtaccaaggggcagtgtgttaatgcacctatgtggtgctgtcctctgcccttacataattagcttgatttggactgctctggcaaagaagagaaaagattaccagtctgaggagagtcaagactttggaggagagggatctttgtaccatggtaatgggagccaagcgtctccactttacccatctaactggcagatattgagacgtatagcttaggtaactgatctcatgtaactgcagttaagttggagattgaataagataggatgataatgtcctaagtctttatgctgtcatctgtggacttatgtttatatctgttatgccttgtgcatgttgggattgtgtgtcattaagttttgttttcctgcagcagcccagtaacagttaaagcatatgggaagccagcaaatttgagagaaagccactgcgaaatatggctaagattccttctggaaccagcctttcttgttcatacattagtttccattgaaatcccctaggaactggctcgaggtagagctttgcatgttgaaacttgggactttcgattgataattttgttgttcattttcaaattattctgggaaactttgctttcttttgttaggaagaaaaatacaagtagaaattaagtgctctgaaattacatagcttttcagtgtctttcttgctcagctgccattggcaggtggttcacacagcccagcccccttactaggcggccaccgttatgaatacaggagctcgggtgtcagatttccctcttaagctgtgaactgcttagcttttctactgggcaccaagtcatttttgtgttcaaagatttaaaaaactagtggaggctgggcacggtggctcaagcctgtaatcccagcactttgggaggccaaggcaggtggatcacctgaggtcaggagttcaagaccagcctggccaacatggcgaaaccccgtctctactaaaaaaatacagaaaattagccaggcatggtggtgggcacctgtaatcccagtgacttgggaggctgaggcaggagaattgcttgaacctgggagacagaggttgcagtgagctgagatcgtgccactgtactccaccctgggcaacagagagggactccctctcagaaaaaaaaaaaaaaaaaaaaaaaaaagctagtggtgacaagagtaggaaagatacattctgtctagctttaaacaattgtttataggaatgaaatctaggtattatgtttgcatgtttttcatgttataaaggtcctgggatcttaagatttcactagcagtttcttcatttctcacttcctgccattttaccacctttgttatggaaaattttgaacattatgccaacacacttaaaattaatattcacaatgctttcaacttcaaattcattttagaaacgacagccaaagcatcttgagttattgactttattcttaaagatcattgtggaatatattttgcaatgatcttgtgaggcttttttatttttaatggcttattggtgaattaattttaggctttgttattcttttgtatctcacataatcgtttgctttctaatttttagagcctggttatttctgatttctcggtctcatgtgtttgtttgtttatttttcctgtgtctaaagaaaatctaaaagaccccaaagataggctgcctctcttaagtaaatagaagtaccaatggaatatcataattattgctcatagcagttacatttctgcttaaaattcttattgtccactctgcaaatttatattgcataatcttatctcagggagcattttacatgcataaccaacaaaagtgactgaaaaaaaactactctttctcaattcccactgcaatcactttcacaactgtatactgttgactattcaaaacacaaggctaagaaatggcttcaaattctccattagggaaatttacgtaactttgttttaaggtttctaattgcacagtagttgtatacctgagagaagtgaatactttacctgcttaagctctgtgaaagttggattccaatgaaaagatgaatacatttccctcacagactcacctggactgattcctgctcaccctattctttctttaaagaagacatgatcattgtcttcaggcactattatttaatttatcttctattaagaattaactgttttgttcctcttgattcacagaaagaaacagaggtaaaggaacggtctgtttttgacatccctatatttacagaggaattcttgaaccatagcaaaggtgattactgaagtttctttttgtgtttctcagatttttgacaggggacttagttctcagaagaaattcattgctcaaaagcaatggtagtgttatccctccttaggactactcaaagaccagtgaaggaaagctagggcattgttgtcaaagcttctttggtctctggatgaaaggaaataaatgcaaatcacaaattcacttgtcttcaaactcttagcctggaaccccttgcacaaataaaaacttacatgggagtccaaaatataaaataagtaagagcaagtctgatcccattgtggtaaagatgggtacctacagctgtgcttggccagtctcccaggatccccctgcaaaacccctcaggcttctgattgtacaatttaaaaagcaaaaactaacaaacaaaaaaatactgggaattgaaactgtttgttgcaatcttatgtatggaatgtgactagctttaagaattaaaatagctctggggagtcaggcgtttcattgctgaaattgctatctggaatgccataatgagaatagggagatgaggtggggtagctaaattagaggcagctaagcagaacttccctgtaagagtcattgggactcctcagagactccttctagtgctgcatgtgttctgtgggatgtatgtcctcagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggtaagtcctcctgcctgagaactgtcagtgacaggggtgtgtgtgttgtgtggagtggggtgctgtttatgttagtactggtgtggagagattgaaatctcctccagaggaaaattaattaaactacattttttcttctctggatataatagaatgtcagtattggctaaaatcgtccaatgtttcaggctctctggtcattcaaatttttgtccatttatattttaatatctattttcccctcttttaagcttaatttgctattcagaacactggaaactgagtagtaaatcttgagagtgtttcttcttatgtatgtttgtttgctttttagttgtttttgttttaacgggaaggaagggagaatgaacactggtatttcttatatactctttcattttgaagatagtcatagcagaaagctgagcgagtctaaccttctgttacatgcagctgctcatatatactatacagcaattatatagcccatctgtttatttagagtatgtggactaatttcatttctttgagatctaaaagtctctcctctaaaattaaaagcatgtctgtggagcagaccacattagaatcactgtttctttgaaattgtgttttatggtacaactgaatagggaggattttcttactttcttcttatctcacttcaggaagtggagagacacctacagtggacaccattgactcatatatgaacagactgcacagtattattttagctaatccccaagacaatgaaaacttcatagctacagttcgagaagttgtgaacagactcgatcgttagggaatggtgagtgctcactgataaatatttatatgccagcacatcatcaaaaataagatgtcatcagactttatcaatactactaaaaccctgggattacattggatgaacaagttggagacttggttaagattcctgttgcatggttgttaaatgtagtaaataatattagaaaagagaatcactgtagtcccagctacttgggaggctgaggtgggaggattgcttgagcccagcagttcaagtccagagagatcctgtctctaaaaataaaagaaaacagactcaagacagttttttcttatgcttgcttcagaatggtttaatgggaaaagcatggtttttgtggcttgacctcatttctagctttgtcacttattagctgtattcttgggcattagtttcccaaaaggttttgaaaagtgagtgggaaacttagaagaaatcatccccaaaacagcactcagaacaaaataaatataacttaatttttaatcttccttttctctggaaaatactaatgataatttagaagtagtcagtgagacattgtatgtatgtgagcctacataagtaggaagcttttatattcaccactcaataacacagtgactgttgtctgttaaatgttgatgtggactcaccatacaaacaggtaactccctggttttgatagattaaaaaataaactcttcagccaggtgcaatggctcacacctgtaagcctagcagtttgggaggtcaaggcaggcagatcgctggagtccaggttcaagaccagtctgggcaacatgacaaaaccccgtatctacaaaaaatacaaaaaattagccaggcatggtggtatgcgcttgtggtcccagctgcttgggaggctaaagtgggaggatcacttgggcttagaaggtcaaggcgaggctgcagtgagccattatcagaccactgcatgccagcctgggtgacagagcaagacactgtctcaaaaatttttttaaataaaaaataaataaactcttggtggggcacagtggctcacacctgtagtcctagcactttgggaggttgaggcagtattgcctgagcccaggagttcaagaccagcttgggcaaaatagtgagacccctgctttaaaaaaaaatgaaaaaaattagctgagcatgatggcgcacacctatagtcctagctactcaggaggctgaggcaggaggatcacttaatcccaggagttcaggtttcagtaagctagggtcacactagtgtattctagccagggtaacagagcaagattctgtctcaaaaaaaaaaaaaacaaaataaaaatataaaattctcaataagcaaaaaagagagagaaaataagtttttaaaaaatatgttcaacaaatgagcagtagtatgtatccttttttttttttttttccagaagagatctacccatgacactttttggtactaatggtcatttctcaaatggaattggtatttattcattcaaattcctagagataggatacccctttactatgccatcccacaaaactggcatccctttgctctattggttaagttattccatacctgcagacatataaactgtgtggaaattttaagattagactctacaatgaggtggccatatatggatactaaaataagagtcaacagcaggatatgttccttagaatggtcatgggtttgaatctttatttgtcctgtgagtacatgagcacactcatatacataatttatattctggtttggtttggactttgagcaacatatataaagataaatgcctagtaaagacaaaggcagaagtctttatacttcttggtgatgcccttggatggtaactgtacaaggcaatgcattatattttagcctcagccatgctctgatggggaaaggattactatccttctagggagtagccagatggaatggactgtacttcttagagatggctggactccctgcagaataaagaagtggcattactgctgctgcttatgaagggaacagcttgtaaatctaggcctgggatattcaggagctcatcatccttcccattttcgtacagtgttttcaattagcactcttgtaggcttgaaaagtgagagctgggagaaacagtgtggaagattgtgaaagaaaacattaattgataacatcgtgtctcttcacatagatacagggcagctaattaagtattgacccaaaagtggttttccattttgagcattttgccagtaagactctcctaaagcttttttcatctcaagagtataaactatattatttgttttctgatgagtctttgaaaacttagaatattactattatccttgattttaacctacaaatattttgcccctgaaaaaatagctaaaagtgtgaactgttatattactacagattcttacagtctagccatgcaaacataactaacaatagatggttccccacacccccaaaactgtcaaaggaaacaattacaaagactgtgattaatactggtttggcctcattatacaaatatgtacagacagcgaggctgatgtccccagcactcatgatgcaattaattactctgacaagagtttggcaaagttttcatccactgtcaggagccagtgagtgaagggaagctaatggtctacaagtttcagaggagcatattagggacctttagaaatctaacattttatatatgaagaaactgaatcccagagaggagaaacatcttgcttgaaaatatctgcgtagatgagtacagaatccaagactagaaccacagatatctaaactctctcattcactgggtttctaaaacattgctctaaggaagaggtggatgggggaaggggaaagcactaaaaaatcctgaaatagagcattaagatacataggaagtaaacagataaaaattgtaatccaggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattcttcagactaaagtagggtactcattttccctcctcaggtttgtccctgatagttgcttttctgtgtttagctgatgattttcctacctcccattgttgctgaactggaacagggccatgtttctcattgaaatgttatgtaaaacatctcaatgaggttgcctgcttacagctttatgagttcttcagtttacatacaccctgcactcactttaacgcttatgaaaccaaagcatttttaaaatccatagcgctaaccccttccattcaatacttactttcttggtgttattttccttgtttgtttttgtttttgttttgttttgttttcctgattctacaggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttatttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaattcacctgtttcaattttacttgctttgtaacaaaaagtcctacctctggccgggcacggtggctcatgcctgtaatcccaacactttggaaggccaaggcaggcagatcacgaggtcaagaaatcgagaccatcctggccaacctggtgaaaccccgtctctactaaaaatacaaaaattagccgggcatggtggcatgagcctgtagtcccagctactcaggaggcttaggcaggagaatcacttgaacttgggaggtggaggttgcagtgagccgagatcgtgccactgcactccagcctggcaacagagcgagactccgtctcaaaaaaataaaaaataaataaaaaagttctatttctgttttttcctcttaaagactttgtcaactctacattaatcatgacatctgttatgcttttaaaacagtaacacattcattttactaattgctacttcaaaatgtatctttaccggtttgagaagtcagctcttttaatgtatgctgtaacaatacagtgaattctaattcattttaatatagcagtagtattctgaagacaacttacaaggatgtttttaaagtcagtgactctgatgtccccttgatagaagatcatttgatagaagaaaggagatgtgcttaaatgcttgcttttttttttttttttttgagatggagttttgctcttgttgcccagcctggagtgcagtggcacgatctccgctcactgcaaactccgccttccagtttcaagcgattctcctgcctcagcctcccgagtagctgggattacaggtgcacgccaccatgcccagctaatttttgtatttttagtagagacagggtttcaccatgttggccaggctggtcttgaactcctgaccttgtgatccaccagcctcggcctcccaaagtgctgggattacaggcatgagccaccacgcccagccaaatgcttgctttttgaaaataactaatcaaaatatttttaaaggaaatttgtcacctatttctactatgcttttaaaaatcctaggggtgaggcaacctggtttccagagcctgctgctctccaagtagccatttgtgtggcattgggcaagtcttgatttgtttcaactccagtttcctcttctgacataacacgtgcctcagcaatcctgtactattgtaagaaggatagagtaaggtaacagaatccaccttgccttggaggacaggaagataggaagtatctgttacatgattgccagtaactatcagggtatctcagttaggattgagtttggctctacattaagcagaactagcaacagcttaaataagaagtgtgtctttctcatagaaaactatgccaaagttgggcagttaaaggctagtatggaggctcctgtctgttccacaacatgatctttctcaaggtcaccccgtggtccaaaatagccacttgaccatcagccatcactctgaaattcctggcagcatgaggaaaagagggcaaggacaaaatgagcaaacctagctgagtcagggccctctaaagagtcttcctggaaatcgtattcaacactttcacttaatttggccagaactcaatcatgtgactatagctagctataaaggaggccaagaaatatcatttttgcatggacgtcactgtgcccaacaatacaggttttagtaaggaagaaggagaaaatgaatatagagtaggcaactaatgttaatttcataactatgtgtgacttcatttatgcactctaagcccaaccccgccatgctagtgaatggagtgcattatcttgcctttgtctcttggccatttgagaatgaccatgtacttccgtgatacttttttcccccggagagccagaaagccaaaaactggcttccatctgagttgccatttcctgttcccatctagctcttcccctaccctacaacagctggtggccagtcttgtttagtaaaaatcaacataaacaggtggtaa

SEQ ID NO: 12800 - DNA, 8521 bp, Human
aggccacaccctgggtcacctgccctggatgtctccctgcccaggcaggcaagtgaaggctaaggggtggctattggccctcgaacccagcaagataatctggccattgtcccctcccagagcctcctgccttctctcaggctgctgcccagtggctagggcccagcaccctagctgggtggccgtctgctgatgggccatcctgcccacagatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggtcaggggccgccagctgccgtcaccttgctcccaggacagcccagtggcctggccacgccgcctcccacttgctcctacctgcctgggctgtggccccagctgccagcaggccacagtgctagcaggagcccaccctccctactctatgggaggagccgctttgcagggaacgggggaagccgggctgcctccaacgggcctgaggggtcggggtcctggacccggggtgagtccccagtggcactgcagggtccccagacaaggggtctcccgacagagctgctgatctccagtggggtctgtgggtcaccgggcccgaacttggcagcaccctctgtgctgggacgaggtttgcaggctgggagctaggggttccgaatggagggtggcagttcttcggagagaagttctctgacagaaacgttccctgatggggatgtagggtttcctgctacgaatatggggctgcctgacaggctccccggcctgggctatgggtgtgctgacggtggggccacccggtctcagtccggcctccttacaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggtagggcctcctgctggggccttctggggctgcgcaggcctcggggagagccccaccgggggtctgtggcctgtgtccacggctgccctgctgaggacccccactggcctctgggtgctctgggccagccctgcccctgccttggtgccaccgccagggccctgccacccatgtgccctcagacccggcagcctggcccacccagtgcctgccctgcaaactggtccttcctgccaaggcccccgcacagcctggcaccctcataccttcgttggtcccttcagcccagagataaaatgagctaagtggcccctggaatgcagctctgccctgctgtgggaagggccagggtggctgcccatccagtgaggcagggcgggctgtaggctggggtggtcagccaggctgggtgaggtgtgggtgttactggagccccagggcagtgggagagcctggtggggtgagcggggctggggctgctcggcctcagctcaccctctctgcatgcaccaggagccgcgtgtgggccgagccatgcctcctgcccacggccaccagcaagctgtcgggcgcagtggagcagtggctgagtgcagctgagcggctgtatgggccctacatgtggggcaggtaggccccggggacctgtggacctggctggctggaaggaggagtcagagggggagcccctcgtctgacccctggggtgtcctgtccccatctcctggggaggaagcggagctcaccgcaggggctgggctgatccctgctgggtggaaggtggggtgcgggtgtgcagggtgggagtctgagccccgaggtctgccaccctcaccgccctcccggtgcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgcggccagggccggggagggcagccacggggggccctgggcactggtccaggggcagagagcctagcctggcccccctgccatgctgcaggtgcccacacctcctgcttcccccgacgacccctacaccccctcacctctcctctgtctccggaccccatccaggtgctgccttcacctgcctggagactgccttccgcctggacgccctgcaccggcagatgaagcttctgggagaggacagcccggtcagcaaactgcaggtcaagctggagccaggtacctgctcctcaggacccgctcccacaactggggatgtcacccctcaaggcctccttgcctgcccttcgtgtgttctggctgtggcttctctgtcctgcactgtgcctggacccctgccaaggccaagctgggagcccctggccagggcaaggcctccccaggctcccacagccaccgccgcttccctggctctgagcagcagtcacagtggtgtgtgagtcctcagtcttccccgaggccctgccgctgcacgcccagggcatcagtacacatctggacatgtgagggacagtggcgcttggcccttgctgctcctcggagcctgaccactgcccctccctattccacgggacactggtggtttcggacgccagcccaggtgggtgttcaccttgcaggagtgaatcccagccacctgatgaacctgttcacctacgagaagggctactgcttcgtgtactacctgtcccagctctgcggagacccacagcgctttgatgactttctccgagtgagcagccccctgcccgggacggccctgctgccatctgcccccagcccctccccggctcacagggctgcctgctcttgcggcagttggggtggaactggcaggggcctgtgagcctggctgggacctagtctgcctttctttgtggggagtgcctgggttgccacctccccttctgccaccctgtttgctcccttggcagggcctgcgtgccaagtgctggctccgcagtgcccactagctgcccctgtgcccagcacgtaccttggcgcacgccctgcagtgccctgcaggcctctggtggggctgcctgtgccccacccttccaggcctgctgaggccccacctctgccacacaggcctatgtggagaagtacaagttcaccagcgtggtggcccaggacctgctggactccttcctgagcttcttcccggagctgaaggagcagagcgtggactgccgggcaggtgaggctgacccccaaccctgcagccagggagccgtgggtatgatggcaggcggggcctctgctgcctgaggggccactccacctggaggaaagccctgtcagttcactgtctgtccttcagccaacccttgctggaccatgtgggccccaggctggtatgctatgagaacagggctggggttgggggcctccctggggccggtggcacaggctaagcaggccgagtcaggcactcccaggaagcgggccatggaaaccaggtgtgcaaagggcctggtgcaggaagggcgggtgacgggggtgtcctggagctggagaacagcagccagccctgtttatgtgtcacttgtaaaggtgtccctgagggtctgagggcttggggcccaggaaggcactgcagggttcagacattgagggagaggccagaattgctggagggtggtgaggtgccactgggagggctgtgcatggtgacaccaagttttggaaggtacagcaagtgcatcaagagctttttgtgggtagggaatgggcactgccctttaagagcaggaatatcatcttaagagcctgttgcccccatcccgcccctgctggttcatggcgcaggtggcctccaccagcactgaggttgggtttagactacttcattgtcttccacccaggagaggcgtggagtgggtgcgagtcccttggtcaccaacccaagtctctgcttccctgtaccccttcacagaagccccttcagtggcttcaagtggcagtgctggctggagctgactccgccttcctgaacagcccacgtccctggaacaggccacctgcctggaacacactcagggtctggggtctcctgggcagattgctcaggcagccccttcctagcctgggcagggaccccagggtcacttctcccctctagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcagggtgagtccctgcagctgatgggggcggcccaggggctggggtgcaacagcggcccagccctgacctgccccctgcgctgcagaggtggtgatgagcctgtccaagtgctactcctccctgctggactcgatgaacgctgagatccgcatccgctggctgcagattgtggtccgcaacgactactatcctgacctccacagggtgcggcgcttcctggagagccaggtgcggtcacctgcccagggggccagcctggaacggcctagccgtgcggactgggagtcccacccgactccctagtctgagcccttggggcaggccaggcacattctggagaatggggcggggaagacgtaggggtctgttgggagtgggggcatgcaccgggtgcaggtaccagagggcagcctggactccaccagttcttggagaagctgtggaagggaccagctgggagcaggagtttagggtccaggccaccacagcctgctgggccctgggccttcagcgtcctggtctgggcagaggggacgtcccagctcctcagagggaggccagagccctcaggcccgtgggccctggctgccctgctccctgtatgtgctccctccagcccaggttccctggagatggggcctccatggttggcctggaagggcagggtggaggtgggaggctaatggtaggcctcctggccaccggagtccaggccacagccctaatgatgaagctgggaagccaggggcaggagggccgcctggccgggctggcagggtgggctggctcgaggggcctggggagcccaccagtgtgaccgagtgcccctcctgcagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctgatctcctgcgctctttctcgcgactcttgtcctctgcatcttcctggctgtgtagggtgggctggcctgccgggacttggggcctggagctggtcaggagctgggtgtggccccctcctctgatacataagcccgagagcaggctccccgaatcctgcccagccccttggctggaccccctgggcctgagtagcctctggatgtcacaggaaagccatgtgtcaccttcactctgggccttcacctgtggcttaagccaaatcccggcctcagtggtgatcctttcccaagatgggtacaaggtgacaggcatgttttgttttggagaactgagatttccattttcccaggcgataggtgtcgctgcccttcacagtccccaaggatgtggcgccaccatctcagtgccacgcacacctggccaacatgccgtggcccagaagcagcacgtctcttctcccaacccgctggccaggcccagtcacagccccactccacacatggcagccaggaagtggggagggcaggaggtgctgggcaaataaccctgataccatcactgtccagtccccagtcaccaaatgtcccactcaccctccttcctgttctggatgccccgcccctcccctcccctcccaaggacatatgagtcccctccagtggcggtggcaactctggtctagggtctggggccgtctctacatgtgttgcttcatgtaccttcttcacatcaggtctgggggaggcgccaccccatccagagacctaggaactagaagactgccactgcccctcacacccagggataggatgactgcagtaacccctgtgaaagcgggtgtggagggcacctggcagcccctgctgcatggccatctaaagtcttgccaggcaggcacagctagggcccctgcctgggagtggacaccccactcccccaagtcgtgttctctgtggcctggggctccagccttgggaggacccctttcctgtttcttaaccatgcttgatggtgtcctcaaaggagccctgctcagtggcagaactgctttctcagcctcttccccgccaaggttgttttcaagtcccagcagtcacagactttcatcctgggctcttctttcttttgcaattcagctctcgaaatgactctgtggtctgcgggtgactccactccacgtgcctacagccacgcccacagcgccacctccggacgctgctgagctgcgcacctgtgcctgacacctggctttgggaaactcagcagcagtgcccagcgtcatgaccctgggggcaggagggcatctggatccaggatggcaccctcaccacaatctgtcttggctctgtgcccgcccgtggggtacacaggagggctctttcagccctaagtccttgtgttcctgacctttgttcctcttccacccagcttgcaagtgcagaatttttttttagctcgtcgcttccctgcagtcccttgtccaatgcagcctccggccgatactcaggccagtgttgtttcccaacctctccactagatacgcacacttagctcacggtctgcctcatgagtcatcccagttgagctttaccaaatgttttgccccacctaacagcctgcccacattccaaatcctggcaggtcgcacgttttattagcacagcacccctctcctagcggccagcttctctattaggccacgttatgctccagccacacaactatgaagcgcagacgtctcacacaacaaagctttctcatgctgcaggcccacctcaggctggcaggggaaggggggattctcttcaatgtgaccactctcggacccgtaccgatgaacagagatctcaaatgtttccaggcaccttgccagggataagagagctgttgaggggctcacactggcagtggaagttctaaggggcctacaaccacaggggctgcaaccccaccatatgcacaaaagcgggggcagatggcaaacagcactaatgacaac

SEQ ID NO: 12801 - DNA, 39154 bp, Human; identical to SEQ ID NO: 12384
  misc_feature (1)...(39154): n = A,T,C or G

SEQ ID NO: 12802 - DNA, 13782 bp, Human
  misc_feature (1)...(13782): n = A,T,C or G
cccctgcccctcaccttctgctccagcacacagggcagggagttcccccggtccatcctccccctctggccctctccgttctggggagaccaaagccgcagtgagccagagcggggcagggagaccttcccagccttaccccggcttcttcttcttcaccaggcaactctgtggccccacaccccccttcccctgacactttcgggtgccaggacccagcttctgctgctctgcctgttcccctccaggaggcactcacctgcaggcctgcgggagagaaggggcatgggtcagatgcagctctgaggtcagcaggccaacacgcctgacctcaccagacccctgcccacagcccagaccccggctgcccagggacctgtgtaagccccttctccagaccccggcaccaggccccacttctcacctgggcttccagtctcactccctgatgggctgaactctgtggactgtagctagaaaggacacaaaggaatcagaggcagtcggggatattcacctttggtctccttcactttgggggtctccccgctccctgagggtgcccaagtggctcagtccctcagcaccccacatgcacgttcctcccacgtagtctatatctctggtcctgagaccttacccggctcagggtggtcctgccataggcggggagagaggaagatttagacgttccctggtgcaaggctggaagacagcaaaaggtcctgggttcagtccctttggccctgacagcccttcctgagacagcaacctcactggccttccacagctggggcagggcaggaagggatcacgctggggggaacctggtgggcttctgctagctcccagctcctactggtcaccttcagcaagcaatacagtgctggtggttctcagctgtctctaccaccatccctcttctctccagctagaagtggcccaaatatacaattgggcccaatgcctgatgtgaaaattgagtcagccagagccaaggctcacatcataaaatgaacctctgggatacacaaagaaaactaaaatcgaatcacaataattacattattataattttattaacaatgttagtaatcaaatctaaaaaaaaaaaattttttttttggccaggcgtggtggctcatgcctgtaatcccagcactttgggaggccaaggtggacagatcacctgaggttgggagttcaagaccagcctaaccaacatggagaaaccctgtctctattaaaaaatacaccgtgcccggccaaaaatttttaatagagatagggtctcactatgttgcccaggctgaacctgaactcctggacttaagtgatcctcctgcctttgcctcccaagtactggagctacaggcatgggccacctgctcagctagtattcatatttgtttgtttgtttatttatttatttttgagatggggtctccgtgtgtcacccaggctgaagtgcagtggtgtgattatagctttctgtagcctcaacctcccaggctcaagtgattctccccatctcagcctcctcagtagctgggactaggggcatgcgccatcaaacccagctaatatatatatatatatatatatatttatttatttatttatttatttttattttttgtagaaaccaggcctcactatggtacccaggctggtcttgaactcctgggctcaagcaatcctcccaccttggcttcccaaagtgctgagattataggtgtgagccactatgcttggcctagtaatcaaattttaaaagtctgacattaggctgggcacagtggctcacacctgtgatcccagcattctgggaggccgaggtgggtggatcacgaggtcaagaaatcaagaccatcctggctaacatggtgaaaccccgtctcgactaaaaatacaaaacaaattagccgggcgtggtagcaggcacctgtagtcccagctacttgggaggctgaggcaggagaatggcgtgaacctgggaggcggaccttgcagtgagcggagatcacgccactgcactccagcctgggtaacagagcgagactccatctcaaaaaaaaaaaaaaaaaaaaaaacagtctgacattatactacagaaagagtcatgttctcagcactgtcactggggattgtaccagcagtcaacaacttcacatcagcattactggacctcagtctcaacttgcacatttaataggatctctaaattctgaagtactacagattataattcaggaaaatttgtttccagtaatatgttttcctggaaataactttgtacctaagatccttagcttgaggtgatctcaaaatgccttcacctccaattgctggaaatggctggcatttataccaactgtttccacagcatttttgtataaatagttaacctccatagattcaaaactatgaggaactatcttaatatatacatatatatgtatatattcacatatatacatatatatgaatatatgtatatatgtatatatatattttttgttttttgatacagagtctcactctgttgcccaggccggagtgcagtggtacagtcttggctcaccacaacctctgcctcccaggctcaggtgattctcctgcctcagcctcctgagtagctgggattacaggcacgcgccaccatgcccagctaatttttgtatttttgttagagacagggtttcaccatgttggccacgctggtcttgagctcctgacttcaggtgatccacctgcctcagcctcccaaattgctgggattacgggtgtgagccactgcacccagcctcttcttaaaatactcttatgaaatctgttgcttggaagcattcgattattgagaacaaaacctcatttttacccctaacacttatttttatttagaaaatagctttcacaatcaccattcactattgaagcatttcactcttacaataataagtacacatttattcaaccaactgatagaatttcaaccttcaaaccctgcacgaagattttcccctccaaattacttctattataaaatgcttacgtgtgttccagagcgactattccagtgtcaccatttaatcagaatgacatgcctgttcatgattctagaattcaggttgtttaaatatgacagtaacctatgcagtcatgtgatcattaatcacccacaagttcagggacgccaaagatgatccagaggtaggcatctggctatttcaacttcacgaggccaaaatggaagttaaagagctaatctgggctgaacagaagattctggcagaacactgacactgaatccaaccttcacgcatcctctctccacatcattctttaggccttaactctttattccacattctctaataaacctctgtagctcttcccacccacagagacagcatcctgagagctctggggaacactcagatgtcctaaccacatgttaaccttgaattccccagttccagtggttttcacctctgctccacatgagataaccctttcaaagagccatgcccaggatcttgtcatcagctgcaccacgctgcctagaaactgtgagcttggaccattcactttgtggctttggctcagctccatccccaccacccagcccaccaacctcatggagaactccagtttcttcattcccctcctacctcccccacctcccaccttctgtcactaccttctcagtttcggctcggtggctgggcacagcaactacttttatcagctcctccatggtgcagcctggcccctcagcacctatccttaaaaacgctaacccagggtcaacccaacagctcccatcctgccccagctgtggacatacagcccacacaatgtagatgagcatcactacaaaggccaagcctcgcacgtttctcctcccctccacggcagttccaaaccctcgccattctcaccaagtctcaccctctaacgctcagcagacaacctcggcttctcatctggcctgcccctggatccaagttcccatcccacaggggaggcctttgaaggccagcctcccacacattctggggctcgatctcaaccagtcctcaaaccagccctctaatatatatatatgtatatgtgtgtgtgtgtgtatatatatgtcacccaaaaaagaaaaaataggacacccaggtgtcacccaaaatagtgtgtatatatatgtcactatatatatatgtcactgtatatatgtgtatatatgtcactatatatatcgtgtatatatatatatagtgacatatatatatacacacacacatatatacatatatatatacaattagagacaggatcccactctgtcacccaggttagactgcagtggcgcaatcatagctcccatcttagccacccaactagctgagactacaggcacatgccaccactcccaactaatttttctattttttatagagacagtgtctcactacgttgcccagactgatcttgaactcctgacttgaagcagtcctctcacctcagccttccaaagtgctgggattacaggcatgagccccgactggacctttaatggaagccctaggcacccttccctcctctctctgtacaatcttactttctcctcaccattttcctgccacatatgagcaagctgaagaccctcaagctcccaactctgccagatgcaccttccacccacagtgctgtacatggggcacttcaaaccccacatgtccaaaaccagtctctcatctttccctgaaaatccgcctctcttattatctcagttccaagttggtcatcacccagcacccaagacaaaaacctcagcttctctctcttgcacctcccacgtccaatcagccactggattcgatccagcggattcaattgtctatatattctcaaatccattccctcttctctggacccacatcgttttttagcccttatccagtctattggagagtgtggtagattatttccaaagatggcctgcactgttgcctcccatctttcatgctttctgcaatgagaccttgtggtacctgtcatcaagaagtggagtcttggctgggcgcagcggctcacgcctgcaatcccagcactttgggaggccaaggcaggtggatcacctgaggtcaggaatttgagagcagcctggccaacatggcgaaaccccgtctctaataaaaatacaaaaattagctgggcatggtggtgtgtgcctgtagtcccaggtactcgagaggctgaggcaggagaattgcttgaacctgggaggcagtggttgcagtgagccaagatcacaccattgcactccagcctgggtgacagtgagactctgtctaaaaaaaaaaaaaaaaaaaaaaaaaatttagctgggcatggtggcatgcacctgtaatcccagctactcaggaggccgaggcaggaggatcattcaagcccagaagatagaggttgcagtcagccaaaatggtgccactgcactccagcctgggcaacagagcaagaccctgccagaagaagaagaagaaagaagaaagaaaaaagaagaaagaagaagaagaagggggagggggaggaggagggtctagctcccctccccttgagtctaggtggccagtgactggctctggcagctgcaatgaaggagtgacactatgtggtttcctcttaggcttttttcttttttttttttttgagacagagtctcacgctgttccctaggctggagtgcagtggctccatctcgactcactgcaacctccacctcctgggttcaagcaattctcctgcctcggcctcctgagtagctgggattacagacatgcgccaccatgcctggctaatttttgtatttttaggagagacggggttttaccatattggtcaggctggtcttgaactcctgaccttgtgatccgcccgcctcggcctcccaaagtgctaggacaacaggtgtgagccaccgtgccgggacccctcttaggctttaagaggctttgcagctttcattgctgggttttcaggtcttcctctcctctccagccgccaagctctgaggaagtccagggtagtgcgctggatagtgggccacgccattcaaagcctgccccactccccatctcttggtctcactgcccactgccccacagtgtaccctgtactctgtaattccagactcctggaggctcagccagccagatgtttcatgttcccaatttcgctcccacaccattcccaatgtctgcaatgcgctctcccactcactttttctggcttgcttggtctcagccttcaagactcagtttaagctggacgcggtgattcacacctataatcccaacagtttgggaggccaaggcgggatgattgcttgagtccaggagttcgagcccagtctgggcaacattgtgagaccttgtcactacagaaaattttaaaaattggccaggcatggtgacgcacacctttaatcccagctactcagaaggctgaggtaggaggattgcttgagcctgagaggtggagtttgcagtgagctgagagtgcaccactgtattccagcctgggcaacagagcaaggccctgtctcaataaaacaaacaaacaaacaaacaacaaacaaccacaacaaaacccctcagtttggcctcccaggccctgttgctgtgctcccaaagcaccccgcgcaccttgatcacaataccggccacactgcatcgaaatcccacgttccacgacagtttccccgccaacagcaagctaccagaggacaagactagattttttccctgcttatatgcccagtgcctagcacatggtaaacgctcaataaatggttgttaaattaaaccaaacttgctgaattctattttagccgattctctcatttatcatctgacattgttccaagactgggattcttgctcccaagagagcagccgtgctttgggtcagggattgcatcctgtatgtgtcacaagtcaacagatgcacagagtcaggcctccatctctggccaggtgactctgagccccctccacagcactcacaggtatggaagggtgtccggtcaggcagagagcgggttttccttcggatcggcaatgacttttccatctcttctttcaagatcatctttcccaagttggaagtaacctgaggagggagaaaggaagatggagccaagacttagacacttgaatgtttcttttttttctttcttttttttttttttttttttttttttttttttgagacagggtctcactctgtcacccaggctggagttcagtggcacaaacatggctcactgcaaccttgacctcctgggctcaagcaatccaacctcctcagcctcctgaggagctgggaccacaggcatgcaccaccacacccagctagctaattgttttttttttatatacagatggggtttcaccatgttgcctagccttgtctcaaaatcctgggctcaagtgatcctcctgcctcggcctccctaagtgttgggattacaggtgtgagccactgtgctgggccaatactcatttcttatctctaaaaggtctagagttgggccatgctgcaggcaggactgcggacatttcccaagtggctggtttgtgccctggagctcacagagcctcttgttcgtggctgacacatggccacaatgggtttggccacccttgaaagccaggagtcagcgctgcttggtagaactctaccacggcggcctccctgtccttgtcccaggtcaccctgctcagagcctaggcccatgtcactgtcaatggtctttccatggttctccctcctcccctggaggcctgtagcccatgctctccttttctctcctcccatggatcactcaggctgctagctcccagctctgatgggaccacccttttctgtgcttttgacccttatatcaagtagtgtcccccagaaagcagcataaagtccaggtgtcccttcaaaagcaaaatcctggggtcttggcaagaagcggctccccaacatgttccaaaaagcatgcttttcgggtaggaaccccttcgactagctacagagccagaacttctgtccccagaaagacacacagggtgggctgagcatagtggctcacgcctgtaattcaagcactttgggaggccgaggtgggcggatcgcttgaggtcaggagttcgagaccagcctggccaacatggcaaaaccttatctctattaaaaatacaaaaaaaaaaaaaaaaaaattagctgggcgaggtggtggcgtgcctgtaatcccagctacgcaggaggttgaggcaggagaatcacttgaacccgggagcggaggttgcagtgatctgagatcatgccactgcatgccagcctgggcaacagagtgagactcctgcacaggggtggagggtgggggtggtgagatgctaccttactgagttcctctctctgacgctccctgagagccttcatctcctctccagagtcgtcatcttcctcctcctcctcttcctctgctcccctccgagacgccttccgcttcctccattctgtctctaggagacacaagcaaaggtggggagggagtcactcgccatggggtcagtgtgtgtttacatggcacagcctctgtgcactgctctgggctggaccttgataaggccactacaaaatttttttaaaaaataaagtagggtcggtagatgactcatgcctgtaatctcaacacattgggaggctgaggtgggaggatcgcttgagcccaggaatttgagaacagcctggggtaatatagtctctatagaaaattattttaaaaaattagcccggggtggtagggcatgcctgtagtcccagctgctggggacactgaactaggtggattgcttgagcccagtaattcgaggctacagtgaactgtgatggagtcactgcactccatcctgggcaacagagtgagatcctgtcttaataaacaaataaatatttaaaaataaaaataggccgggcgcggggactcacgcctgtaatcccagcactttgggaggccaaggcaggcggatcacgaggtcaggagatcgagacaatcctggcgaacatggtgaaaccccatctctattaaaaatacaaaaaaattagctgggcgtggtggtgggcgcctgtagtcccagctactcaggaggctgaggcaggagaatagcgtgagcccgggaggcggagcttgcagtgaaccaagattaggcctctgcactccagcctgggtgacagagcgagactctgtctccaaataaataaataaatataaatataaatataaaaattagccaggtgtggtggtgggcacctgtaatcctagctacttgcgaggctgaaacaggaaaatcgcttgaactcaggtggtagaagttgcagtgagccgagatctcgccactgcactccagcctgggcaatagagcaagacttcctgtctcaacatttaaaaagagagtcaggcatggtggctcacgcctgtaatcccagcagtttgggagacaggcgggtggatcactggaggtcaggagtttgagatcagcctggccaacataatgaaaacccatatctactaaaaatacaaaaaattagccaggtgtggtggtgcatgcctgtaatcccagctactcaggaggctgaggcaggagaaatgcttgaactcgggatgtggcggttgtggtgagctaagattgtgccactgcactacagcctggggcaacagagtgagactccatctcaaataaataaataaataaaataaaataaaaatacaataaaataagagtaacattttctcaccttgccatgaagctgggtaggcaacacacacatacacacactcatgactgaaattcagtgggtgcagcaacatgaatggaactggaggccattgtcttaagtcaaacaagacacagaaagacaaagactgcatgttctcactcatgagtgggagcttaatagtgtgtacgcatggatgtagagagtgggatgatggaccatggcaactcagaagggtgtggggggtggtgatgggaaattgcttaatggatacaacgtgcagtattcagataacaatatcataaaaaccctgacttcaccactgtgcaatctatgcaggtaaccaattacacctgtaccccataaatggataaaaataaaaattaaaataaaattcgctggggaccaaaccatctatcatttatctttctctttcccagtgctcccctcacagagcctgggatgcagaagtttgatacatgtctgttgagtcaggaaataaatgaatggaaagcaaatgaatgaccaataaaagggccacttacaccaagcgctatgggaacacagagagtgagtgagcaaggagcctgggggctcctgaaggtaggaaaaagcccacgaggacaccatagggcaggggtgggagtgggttcacggactgcagcaagagccaaggggagggagtgcaggagtttcccagaccacccattccactctccccatctctcctacccacaacagccagagacggggggcatggccagtagtcggtttcgattttggctggctggttggggtctgggggctgggctgcaggaaacttggatgactcgatgatgagatcctcgatgaggtgcttggtctgagggctgcctcccacggactctgcagacaaaggccagggtcagccaggtgtgccctgcccgaggccaacttggctaccttcacccctcccccctcacacctgtgaggtcctgcaggtaaaagcagtgtacacgctgagcacggggcacacgtgctgctgtgacatgctatcctcccgaccccctccagccagcccgcagccccagggcacggcctcccagcatgcagccggaagcaggctctggtgagccagcggcgccctcacctctctgcttatagatgggaggcttcttgtagatgttggaatctgggcgggaggtctctgtgggaggaagaacagatgaggaggaggacatgctgatggcagggaggctggggccaggagaatggagatgatggaacgggacaaggtggggaactcactggcccctgtcaagagccaagacagggctggcattcctggcactgcccctcaggggtttgggacattttacacttttcccgctgggggagagagaaaaagtgacaggtctcccatctctgggaggggtcctggcctcctggggcctacttagctctgaggcgagcatataccccagagagtgggggactgagcgtaaggggattggggttcctgatggagaaagtcttaggaaacaatgaggtcgtgccgagaagacctaccagggtggtggaaatggggcaggctggtccggggggttccagtggttctgggggccgaggcctgagagatgattccaggcgaccggctgtccgcccacacctgcagagcagaagcgtgtggctccagggcccctaaccccctccaacccacacatgcaccccatcagctcacaccaccctctctgtcctcccatcctggccggctgcatccctccaaacccagggcaatgttgtggcacagttccaaggacctactgatggtgcctggcccagggagaaagggttgaggtcctgggtccgacagaatgatggacacagagctggccagtgacagccagggggccgctgattcgggcactccctgggctctgcagagcttggtctgatgtgtgaggggagggagttaggatccccttcagggcagggcagggcaagttgcaggtgtggggcagactcacctctggggatggtgggggggatgtggatttgggtgacagcgagcgctgtgaatggagagggggctggtcagagctacaggggcagattcagcctcttccctagaattccagagaggccacctcatcccccacccaaagccgcacactttcctggccagcttctgggccacctctgctttcttggatccttcccacagttccctgcacaaagtcctcagccttcccacaggaggcacagagaagcacgcgagccttgctcagtactcctggggctccaagggcactcttttcttccttccttccttccttcctctctcctccccttttctcctctctctcgctctcatctttcttttaattttttcctacttcctttgtcctttttctttctttccctgccttcctcccttccttccctctttccttcctctctctctccactttcttctctcttgtctcttattctttctcctctatccctctctcatctttctttcttatagtctcactctgttgcccagcctaaatgcagtagctctatcacagctcactgcagcctccccttcccagcctcaagggattctcccacctcagcctcctgagcagctgaaactacaggtgcacagcaccataccttgctaatttttgtagagatgggggtctccctgtgttgcctggactggtctcaaactcctggcctcaagtgaccctcccaccttggcctccaaaagtgctgggattataggtgtgagccaccgtgcctagcctgggaaccagttggggaatagttggtcctgtcctcagagcctcaaaacaaatagaagagacaagaccaagaagcatccaaggatgaggtcggggtttatcacgcaggtactgaagtcaccccatgatctagccccctgtcactggtcagccacgacgctaccctgtcttggaggcagttgatgagtacctgccttgcactgtctcctgcaccttcactaccttgcgcgtggatgggcagaaaggtcacctctattttacacgagggtaagctgaggccacaacatcacatgggtccctccgctagactttcagcccccgctctcaatgcttctgaactgtttccacaaatcttgctctttgtgcctcttgtgtgttgctgccatccaaaggtgtccacccctctacatctgagccacatgccagcccagagaccgttctgcctgctctcttgaacaccggacggactgactggttggttcctgcgcacagttccctctcttgttttgccgaggcagacctccaggaaaggaagcacggggagggatcggtccccacccagtgtggctggggggggggcctcccccggagtcctgcccaagaggagccccctcacctcgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12803 - DNA, 31861 bp, Human
gcgggaccccgcggtgctggcggcggccgagcgcgcccaagctcgaggtccgagaggaccgcgaggacggccgccccgggccagccgggcgtggaaaaaaggaaattgctgggaagggggcaagctgtcccgaggtctggatgtggcttcgtggcggagagaaaaggaagaggcaaaccctgagcccgggagggagagcactgagcaggcctcgtccccagtccgagctgcgggaccggcgtcagtggacgcgggcggtgaaccagctcctcacagggcagggctgagcgcgtaggactgagagcgcagggcgcgagccgcagggctccgctgcacggctccgggtgtgacaagagcccagcagaggaccccatggccatgcgggccaagcgcgagacggcccctccttgcgaccccgcaggccgccacatctgggaccagcggatcgcttggtcgctggagccgatcccgccggggccctagatatagttggacccagcgcgctggccggagcgggcagctaccctactggcgcagcggccctgtgtggggactcctaggtttccgaggctcggcccgcgttcgcacgtggcccgaggcgggtgctggcgctggccatgtccagcgagtctcactccctgcaggctgtggccgaagactggtccgcctgtcaaccttatctttatgggtttttcccaacccagactggccccggcccctttttatctcctgggttgcacttggcttgtttactttgcgaggtcctgggagtcgaagtctaagcccgggatgaggaggcctctgaacaagatgggcgagaggcctgagcccggggatgctccgggagggcccggggagagcgggaagaaggtaggaagagaaaggcggggcattccgcctcaagaagggccgtcagacctacagaaagctccgctggagcgcccaggtccagcaggatggggaagagcagggaggtggaaaggggaagcggagcaagcggggcacacccttaagggatgcgggcaggctggcctctcaggctgtgctctcatcccgaggccccaggacctgcttcgggcagggagcaggcacctgagtaggcgagggaatcagccaagacagccgaagaaatgtagctgtgccaggcagggctaagcggttcctgtgaatgggcccagcctgctggcctggtccttcactgggaagggtgtgggtctttaggcccaaagcagagccctgtggcgctaaagtgtgcctgagtgagcctgtaggttcgaactcgagcaccaggtaggggaggcctgggctgagggcagagcctggatcagtcacccaggagagtgtggctgctcaggctggtgggatgctgtgtgaggggctgtgtttgggtgtgaggatgtctgtgccagaacgggaagaggatgtgtgtggacggggagtgtgttggagtgaaagcctttggttcaggaagtctctacctcagtgctgtctgaggggttgggtgagggcagatgggtgagctgggcctgaggtcctgaggccctctctgcacacaggtgtggagctgcaggagcctgggccctgccctccagcctggctctcctttcctgcatggccaggaggtgtcctggctgtcctgggcccacagagaggcctggaccccagttattggggaacagccgagaaggcccaggcctcaggctccaccggagctcagtaggagtgagggactcggggtgcagctgtggcaatgccgagagggcggtccctcccctagacctactcatcacagaaccccacacccaggggcaggcagacattgaactgccgcagaccctcccaggtccacagcctgaagggaggaggcgagggacctgccttccttgcgggttccctcctccagctcaggagggggcggggtccacgtgctccagggctgcctccgcgccccgcacgaagtcccggaatcggctggagagggccaggggtcctctggcgagtgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggctgcgccagccgtcgggtagaagtcgggcgtcggtctgtctgcggggccgcctgtgtccgtctttccgtccgattgtcggcaggactcgctttcaggaggacctggctgcattcaggacggtctgcccgttcgttctccactggacatggctcgctttctctgccttttgggtccttctccactttgagccctcggggctactctgggacaagcaagagctagagctagagatagaggagagggcggtaagagagagggagacccccgtagcatctgagcgagcctggaccaagtgtccagctccaacaacccgtagagggcctgggacccaacggcgagggggcaggaggaggccaccccgccggtgcgcacgggagccgctgcggggatccgaggcctctgggacgtcgccgagggcttcacagtgataatcggacgatcacagcgcacgggatgccgcctggggatctgtgtgcactatctgcaggcgcgcgcctggccgagggtgcgtgcgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagccatgggctccgggcgggcagggttccgcacagctcttcgggtctggttcttctttcctcaggctccgcgtggagccctgggcctggcagacacaagtttctctccctcccatccccagaccatcgagaacatcaaggtggggctgcatgagaaggagctctggaagaagttccacgaggcgggcaccgagatgatcatcactaaggctggcaggtcagcgctgggagatttacttccggggatggcggtggggagcaaggggggccagggaggtcccttagaagtcctctcggccccggcctggtggcctgtgggaggcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtcccagctccagcacttttggccccctggggggctgctttgccctcctctctttgaggacctgaggaggtttctcaggaatgcattgattggagacccagagatgcctctcagcagatggggagagggaaatagactatgctgttcagttttcatacattttcgtgagtgactcgaaccccaagtttttcatcccaggggcgccgctcttctgtttccatccccatctctggccaacgggaaagcactacgttgggctccgtgtgtgttgttgggggagcggctctcggtggctgccagaaaaggatgatttataaagtggaaacatctttaaaatgcgctggtgtctgtgggagagaacagggaggagaggatgagaggaggaagactcacggcgggggtgggggtgagtgagagattcgctggggctggtggggtgggggcaggagtgtggaggagaacggttatcaggtgaaggtggattgctgtagacagagacgctggcaagttcaggttcaggaactccctccccacccactctatcccctgcacatacacacacttgatttctgtccctgaggacagattaggtgtgaaaatgtccctttgcctggatgtgtctcataattgggattttgaaggaataagatgatgaaggctcaagtgccaggaatttggagtcagaccacggtgggtgagggctgcagttccaactcagctactttcatctgtgcaacctcagacaaggtgcttaatggtctctgctccctccccactccatctgtaaaagaacaggtcttgcctcatacattgtatgtaaagcaccaagttcctgtcacatgcaagcacacaagaagtgctagcgaataatattagcaataattagagaagtgtctggcgtcccactcagtattttcttctactttttagagaactcagctctgctgaaccacttagcgaatgatagactattcaaaggaaacaaaaagccggctggtttgctgtgtgcagcgtatggggtgctgtggtccttcctctctgctccctggcaggccttataaagtttcctttcttttgttgagggtggaggtctgggcacttggccaccctcaggccttagccagggaggtggcatcaccactcagggcctctatcaggagagaaagtaggtttagtttagggcttgagcttgctgtattttggggatggagatagggaaggaagacacatgaaggggctggcagagggtgcgacatggagcaggcattgaggacagtggaagccaggtgtcacaggccctgcctctttctggctgagtgtacttgggcaagtcacagtctccttgtagctcagtggtgtcagggaaatggtgaccgtagacctatctgctgtcccttccttttctatcactgtgaaactcaaaccagggaatcacgtggatgatggttggtaaatggataatccacttgatcaagtgcgaaggggaatggggctatttcttgtgcctgctagtgtggaaagaaggtaagaaagagaaaggttcagaactgccatttttaggcagcagaaataaccttgtctcttgaaaataactggccagcatgttctctgggcatgtctggcctttggcattttaaacaaagggcatttttgtttgtttgttttcctcagtagtgtttcctgcatctgcatgggtcctcctcctccctctcccaacacatacacttatacacatacttccataggtggccagcttcaggcagatgtttgtgcttgatcctagttgaggcttagagatggaccttagggaattatgataatatttctaaaatggctgtgatgatgttggccaattatggatccatcacagcctttcacttctctggcagaaagttatccttgcactgggtctggttcttaagaaaatcactagtctcatgcccccaacccctcacccctcacagaccccatttcctccttcatagctgcccccctccttcagcaaccactgtattgctctgatctacgttactcaggctgtggttcttcaacatcctgtccagtgcctctccctgctccccaaattctgtgtgcctctactggaacccttcttggtacacgtccatttgtcagcctgggccctgctgctaaacctggaatcatagcttcctagatggctagagctggaggagaaccaagagaacgtaaaccaaaccccagagaagggaagttaggcagttaccaggtccacacaggaaaacagatgagacaccccacccccagaacacagcccctactttgataagttcccttgattgcttttttacggggtcctattcagtgtggattgtggctctgccctagagaccctggctgattagggacacgataactgccatctggctgggtaggagcaggccctggaaaaggggagccagaatgttctcaagccaggttgagttctcagatcacaagtttccttcctaccttagccctttgggtccttgagagtcttgaaggttgacagagagaagaatccctttcactggatagtgactttgaactgccaaacaatttggcctggtggataaaatgccaaccacagtgggagccaccagtttctgaatactcagcgacctccatgtcaggtgtgaaatgggggccacagccctccgcagcccgtctcagtctcttgggtctctgtgtccagagggttcgtgctgatagccgcagacagcagatccctctcttggcctccccacatccctgccaagcttgatacatgtgagaaactgcattttctcccaaacatagataaaagtgagctccacaaaaaaatttaaatataaacctccccaaaatgaaaattgcctaactgtctcactgccctactcctaggtcagggttttgccaccagataaatctccactatcagccttcatagcctgttgagttcaatgttgcttgtgttagtgacagtgaatttgcgtttgaaaaatgaactaccgatgagaactcctgttgaacctgtattgtttgttattctgaggcaaggatttggcccggcttaatccggggcttcaaagccaattgccctcactctgtatacagagcgtcagagcccagtggcgtggatgataagagaagtaagggttgaagacactgggaaagtgggttggggagagagtgctttgatctctttttaaagtattttctgaaagcaaaagtctatcagaaggaagtgcctttaaaaaaaatctaagagaagcaaccgatcttccaaaacaacatccattccacacactctcacccctgcccctccctcagggaaaagatttcttaaatatgctttgggtgaattagaaaactgtgtgtgtatgcctctatgtatgtgtgtgaaatgtggaaatcgatttattatcttcaaaatcagaactcacttggctacagaaggcttggtctcagtgtaggtggcaccagcagccccactcctaaccccagccttggatgctgggccctggcctcttccccgcacacccaggattcctcctgaaaagcccccacggacatcagggttggagaaacaaagggttttaaggggacccctgccatttcactgctgtagggttcttttcagactctgagctccaaggcgcctgtgtatgtgtacacacatatataatttttaacctaaatgtattgaagtggaacattcctacagaagagtccacaggtcttaagggtgcagctttacagacttgcacaaaataaacacactcgtgtaaccttcatccagataaagaaatagatcatcaccaccaccgccccagaatccttcttgtgtgcctgcccagtcagagccatccccacctttgaaaccgctctctagacttctgaccccttctggctggtgttcccctacattaagggagggtccgtgtagctgttcctggagtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcccctggcggagccgtttccgcgtgtgccgtggggagggcgggggagcccccatctgtctgggggcgcgggagcccgacggcgcgaggggaactgggggagcatggagagggcgcttggggcgcggagagaaggtgcggggcacgtggaaagcgtgccgaggggctgggaagagggagggacaggaggacggggtgggagcagggagagggtagggggcatagggagagggtgcagggaggggagagggggagcgcgcaaggagggggctggctggggcggacccagaggtagagcgcagagtgcccgggacaggcgggcttcaccgccagcgctggtggcagggcctgcgtggacacaggcggcacacacagtgtcttccttcttggtcacctcccccaccccaacacacaaacagggaggcgttgctttccaccgtagggtgttggttttcaggtacattctatgtcataaatcacagaaacaatttacatctcactccatcatttcaaacctttcatgagagaggcagagctcacaggaagtcacagctcccaaacccagcctggcctctgtcgcctgaggcatgccacgctggggaacacccccaagtcaggcgtctaggcaccaactttagtcccttcaagaacccaagggcagatgcccaaggggccttgaattctcccctcgacctgggcaggaagccaatggaggggacagagggggcctcactttcacaggcagccctttcccaacgctgggtggacccttcctccttctggagccacctaggcagggaaacggtagtgcttagggccccccaccccaccccagagtgggttctgcatggctcagaagcagtcccccaactagaccctgccaagacctagacatctgttgcattgaaggcaatggaactccctgaggcagttcaggccacagcagagggcttttgaactccccattcagaccagacatcctacgtccctgtccctcggcttctgagcgctgctgccttaggtagaggggaattggtgggcaggggaggcgaggctgggaggtactccccttccctgtgccgacgcccacatctccttatcagtcaggaatctggcctacgatcagcttccagcaggggccaggtcccaagacaccagctggggctgcagagaacaggctcctcaaaggccttccagaaagcacttagttagtgtcagcctggccccctgggctgtggaaatgaagcccagcagggagaaggagaggggaaggccagggccccttagcctcctctcagcctaggctatgacgcgtgccaaagtggcagtgagcccttcgctcctggccccctatgtggacactggccctggagggaagccatggctgccctctgctgttgccacctggaatgatgacaggaaacaagctgagtgcaggcccccggtgccaggccagcccaagtatggccagggctgccccattttgtggctgtttctgtggcagttacaaaatggtggcctgcagggggcgggattcttggccttaccccagggaagggggaggtgaggcagctgctgccctccctgcttcagctgttggcccaccaggagagaggcagggccgggaaagggtggtgcaagatccagctgcgcccccaggccccataggggggctggtaagcaggaggcagggttgggttcctgagcccctcacttcccccattcctggagagggggtggggtgggtatttgaaaatgctttcaattgacatctgagacaaattcttccacaaggtttataagtccctagacttgcagctagaacttccctcctccctccaggcacgcacacatccacacatgcgcacttgcacaccgctcacatgcgcctgggcacacacaccccacatccccacgtccccgccctgcagtgcttgcacaggcctctcctccagcaagagaggggcacaggcggggctgggtggggcgtgggctggcaaggaagtgaaccctccacctcggtcggggtcctcgcctgggcttagggcccgccagcttatagaggccttgatcctttctggaagccctgttctgtccaggtaagctggtgcccctggtgacaaaataggggcctctgatcagctgtttgtggcatcttggacagcttctccagggtcccgtactgtcttgggttagtgagaggcagagaaccacctgatggttgtcccagagtggaccagccgggcagtggcacagctcagtggggcttagtgtcttcactgtgtcttcagctaggtttggatcctgtttctcttggggaacacctttgtggaagatcagctggggtgggggatggagtctgaggaggatcgtgggaagttccgttcttccctctggtgaagtcagggacctagtgactaggggagggagctgtgcccagagcgtttgtgtatgcgctgtgctgttgtgtgtgcgtatgtgctgaggggtgtgcggaagccccctctagaatgtgcctcgaacctcagggcccttgacagcctcagcatgggctgcaggaaatgacaaactttctgggttttggtgaatccattttcacagaagtaggtcataccacttctccatttactttgctgagggaggagtgcagcaggggtccgtggtaattcacgcagcaatctatgagataggtggtaatgttatcctcattttagagataaggaaaccaaggcacagagaggttcaagcaagttgcctaaggcttatcagtggggtccaggctgtgaccatggcaggtggtttcagaatccatgccctctcttatccatgaggctcctggaccgactttcccctgatactcagggtgcacaggtccaggtgaggtgttcacagggagaagtacccccgatagacacactggaagaacccaaacctagcagggttttggacagcagtctcctgttttcctgcaagctggttttaggcctaaggatttccacagaggcatgacccagaggaggcagctcattatttatggaagcagctgacgggggtttccgtccccctataactgcaccccagaacttcacttgtgtgtgggctggcaaaggacaggagggaaattaaggcagcaaggttggcgtcagaatctgctcccacaatcctgactggggtctctgtgcttcagctgctcatgggcactagccccaagtcttaggggattatgggggaggggataagtgaatttgggaaatggtgtaaactctcctcctagacacagactgatagctgcaggggctcagagacagcagccagtgccaccttttcactgtgcagctcgggcagagggggaagtgagttgtgcaggtcacacagctgtgaccaatgccaggatcgctggccaaaagggcagcatctgttagcggccttctgcccccttgctcactctgttccatctctcctggtgctctgtccacacgctccgcctcacccctcggctcccccaggaggatgttccccagctacaaggtaaaagtcacaggcatgaaccccaagaccaagtatatcctgctgattgacattgtccctgccgatgaccatcgctacaagttctgtgacaacaaatggtaagtggaccctgaccgcatcacccacgttccctcaactgcccacttgccacgcccccacctagtgttttgtccgggggatttcttagctacctgagtgactgcccaggtctgcaggctggagtccactgcctggaactggctgtgcggaggctgaggtggtcagcgaatgtctgcatgcctgcttcaggtggggctgggtttgggctgaaaagcagctgcgtgtttgggagtttggtggatcgcaagggtctgtactctccttatggccgtgggtagtcaggacttggtgactatgctgtcaggtgacagacaaatcattaacactggccagatttagactgtcagtgcttcactgtggggaagatgggagcagttctcttggggactttaagggcaagccattacctgctgtgtgggggcactcgcctgtttctccatgttctccttggcttcaggcccctccagccatccagacgaagtgaggctccaccagggggttggtggatgggaccctttggcaaggggctgggagacatagagaggtaaagggacaaaaccaaaaggggccaggtaaataaacgctgggctacctttcatgaagccaactccttagtccctgactgcctgggagctcggaacagcgctccaggagcgagcagccagccaggacactgggctccgtggcaagtgagccacagagctggagagattgggccgagcaggcaggatttggtggccacgtcctggcaagggccatgtttctgtttcttctccctctctgggctagaactcagagcaggctctggctgcggggagagctaccaattaatttcttaccattgttttggggacaagccttttgagagttgtctaggtcctctgagaagctccctctaaataatataatttataacatgtgacaatcataatcataccaggtgtagcggctcatatctgtaatcccagctactctggaggcagaggcaggaggatgacttgaaggtcaggagtttgagaccagcctgggtaatatagtaagatccttgtctctgtaaaaaatgtaaaaagttaactgggcatggaggtgcatgcctgtagtcacagctacttgggaggctgaggcagaaggattgcttgagcccaggaattggaggctgcagggagctatgatcataccactagcatgggtgacagagtgagaacctgtctcttaaaaagaaaaaaaaattttaaatcataagtgtaaatatacatagaagtgcctaaatctcctcacaatatctttgtgattagccccagtccttcaattaaatgatcccatttccctgtaacctcccttttcttttctactgcagtaaaataaaggagattcagaactgctctctcctcctcagcattctctcctctgaacctcacactcctacccttgaagtactaatttgacaatgtggtgggaccagcagctattttttcctctggtcaatgggggtttgctccaagaggggacggggaatctggcctcaccagcccctggagtaatcacctgctcttatctgctctgttggcaggatggtggcagggaaggctgagccagccatgccaggaaggctgtatgtccacccggattctcctgccacaggagcccactggatgcggcagctggtctccttccagaagctgaagctgacaaacaaccacctggacccctttggccatgtaagcatgggggctgcctggccccaggaggcaagtctggggcagttttaggggtgggacaggccaggatggggatagggagaatccactccgggatccagctccaggctttggcgctcactgaccagtttagggaaggagctcaagcctctgaggcctgcagagagctggacttccttcccggccacttactggctgggtaactctggacaatcgtctcagcctttttgagcctcactttccttgtctagaaaatggagatgaccacatgtacctttcatggttgtgagacttaaatgagagggtttaccggaagcactttgcacgtaggaggggctaaataaatggcagctatgatgataaaggtgacgggtcagatctcagcttcagttccccaaaatcttgccttgctggaacataacacaagaggggtaagccttttcgagcgagagtcacggatatgttccaaagcccctctttggtgtgtaccgtctgcctggcctgacagccgcctgcttctgggagaaaagaccttgctctggctcacatgttagctcctgctggatttggcctggtccttacagaagagattctgaagccccagggatgctgctgacgccccatccaggcagcccaagctcattctttccccatctggccctggaaagtccacaaaaaagagatttttatgtggaaatttttagctcaagtgtgtggcaaacagaagtctggggacctggtactatctgccagggcacaggcccctcccctcgagactgcccgtggtttctggggaagtgcagggcaggggcagtggaggctttgagatgcaggtgtggctgttggggttacgagatgtgcaggtatgtcccgcttttacgtcccagctctgaagcatagttcctatggaaaactccagccatgcttcttttctgattgatgggtatgtaactggcattgagcttctagttttaatttctcagaatctattcagttcgcttctgagtcattggtgagctataaacaagcagctaggagaatgtttaattaatgcagtcaactcctgacttatcttatctggtttgtgagtccctttgctgggtttcccatacagggcaggcagattcccaatggggaggatcagccaagttcccacctccccgagccccaaggcatttcagctgagaggcagaggggcttcctgggtctccctgggcaccatcctggtcaagactttgttcccagtcaactcctacccaacttcctatgcttggccaggctgtggcaccagcctcaaagggtagggagggtctctgtgtggggaggctagggaacctggcccacgacggcacacacacacagaccccatggggggcgaatacagagcttgtggggagctgcatctttgggtggccatttgtccctagagatccaaacctggagaggattttggatgagccagcttgttgtcagggctgccagctgcagggatgtctcagaggacacctctgcttccctgacctctagaaagtgagagcagagggagttaagggctggaaagctgcgccttctttaggaagtgggagagagcgctctggccttcacagcccagcagtagcttttcacagcctggctaacctcttcagtagctctccctgggtctgtgagtggtttgtgataaactgcatagaagtcagggccagtgaggctgcttgatgggcttgtgatgctgggggtgcccctggctgcatctgccgtgcctgcctggcgcttcccttgccttgatgatagggatactacccacaggaactcagctttttccctggatgagtgggacgcagagcatcttccttctcccttcatccccacacttacccagtacttgcagtttattggctacaacagccctgtgggtgtggcagggcccaggtaccgtctcagacccaggccttctgcttccaggtccagtgtctctgggcttctccactgcctttctgtacccagggctctcgctgcggtatcttcacctatttagagaacccttgaagagggagcagcctctggccattcagacaagggctgtggagagacatatcagggcacagcaacccatttggacattgattttcttctgcctcttggcccgtgcccgtgggagtggtgagctcccattgaaggatgaaggagtcacccttcttggcttctcagtgcaagaggctggggaaaagccacgttgtattgggaattgcccttccttctgcacaaccacttctacgttttcagcttgccctgaaagcttccaggcctcaagggactttctccagccacatgggcttggacttttcttggggatcctcacggtatcccaggagcttgagcagctgcctcctattggcagccctcacccccaactcctgcccaaaagggtgggctctctcctcgcgaaagggcaagttgagagctcatgagagtggctgtggtatcatcttggggtccaacaggtggactcagtgtccttctagcctggagatccctgggcccaagccatcccatttcctcatcccaggagatgagcagggtggctcatgtgtctgcttgctggtgccttaaggcttcaaagagcaggaagccctgactgtcggggagggggtgtggaacaactattttgggataatccgggttttcctatcattcaagattcctttcttccatgaatgctgctcttctctgaagtctgaggaccttagattgaagtcttgggcctggtagcctgtcctgtatggcacatggggccctggaacaggaacctctcagaccacatggccagaacctcctaaaaggactgagctcccactagaacaacactccttgtgggtttttgctgtgggattaggaaagccttcacagcagaaatccacaaggaattttccagtctgaaccttggaaggcaggttcaggagggcagattcagacctgggcgtcagctccagtcccgaggttgggccaggcgggagcagaaaggaccaaggggctggggctggatgagctgcctccaggtggcctgaattcagctttgcttctgctgttctgctggccacagaagctgcctgcccactgtccctcctgcctgccactacctcccacgcccagcagggtcctgtgcccggcgactatgagatgggaaaggaaactgcttccctcggctttcttcctcttctcctcttctgaataagcttctagcaatacctgggcttcaggaagtcagggagggcctcactggggcataggcgggacctgtatcctgtagcacgatgaggaaatggtggcatgcaggtatcccagattgctgaggagggagggccagtttatgatttctgacgcagtgagtccaactgttggaggggctgcattagcccctgggctagaggtgtgggctgcagttcctcagtcacaaagtagcacgcattagtccccttaatatgcgacttccttctagccactgggcttcataactggcataggcctgactgccacacccttaggcctgggactattttcccaccttcttcacctaggtagctactcctgagctgcgagatccaagctcaaatgcaccttcttcagagagaaaggttggggtcctcattccatgctgtcagagcactatgcaccttttcatgctagtacttgccaaggttataattttatacctatttgcatcttaacattttatttatgaataggaaatactttcacaagctttaaacataaatcattgaacaaattaaaatgtctacaatacgacatctctctctacttgttcctgatccactgtttctttcaacccccagtacaggcaaccatggctaccaatttcttttcagcattttttttttttttttgcacataggcagaatgtgtaatctggaatcccctcttttacacacaaaaggtagcatactatagaaacattttttgcatttgctctgtaaacttaataatatctcttggagaatagtctattcagagagggcttcctcatcccttttgcagctgcacagaattattattattttaatttctttgagatagagtttcgctcttgttgcccaggctggagtgcaatggtgtgatcttggctgactgcagcctccacctcccgggttcaatcaattctcctgcctcagcctcctgaatagctgggattacaggtgcctgccactatgcccagctaatttttttttttttttttttttttttttttttagtagagacagggtttcaccatgttgatcagactagtctcaaactctgacctcaggtgatccacctgcctcggcctcccaaagtgctgggattgcaggcgtgtgccaccgcgcccggcctgcagctgcatagaattttatcaaaatgattgtttcagaaatcatgtagccagttcttgttgaaggaattagatgtttttttattctttgctcttctgattaagcttgtacatatgccattttatgctgtgccaagtatatctgtgagataaatggcctgttcaaagggtacgtggatttgtaactttgaaaatatcaccaaattcccctccatgggagctgtactgatgtatatatttccaccactgctgtggccttaccaataagggcgggagagcaaacttgtggatttttgtcagtttgacaggtgaaatgtggatatcagtgttagctttaatttgcatttcctttattatgagtaaggttaagcatcttcttttaataaatttcctctcctgcgaactgctgttctcatcctttgctcatttttcttgtaggtttttgatatcaatttctaggaactcttataaattaggaggatgtagctcttatctgtgatgagttacacatgtccaggttatcatttgtcatttggttttgcctgtagtgatattcccacaccgatgcttttgattgaattgaccagtcttttccttatagattttggattttgagttattgaaagccctaacccccctccttacttataagggacttttcttttagtattttatggatttatttttacatttaaaccattgatccttttgaaatttatcctggcattgatttgaggtgtgaatccaattttttttttttttctacagagctatccagttgtcccagcatcactaattgagttgtcccctttcctcccctggttgaggtgccttatttctgaacactaaatccctatatgaatgtgtgcctgttcacacgccagtcttttaactgttgagactggataataggttttagtgtttggcaggactgggcctccttgatcttcttcagagttttcttggctagtcttgtctattttttcacataaattttagaataagcttgtagtgttaaaaaaggagcttatttgtatttttattggattttccttaaattataaatttacttagagaagactgataggaaggcttttctatttgctgagggttttctggttcttcaaaacgtattcaggtttccttgaaatggccctgcacgtttcttgttaggtgtgtcacctgatttgttaccatgataaatgcagcctttctttcactacattttctcaccacttatttctgctcattttcggagttactatgtgactgccccaccagatagtaaaccatgaggtttccaatcactgtgacatcctagtgcctagccaccgtgtctggcaagccagcgggtgctggtggatggtaagtgcatgagaaactcctgaagggggtggtaatcagacagcaaagccacttcccctgccaggggcagatgtccccccaaagcttatgctgctaatctgccagtggggacccagagctatttatctccctctttcctcctttcctcccacatttgctgatccctgacaatgtggcaagccctgaactccagatcaggtcccaccctccccagccaggttaaggtatgaactcaggcttggaaactagtaccaattctggctgtgcctgaaatcggctgtctgatgctgggcaaatgcctgcacctccctgaccctcagtcccttgcctgttaaaataagggcaataataattaatgcctactttatacggatactgtaaagattaattttatggtgaatgtaaatggcttagcacagggcctggcacataagctatgctcagtaagtgccagctgttactgctgttgctgtggcagaaggcaggaaggtttggaggccccacggtaccaccccagtgttgctcgcatgggagtgatgcctaaggttccctgggcaaggcctcttgagtgggctgatgggctccctgacttagatctagtttgaattttccttggatgcacctcttatcatccggggtctcagttttctttctttccttctttggtgtttaagctgagatcctgtcactgtcctaacctctttgtagggctggggaggatcagaaggatgatggagaaggtagtcacagaaaataaaattatgatgcagggtaaatctggttttagtatctgacaaaatggacattagccacacttttgaggggctagcatccagataacatgtgttctgtgttctgtagggcctgctgacccaagtcccttacagtgtttaattggcaccttctcattaactctgagcttgttgagagcagtgtgtgctctctcacaggccatctggatcctgctccagactgtgtctccaaccagctgtgtgttcctgggcgagtcacgtctccactaccagcattctgttcctcatctgtaaaattagagagctggacacgaatgatctcaatggcctgcctctccatgccctaatgttctgtgattccaatgtagatagatctgggctttattggccaagcacgctatggcgatctcttgaggagagggatgtttggcgcaattgcagttgttaaaatagaacaggcttctgaattgtggccagaacataatgaatcccatttctgtgaaacgatgatgacggaaccagtcatgtagtggggttgttgacgtggctggcccatttggccccatatcctctgcagcaaatataaatgtgaaactctggcaaagtagtttaatgtggcgcctgaggaacttccgagcaaagccaggtgtgtgagtcactgagttggtttcacattctcccggctgatgggactaaggctcaagtttatacttgtcttggctcaatgggtgggactttcttccagatacctgtccaggttctagactgtcggagtcagaaggggtgtttgggaccacttagtcaaaggccccacttcatagatggggaccccaatggttggagaaggagaagagcttgctcaggacttgacgctggtgaacagagatcatgacggcgtctgcacccttcttgacttctctatgaccggggttaccctcacctagtggctcccacctgcccctgtaggactggcagcttccctctttgcaggtttccctgtgagcctggctggttccctgcctcggaagatgtgttgggcactctctccaccctagtcatcagggactttgtctgacgggctaaggagtttggcctttattccaagggtcaagagggaacaatcaaaggtggattgtgtacataaggcatttactgagccccatatactggcagcagtggtaggaggggatgtgggggaaagaggaggaaatacaaaaggccctgctcttaagcaatgcacatcttcctgaatttcccagaaggttctgagcaggggagtgaactgatgggatgtgtttcaggaggaaatggagagaaagtagatggaggtagggggaggctgtcctagcagcccagccaaagatggtggggcctgaagcaggggtgtgcaaaaggaatggaggggcttttgttttatagatagagtcacaggaatcggtcactgagtggacctggaggtggatgacagtgaggaggaggggagttgatgatgatacccagggctttgacgagcccacgactgcttgtgactgcccaggtgtcacaggagcagggtggctgctgccatgtgtcctagtgtcctgcacagccttcatgaggtgctggtgcctatggctctgtcctgggttctctcagcccacggtctttgttctccctttgcgctgccacctttggagagctagagtgactgggggaggccttcatgccaaggagctggcacatcggggaactcatgggagatcatctctgcacatgtttcatcaccacttttgacctaggaaatgccttagagatgatctcgtctttagtgagcaagcaaagaccagagaggaggggacttgcccacgttcccacggagggtttgtggtcgtggcccagatcttcccactctcaaacccgaccttgcactcactagatcctgtctgggggcaaaggagcctggaggtacaaaaggataaaaggtatagccctttctcctgaggagtttagagtttaattgaagggacaagaagaaataggaagccactaggatgcagaatgacaaccaggtagataacacatgagaagtaagtttcagaactgggcgttcagagcaggcccttgtacctgagacttcctggaagatctgggtcttcctagaagagatgttaggcccagaaggtgagaaaagaatgggaaaggaagatcgagacagcagagggacctgcatgtgcaaaggtgcacaggtaggaactgggcattcctggagctatcgggccacctcccaggtattccattgctggatcttccgggaacgtgggtcctttgtggatgcctgcagctctgtgaatagtgcacggtgatggagtcacctaaaggggctgggaggtgttttccaggcccagttcctctcgccacaggagcatccccagcgtcctggaaagggacagacatcgaggcctctctgagcgggacctgtgtcctgtagcctcactctgcattcctcacctggcaggcccccagtcgggcagcaggtccccagctgcaggacctggtttggggtttgggagttatgtacttgcctcgtgaaggtctggaggtttgtcactgagggctgaggcgggagtggccagtgcagaaggcagaaagtgtggttcctgctggatggagtcacccagctcaaccgaggagcccagggaaggccagtacccacagcccaggtcctggcccacccattcctcagctgagctggctctctaggctatccctgtgccccagggcacgataagagcagagtcttcccagactaagactttggccaaggtttgccataaaagagcctgactctggcctttctcttggcactctggtcactaacaggttaaacctttcattcagcgtcagtaccaggtcccatccctgggaacctagaagggtggcagcccaacgaccaacccaaggaaagggcactgccagctacggagaggggagctcagaggggaaggggacccgagggcccgcctggcctggccaggacagaaaccgaagggttaacagaagccgcagggctgataaaatgccccaaattcctggtcctgccttcaatggggagggcgtctggcaaatgtcaacgataaaaaatacattttaatggcacatgatgcagctgctaccgtggggcgcagccaaatgaagcaggtttggagcagcaactactgtgagcggcccccgggggctctggcagccgcgcctccagggcgctttgctaagctttgtccagccgcggcaacccgcctcccccagcccacggcatcctcaagggcccttgggatcgggggcctcttgccttctatggcactattttggaaactgtgccgtctcctaccttggcaccttgaacgcttgaagagcttctctgagggctgggagcggccttaggcaggtctgaaggcaggatacatttgggtctccccagcacaccgtcagcaggcctctgtgaacgttgagaaatgcataaacaaggctaggtgcggaggctcacgcctgtaatcccagcactttgggaggccaaggtgggcggatcactggaggtcaggagttcgagaccagcctgaccaacatggtgaaaccctgtctcttctaaaaatataaaaattagctgggaatgatggagcacacctgtaatttcagctacttgggaggctgaggtacgagaatcgcttgaacccaggaagtagaggttgcagtgagccaagattgcggcactgcagtccagcctgggcaacaagagtgagattccatctcaaaaaaaaaaaaaaaaaaagaaaaagaaaaagaaagaaagaaaggaaagaaaagaaatgcatgaacaaatgagcaatgtgacaaaaaaagttacagtgggacattttcctcagctttttccctctctctcatcctgcaaaacccaagtatttctagaagaggcaggtcatgtgtaagaagggtattgagaagaggtgaggctggagggggacccctgagggagggaggttacatgttatgatcccatttacaaatgtggaaactgaggcacagagaagcccagtgacttgtctgagatcaaacagtgactcggtggcaccctggacttttgctgacagctcacaattccacctgctacactgtgctgagttcacagtgggctttgacagtgttaagggctgactcaagttctccattaccacagtgaatcaactggtcacatcaaggagggcctggagctgggcattagtgctggtgcagagaggctaagtagggctggggtggggagagtttggggcccaggggcctggttcttcacttgggagctccagtcctggtcggtaggccccggatcctgggctttgaggagaatgagaaaaaccaggccagggccagaagaatgaggtcaagggcctggggcttgcggatggggacctggagctcagcatgagacccttctcttccagatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaaggtacagccactgccccactgccccacagccccacttaacaccaccctgcgttctcttccaccaggcagagaggcagagtgtgaagccagagtcccagcagggcttgggcaggcccagtgcagggacctcagaagcctagagtccctcggagccgcgagcaaatcgaatgatgaacagaaaaggaccctagatatgtccatctccagcacagaggaattacggtctctgtgttttggggaatggagaaaattggcaactgtaaaaaccaggagcttggagtctgccttgtggtttgagcattgggccctttcattccacaatgttctttctcctggttcatctcctggtgccttcagagacaggggtagggaatggggataggagccctggggtgctgtcagctggggtgtggaagcagagcctgagcggaggcccttcccaggctgtgataggaggtgccccagccacctcccacactcactactgccctccccagcccggccacccccactgcatcccagtcactgacagccgtgctctgccgcccgtctgctttccacagtatgcacacagggactggcaaggtgggcaggggtcactggggaagggccgtggctgtggtggattttaggcagaagagtgacagagtcggaactgcatctagaacggtcactcagagcctgatgtagttgcacagactcaggcagcaggcccgggatgctcactgggaagatgttacaggtccccaggagagacccatggggacagaagcccggcagtgcggagggctggggagcaggagaaagaatcagagggtggagagcaaggagtagggagccagggacaaaccaggtgtgaatggcaaggcccacttccccagacctgccccagttctgcctgtgcctggggttggggaggagggaaggccagaggccagtccagtcccaccctcctccccaaggagggtagtgagaagcggtgaggctggagagcgacccctgagggagggaggttacatgttatgatcccatttacaaatgtggaaactgagacacatttgtgtgcctcacactggtgaccctatgtgttttctccccacagatcacccagctgaaaattgagaacaacccttttgccaagggattccggggcagtgatgacagtgacctgcgtgtggcccgactgcagaggtggggctgcgtagcctgggggtggggcgggcagatgggattcaggcacgtggcctctgtgaccctcgatgtatcttcactctcttcctgtctctcctcctgtcctccccaccccttcagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgaggtagggctctcctggtctagaagccctagagggtaagaggagcggtgaggttctccccgaaaccactctgcagcgcccccccccccaacacacacacactcatctcgtgcttgtgtggcctgggagagtgggcctgaagggttagggatcacagctgggcgcagggccatcttttccagtgcagggatgctggttctcatctctcatgctgcctttggaaccctcacagacagcttgtagccccggtgtccccagacacctttccaagtgttgctttgcagtcactgctctgagagcctcgtggggtgagctgggctctgcctggaagtgcaggaagaggctgacacttcccagtccagaggttttgggattggggctgttgtttgtcaaagcaacctcaattccagaacagggaggacttggtgtctcacgtgcagggccttccacccaatcattccttccaggatctgcagaggctgcttgagagttgagatgagctattgtggatgtaggtgggggctgggaagacaagccacagcaccctctgtgccaggcctcttcgtaaagaggaggagcccggagctgggcaccatcacatctgtgctctgtgccaggtcttgattcctccatggatagaattgcaatgattcgtgttactccaccagaagacctcatggggctgctgaaattcccttcggaatgagcctggggacttttgcttgccttccggaatgttccctcagccctggtcctagggactagcccagcagagctccgagatcccctgtacaagtctcattagaactcaatgacctagagcacgggttggcaaactgtggccttcggacctaacccagcctgctacctgtacaaaatagtttttacatttcaaaacaattgaaaaaaatcaaaagaatatttcatgagatgtgagcattatgtgaaattaaagttttagtgtccataaagttttattggaacacagccatacccatttacttacaggttgtctacggctgctttcatggtacaacggcagagtttcgtagttgcaacagataccctgcggcccacaaagcctaagatatttactatctggtcctttgcagaaaaagtttgcccagtcttgacctagagtgagtaggccacctgccaggatcaagagcttagctcagggagaagagagggatttggagagaagacggagaatcgggctgagtgaggggcaaaggagagagctgggcaagggagaggagcaggtctccctgggcagggcagatgccaccagcaggggcagaggagagaggtgagcagaggccttcacacccatttagcccctctgcttccagccccgtgggtgcacacacagagctccccgaatgaatccctggagaaaacaggaggagggaggccaagatgagccatggatgtgtggggtttttgttgttgttgttgtccttgttttgagacggagtctctctctgtctcccaggctggagtgcaatggtgcaatctgggctcactgcaacctctgcctcccgaattcaagtgattctcctgcctcagcctccccagtagctgagattacaggtgtatgccaccatgcccagctaatatttgtatttttagtagagatggggtttcaccatgttgatcaagctggtctcgaactcctgacctcaagtgatccgcccacgttggcctcccaaagtgctgggattacaggtgtgagccactgcacccagcccggatgagtgttcttaaattggctcagtgggctgctccccaaaccctcaggcctgggtcagccctggatcccaggggaggacatgccactccagatacttaggccctccttgtggaggatgtcgaaaggcacacatacatgatttgtggcatctgatgtcatctttccccagagtatctgcttagcctgaaaagtatgtcacctttttcacttattatcagttctatttcttaatttggtagacactgtggtgttggaatctgtgtagtaaaaatctgatggttcttctttaaacacatgtgaggttagttcatcttctaaaagcaacagaaacatgcctacaagtggctttggctccctgaggtcttcctgggagctgaggatggaggcagaaacctcatggccttaattttctggctacttcagacagatgtggcctctgggcatgggctggcctggcaagtgcctctactttccttggccagggagggcctagcctgagaatgccactgcacatcagggcctctcactctgcaagagtcaggctggcgaaggatcaaagccgagtgctgcctggctaagcctggccctcagtgtccggtgatgtggtgtcccccgtggcctctgagtagggtccgtaatctgaccacttcttggtgcctgcaaccctataaaagccgtggctgattgaaatggctctgggagtgccatggcaacatggggagggcgggcgcagagggacaaggacaggctgtcccagcatccaacagggtgctctggggcctgggctggtggaaatggttcttcctgaatgttactttgtctttcagcagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacagagcccttccccctaggtccccaacatacagtctctcactctggtgtgtggagagtcagcctcccaggcaccataccatctgcatcctatgatgatgggcaattatgaaacacgcctcagctggcatcatccccaggaggccacactggagctgatgtctggcatctccagggcctgttctgctctcagaaaatctacgcttctggagcgagaaaggccaacagaaataaagatagttgaaaaaaatttgtttcttccagtaaattcagccggtgagctcagaggagcaaagagaattctccagtgtggcgctcacaaagtcctcagccctgcgttttagcattgaataccaccaggccatcagtgtggctggggtgaactctccatcaaacttgggaaatcactaaactctttgcatgctgaatagctatttatatattatataaataaataaatatatatattatatatcgctctctctcacaaatgcaggccacatgtcaaattcagctttgctttctacaaatgaatgaacttaataaaaataaacgttggagggggtatttggaaagacatctatttaaatttttattacatgtttgatattaaaaactaagaatggtttagataaaacatataaataaatatatatatatatatatatatatataaacacacacacactacagataaggcttttttagaaaacacattagctaacaggtgatatggaacttcaagtgttttgttatatagcatggatgttttattttgcatatcggaacataaagccattttacaactgtgaagtgtgtggatgctctttattactgacttgtcatttcttggctctgcaacggcctctgcctcttttttgctggtattctttttctcaagtgtcaggtaaggccctcagtacctctgaacatgtgtaccgtggagcctctgagctcacagtgaagtcacctaggaccacagagcaattgcacctttgatctcatgctactccctgggttatgaatctggactccagggtccacaaagaccccagaagggcgggcaggcagtaaagcaggaatctgtctcctttcagcagtcaacacataagctggccatttgggggaagtggtctcgtaagtagggaattcctggtgggatttatgcagctgcttcagaaaaggaactgaagagcaggtttgagtcagtgcggggggcttcctggagcagtcaggggcatgagctcatcaccaccatcaccccagaatgggtgagtcaaggcctggcaaagtccccattcgcctgcacctttgccaggtccctaaagcttggccacaagatggagagaggaaaagcaaggtgaaatccagcccaggttcaccctagattggaagaggcaggcataggaaggcgctgctgggtctccctccttacagccttgccacctgccctgcccctcattgctccttccccaaagctgcttacccgcatccaccatctccactgcaggctggtctaggaacccaggaaaagagaaggcaagggaggcatgcccttgaatccttgccctgtcaggactgagatgagacttcctgctgggtaaagactcaaccttgtctcctgtttctccagagtccttttgtggctctaggctgctctctggctggacttcttcctgcagaacaggaagccaagctccatcctcccttagctgctggcgcacaccttgggattcttggtcatggagaaagatgttaactgagcttggctcaggggacagggaagtgagagggctcttcctaactcccacctgctgcgctcttttctttctgggtgaagacagcacatctgggacactccacaccttctagagcccaggcagagggctgggggcaacgcggatgttcccaggttctctccaaacacatggttggctgagtctgacatgaagaaagccacttcttaaaggggtattttgcctcgaggcagcccacggcttcctgcc

SEQ ID NO: 12804 - DNA, 64319 bp, Human
tcagtttgtctttctgtttgggggaggattaaagttcacaaaagttgaacttcaatgaagttaattatcagttaaggtagactgaggaggcagagacatgtaacagaaaagccaatccagatatcatttttatttatttggctttagaaagtgtttttctacttacatgtgagtatgggtgtgtctgatattctgggaatttacttcaaacaaaggaatgaagccacgcaatggcgatctgactcagctggagttgggaatccatctagtttccccatcttgcctcccgtcttgctcttctccatggtctgtttttacgctgtgtttagatgcctcgtcttctcagatcaatctaaatgctcacccacataaaatcacctttcctgaaattgtatttgcagagcagatggagtcctgtccatttttgcgtgtgtgttttttttaagtcttttgagatagaactctaacaaagtgtgctctgctttcaaacaaggcagtaattgagcagcattaagtgataatattgaacaacatcatggataaaccacaatgagagttgctgcaattgttatggaaatgtaggcatttgtttagtcttcaattttttttttaacagaaaaggcaacctctgcattcactgcttacctgagatttatggatgaatgaaaagataggtcccttggagagttcaaactcttctgcagatattgtgtaacagattgcaaaacaggtcttcctatcagaatatgtataccttagtgacagctatgagtttggaacacgaattatctatctgtggtaggtgttgtcgttgttgctattatcatccccatttgacagttgagaaaatggagttgcagaaaggttaagcagtttctcagtgtcacacagctagtaagtggcggtgccaacatagaagtccacttcctcaagtgttcatgcttttaaaaatggaaacaaaactctaacaaccgtcaaacagcaacgattgtcagaacctagaaaaggcctcttaaatttgcagtgttaaccaagcctgatgtggttccctagatcccctggctgccaccgctctgtgaagcaaaggaaaaactaattccttgctagcataacacttctattgagcattcctggacacaactcccccaggttctgaagagcctagggttgctatttgtttagttccccatggctgcttttcacattttctggatctttctcttgattctagcattataagtctacctcttccctgatcactcacttttctacctcctggagagcactgaccacgggatcacctcaccattttatttaacccattaggactcaatgccaggcaaaacctataccacagcctgcattgtattcaccatctcaggctggagctctgattcctggggttgaggaaaggaagactttccaaccccaatttctgccatccatgttgattagtcagagggctaatcaactgtgaactcatgttctttggaactaggcagcacaggaaaaataatcattaaaggtttggtaaataaaatactgaatggatgcttagctacctgtcattatcctgtctcgcttttcgtcagcatgcaatcccaatcctcagctgctaagatgtagacaaagagttctgatgaaagggatttatttgtactattccaacagagtctgaaaactagcatgagcatttccataggtcgtctctcaacaatcctgtctgtaaatatttgagtcacttacaggcattgttgagcacagttctggcccagcaaatcttcctcctttgtatccctgatcaagtaaaaacttagtcaggatatacttgggtgaccttcacactgtacctcctccagaggtacagaggtggtgacgtaatcactgccacagctgactggctatggcttgcttgataagacgccaggggctacctatgtagattcccagggaggaactgtaggaacaaaccggtgtcaatggttaacccaggttcttggtgtctggagcttttctttcctttattattaactaaagagcattctctaccattgcccagctgaaagcacctagctcatagattctctgtggggagagtgaataaaggtaagtgctattattgctatggatacaatgtcattcagcctatgttttgctcttgctggcatctgtgtttggggagcagcaacactctgtttccagcaaacgtaaatattaatgatcaattaaatgcaattaagataatttaattttttatccaagtgctttaagtaggaatcaaacagtgtgtcatattccttaagttattttgaagctttggttaaaagtagtctcacattggtgtttacagagtctgttaaacagcccttgcctgctattatatttgtaaatgtctaaaagtggctttattatattcataccacatggagtattctgcaatgtctttcaaaaccagatttttgcatcctgtatgcacttatgaacatataattgcaaatattaaaaaatatgtattttatacccccctcttaaaaagctcagagaaaatacacgttaactttttttatagttgtctataatcattgaaaggaaataagagatctattttttctagatttattttaacataaattgaaagtgaagaattttctccttttgttttcaccttaatccctctaaagcttttttttttcttatcatttaaaaatcttaaaattttgttttgagtatttagtcagaaaagtgtgagcttgtgaaactttgctctctggatgccacgaattctctgacatatataattgaacagttttccttgttggtatatttaggtagtaaacaataacatttctataagccacatgaattttgatcatgtgtattacatggactgaatggtctttagaaaaagagtattggagtatttctgctaaatattactcttatggctagtaagagccagatcctgaagaagaaaaaaatgtatgaatgcacctttgttactttagtatgggaaatgtagactagccactctttatgtcagattttaaccaataaaggaacatgaagtacccaaaccacagctgttttgcagaatacatttaaggaattcctgaaattcagccaaaaagaatttaaaagtgaacaaggtccagagttcaattcaaaagagagagaaagagaaagagagcctgagtaacttagagatgtaatcctgcttgtttatttttagaacacgataattgtgataaatctaagattattagtctcatatacaacaagactgacaacctttgaaactgcaagaaaagactgctttgggagaggaattcaatattctattttaatgcatttttctcaacaagaatttcagcatgagagagaacaagagtcttcaaggatattgaaaaatacatgtttcttctattatatagattagtggtgagtagaagctaagacctggatataaattaattgaaaattagaaatggaaaaaaagtatagtttgaggcaaaatatataaagggcattgaaagtaaatatttggcaccgaaataatacaggtattttctttgttaaattagtaaaacctaccacttgtcctcatacaagaacttgagttccagcataagaagatcattgggagccatcttcaaagctacctcccaccattttccatttataaatggaactgtcaaagaagtcttcactaaggggttgatatttagccaaagacctggaggtggcaaggaagtgagcaatgtagaatccttggagaagagcagttcaggcagatggaacagccctaaggctgaggtgtgcctggcgagttaacaaaacagcaaagaggccagtgtggctgaagcaaaattgcaggagtgggagtagcagggaatacatgaggtcctgtagatgtgccataatatttaccaagacagatacgattctgcaagctacaagtgtcagagaaggtttttgagatgttagaaaagaccatgggaagtgtagatttagataagtggagagacagtgaggagtattgcggatgacaggctgatgatacaagtgaacaaaatatagatgtgagaatgagcagaattagcataagcatgagagcaaatgaagttaggctcctccagtgtacccaatggagtaaataaaaaggtttctgaacatcaaggctgtgctgaggctaacaatatgctcaccaacatgaaacttgtaagggaaacacaaatctcaacacagaagccaggccctctgtagctcaaaccagatgttgtcaagagacaggaaattaagaaatctaagtaaaagtagatttcatggacagtaaacagaattagaagtctttctccaaatgcctctttcctggttaggctgtgttttttttttgtttgtttgttttttcttgcattttagtgagtccatccatcagctttggcatctccaaatggcccctttgctggaaaccatggtaataagggctcatcttctcagatgtctatgggaaatgaaagtaaactcaaatagctggttcttggttaaatttttcaggcccaagggcccagattcagaaaaaaaaaaaagatagtttatctgaaatgcattgcatgaagaatgctttcctatacaaagacagttacattttgctttcttagctggttagcctctgcagactgggaggagaactatttttatcatcatgctttagggcctatggaccctaggctttgtagttatttcactctgttaaacacaaggggtggatgactttatttttttgtatagctgcttttaaatgaaaaagataggatcagatttttttcctcaccttgctccagaaagttctactctgaaatcaaggatctggatgcaaaacataagattctaatagaggcttctcactattaaatgcaacttttcccagttgccatggctccacattctccccctcctaaaactagatctgaaactgctgacaggtgtataagaaaattttaaaaagtcaatcatctggggaagaaacagtcccaaattagatttatccaacaactccgcataaaaaaaggtgatttttaccttaacatgttccaaaaaggtcacctccattcctaattttattttccttatatgaaaatagctttagagactccaaatggttacatggcttcagattgtattttgtaagatttgctctccttttaactgagaaacaaatattcagttatcttttttattttaagaaaaatgtgtgttctagcaaacatgaccaaaaacactcttgttttggtaaattttaattttttgttgtatcccattttaaatcagaggcatgttctcatgcaatcaataaacatttattaagtaccactgtaccggacagtctggggacaaagataacaaagatctggtccctgcccccagcctggcagaaaaaggcatgtctgtaaataattaagagccatgcaatggtccagcaccatcataacataacgtacaattagcacacccaccaatcacacttttttccaggaaggcaagagggatgatagccaagtttgaggcaggttaatattgtcctacgtgtgcttgtggaattcagaacttttagacactgaaatatcattttcactatgaactctattacaagattttccactgtcagaaactcactcttaagagaactcagacagttctcttaaaatggtctttttttctactaccgtttggttattagtcaaggatctctagagaagcagaagaaacaggatacaggagagcgagagggagaaaaacacagagagatcttaaggaattggctcaagcgattatggtggctggcaagtatgaaatctgtagggcgggctggtagaaattctagtaagagttgacattgcagtattgagttcaaatctgcagagtatgccagaataggaaacttggacggcatttgtatgttacatttttgaagcagaactcctttcccaggaaatcttggcttttgctcttaagggttgcaactgattagataaggcccacctacattatggaggataataatctgcttttctcaaagtctacagatgagaaatgttcctcacatctaatatgtatcttcctagcaatatccagacaggtgtttgatcaaacaactgggtaccatagcctagccaagttgacatataaaattaaacatcacaataacagaatccaacttcatcctgattgtcttttgccatccagttattagacattatatgtttcaagcttccatttctctaaaagaaattaagaatcatactttagtaatcatataaatattaaatttcataaaatggatctgcctaaaaataccatcatttgcatatagaagcatccattaatttagtacagcatttttattttattatttatttttatgtttttagatggagtctcactctattgcctaggctagagggcagtggcatgatctcggcccactgcaacctccgcctcccaggttcaagcaattctcttgcctccgcttcccaagtagctgggattacaggcacccaccaccatgcctggctattttttgtatttttagtagagatggggtttcaccatgttggccaggctggtctcgaactcctagcctcaagtaatccacccacttcggcctcccaaagtgctgggattacaggcgtgagcaaccacatctggcagtacagcattgttaatgctatagcttttttgtaatgcaacttggttaaagagaaaaagatttttttaaattgaggtaaagagtaagttatttctgagacactgacagtgacagtccaaccttctaatgacattgcttcctcttccattaaaatcactatccatatcatatattttggctgttacataatttcctccatgttttcatgtagttcatatgtatgagtcctacctctgaataactgtgtttacagtagtagcaacataccaagatctctgagaaaccatgtgattaacatcgtataccttttagaagtattaatttcactcaacaatttggatggggagtaaaagaactgagtaattttatggataaacactttaaaattattttcataatgcaggtatgactatttatccaacaataaatatatttttatatttaagactaaaagaaaaactatcataagaccgtggaatattttgagctcgggcccagtcatttgtcttatagcctcaaatacccctggacttggggtagtaataggggtaatgtactcatttatcttctgctttgtaaggtttattttttttaatggaaaattttgagaagtactattaaaggatgaattttgtgagggaaaattcctgggtttggttactacttgattagttagttggctctgccccagaaaaatatctactaacccacaaacttggccagtcttttcacaactatgtgctctcctcatctcatgtgaggctgagccaaacaatgggtaattcaggacattctgtctctactttgggaaaataatctaaagtaagctcacaaaacaaggtgcctggcctaatggctggacatcaaaattgttcgctagatctccgattcaagattttcctatactgaagacagcacaggaggtctgctaaactagggcttaatagctctcaccagccagcaagtgcaagacacacttagccatatctgatgaatgaattcggttcttagctgacctgttagtgttcttgtaatatgttattgagttctatttgtttattttattgagaaagtaaaatccttcccagacttgcaaccaaaatttgggaagtttccagaatattagagatgatgagttatgcaccaggattgtcatatcaagaatgctctttattttgtaacttgcctttcatttggatcagaattgagccaatttgtgggtggttcgatctcacgcccaaggagaacgtggagtggctaatttgaacaaattatctaagacatgatttacacacatttaaatttaggctttatgggaataggaggtggtttcatttcctcatgactaaaattttatttaactgtattagataacagtattgagctgaaggtaagattaggccatttgcacttagaagttaaaagctaaagaaacattcagagagaaaaaactgaacaaagcaaatcacagacagacccaaacaaaaccaaacagaagcaaaatgcactttccacatgcaggaatcaagtacaatagaaatcagggcaaagtttttatgcattatatttctataggcagaatattgttcgtgtgtgtctgcactattgtgtcagctcatccctgtttttgctgttgcaaacagtgggcactgtttctcgagttgtgtatggaatttggttgtgctctgttagggcagcttgtgcaacagaagcacaggggtatagagcgagcagagttaagaggtgagaaggagaagtccaaaattgtgtccttgagatgttagttgttaagagtcaccatgctctgtgtgtgtgtgtgtgtgtgtgtgtgtaaataagtgtctgtattaattattcacaaagtaataccatgataattgctatgccattaatacaacattgtggacctggttattttagacatgaaaataatagcattcagtgaccatgctgccactcagtaaacagaaggttgttgtcttttacactttggcttcatgaattgaacaaatgttctttcctttcttcttggttgatgtgcagtgactcgttctgttggtcactaggcatgtaaagattagtccatcagctccctgacattgggaaagtcaaagtctagcaaaggaggacactgacagaaaaaacaactgtgcctgggagatcaagggaagctttactgtggaagtaatacagtattcaggttttagctagaaggaagaaaagttgtctgcctagttataaagagcctaacagatttggggaaatgtgagaagttcagtgttcagagtgtagggttttcggtgtgaagataaaagcagagtggcagggggtaaaatggaatacaggagtatgacctagagagtaacttagatgggagaatgtttttagtgtccatttctaggcccccaaaccacttgaaactatagttctaatactgaactccttcccagttacctgggactgattctagagagaggagaatttaattgaacatgtggagagcagagaagagataggagaagctaattagtgttttcctacttatcaaagacccttggttcagaggtaaggtaggtatttccaagaaatggaactacaactaacaccaaaaacatgacaattgcttgtcgaggctctcccctcttctgaagttgcccattccctgtgctttatacattggtattaacttgctgccactatctttatggagtaggtggccagaacgtcttttcacacctggacagagtgcttaagatggtagtagaaattcacctacaaagattcagttcttctacatactaggagataagtaaggtagactaaaaaaggcatttgtggatcagcagaaagaacactgggcccaaagtcaggagctgctgtcttcctattattatacatttattattattttaaagtaagtaattctccaccatcagtttcttcatctacaaaataaaaatatttccctcattcatttacacgttccctcaacaaacagttaataggtttgaacactcaaggtttgattagagaagcagaactacttggacaacatatttatctattattgagatggaatcttgctctattgtccaggctagagtgcagtggcacgatctcagctcactgcaacctccacctcccaggttcaagcaattctcttgcttcagcttctcaagtagctgggattatatatattatatatatataatatgtaaagagatatatattataatatatgtagcaggtgaggagaagtccaaaactgtgtgtatatataatacatatctatatgatatatatgtattagatatatactatatagacagttatgatcaacctgtattgtgtgtatgtatgtatgtatatacatacatatacacatatggatgtgtatagtcaagtgctgcacaatgacaatttgttcaacgatggggtgcatatatgatggtggtctcaaaagattttaaagccatatttttactgtacattttctatgtttagacaacacaaatacttaccattgtgttacaatcatgtacagcattcagtacagtcacatgctgtacaggcttgtagcttaggagtaataggctataccatacagcctaggtgtgtagtagattataccatctaggtttgcgtatatacactctatgatgttaaaacaacatcaaaattgcctaatgatgcatttgacagaatatatcctcattgttaagtgacacatgactgtatatatatcataaaaatttgactttacacagttggtcacatattctatgtgaagctgacatccctgtatctggcactggagtctaaagttgtagggcaggcaattggaaggacatagtggtgtgaagtggaggaagatagaatattgaaaccagtgaggattagctagaagccaccaagatgaaatgaagcccatgttggtgtcccatggctttcgagcctccaacttcataacaggggtggccagcaccacagtaccctccctctgtaacacaggagccatagaaactgaaagaggagaccagcaggatgtgtaggcacagtgggctcacctgccaatccataatgtgtgccagtatatcagtgacaacctgcgtgggtcgcctgagcaccttgtgccctacagtgacttgttgtggaaagaatatggctactggttcacttccaccttacataagtcatgcaagatgactcccatggcctgaaactatgaagggaatggaattctgagacatgtagtctcagttagttaaattggtacaatccaaatataccacatctgacacgtccattcagaacaaaaaacaagtgatagagacattgtccctgacattgaagagtccattaagtggtaggagagagtcataatccacctgatgcgtgttatgatagaacggcttgcttctttaacacacataaaatgagattaatacacacaaacgagctttggaagtgttaaacttttaacaatttttcagagtctcatgttgactatctgatgtttgattacctctatctttaaaagcaaaacacaaaggaatccattcatggtagacattttaataagtttgaattctgtaagattccctggtctttgcttcatttcctctggtagagcggtggtgctgaatggatagcaaccacgtcccctacactaaccccagtccttttgctcatggaattatgctgattttgctaatccaccaaccacttgccagaggtgtttgccccgctttcatatagcttatctctcctttaagctgaggaaaatgacagatacgttaagaaacactagtaaaattccttgatcactaataataataataataaaattaaaccctcaaatgtttataccaaacctctattgtgaaaactacttgtttatcggcaccatcttctatagatttttgttctatttctttcttagattgtgtttggccaacgctttcatcttaatcttctgcctcagtttatcttccttcaaggctacttagttgggtagattttgtgtatttcaaagactccatgttttctctgtatcatgaagatactgtcacaatgacaggtgagctcatcatcttgttaaagggtttatttccacatctcaattgttctgtcctcaaagtcacaaaaagaaactatttctgaatctttcgtggaccatataccactacatggagacacacaattttcacctgccaataacaaaggaacatgtgtcagacattacattttccatttatttttaaatttcacaacacagggttctaaacctgtgccatgcaccattctaaatgctttaaaaatattgattcggtcttcataacagactttatttttacgataaggaaacagaggcactgaaaggtcgggatgttctgatgtcacacagccagtaaatgacatagctagatttgaactatgtagtcatgtagtaaaggcatgggcttttaaccagtagtgtatgtcttctaaagagcctcaattccccataaattcatatctgtgttattactggagatgctaagttatattaacacgttctttggattacatacccactagtcaagacacctttgtacataactccaagtgaaatcctgagaaatgctcaggcattgaaataataaaggagaatgaaaccctaccacctcaattctgctctatgcctctgatgattgattttattgaagtagtctatttcatacatcaaccgctagcttattctttctctatcaaagcatttaaggaataaaaaaagcaaaccacagagaatatcttcactttattcaatgggcagaacactagatgttccagcataagaatttgttatttccctcaaaatcaataaatacaaacagaaaaatcaataaagattttactccattgagcaaggataataccaaatctaacgaaagtaatgttttattgatgggggaaaatgtaaccattctttatggtcccaacgacagatggaagtttgctgccttttataccaaatattcaactgtgacaccatttatttgatggggaaaatgtcaataaaattagagcccaataggcctcgacaggtttctttagtttaaaaagtctttacttaattaattcaagataatataaatattatacaaatattgatttgttagaaatactgctcttgatatggaaatacttacaatgagaatttttgtgagaaagtgaagcaatcttaacttttattttttattacaattagttaatgaagagtaacaatgatctgaagtcatccactaaaatattttgtttgccatttattgcatagtaaattctgtatttccttggttcagaacacatattactaatgaagtcaaacgtgtattttcagagagactatcaaacaaaagccagaggtgagcacaagaaaagtgtatttttaaaggtaaaatatgttcagtgttctgtgaataaaagaaaactgcactgcttaagacaaaaagctgttaagattgtttacagatcaagaaattattttacaaaaatggttatttattcatcatttttttcaacatccatggaagaatgcctcttgaagaaataggatgtttactatttaagttgggaaaaaaattggcagttttcctatccaagaaacgattagtacattcatgttgaggatgactgggcttctgaaggtccttataaacttcgttttagtgtttggcatttccttttacgtaattgcagcttttaaactaaagatcagatcatacactggcatatttttgttattcttgttttgtgcattgttggtacaatttctgatttgattcctgatgaaaataacaaacaacatttgtggtagtactttggaagttaagccttttacatcaattgtcacattttattatttatttatttatttcaagacagagtctcactctgtcacccaggctggagtgcaatggtgcaatctcagctcactgcaagctccacctcccgggttcaagatattctcctgcctcagccccccgagtagctgggattacaggcacctgccaccacacctagctacttttttttttttttgtatttttagtagagacagggtttctccatgttggtcaggctggttttgaactcccaacctcaggtgatccgcctgcttcggcctcccaaagagctgggattatagacattatctttaaaacaactctgtgagagtagtgagaggaagtggtagtagaattcttattatggcaataggaatactaagactcaggtaaattaagtgatgttagtgtaagacagatagggaaactcaaattccagggtttcaattctggcctctgtttttctttcatttaccatccaaccactacagtgtcctctttcctcttttacttctgtcatagaaaaatcttaaggaggccaggcgcggtagctcacacctataatcccagcactttgggaggccaaggtgggcggatcatttgaggtcaagaattcgagatcagcctggccaacatggtgaaacccgttctctactaaaaatacaaaaataaaattagccggttgtggtggcaggcgcctgtaattccagctattcgggaggttgagacaggagaatcgcttgaacccgggaggcagaggttgtggtgggccgagattgcaccactgcactccagcctggatgacagactgagactctgtctcaaaataaataaataaataaataataaaatgtgacgatgtaaaagacttaagttccaaagtgctaccacaaatgttgtttgttattttcatgaggaatcaaatcagaaaagtaccaacaatgaataaaacaagaataagaaaaatatgccagtgtatgatctgatctttagtttagaagttgcaattacgtaaaaggaaatgtcaaacgctagaacaggtgaatcgcttgaacctgggaggtggagtttgcagtgaagccgagatatcgccacgccactgcactgcagcctgggcgacagagcaagactctgtctcaaaaaaaaaaaaaaaaaaaaaaaaagtaaaagaaaaagaaaaaagtttgaaaaccagtagtctaggccaaggcacctcaccgccacaaaactgttttcttttcaaattggatcaacgatagctgtgatacagagcttttagggcagcggtttccaacccttttggcaccagatactggttttgtagaagacgatttttttcacggatggaggagacaggggatatgaaactgttccatctcagatcatcaggcattagttagattctcataaggagcgcacaacctagatccctcggatgtgcagttcacaataggattcgtgcttctatgagactctaatgctgccgctgatccagcaggcggaggagctcagatggtaatgctggatgtctgctgttgctgttcaccgcctgctgtgcggcccggttcctaacaggccatggactggtcccggtccctggcctgggggttgaggacccctgtcttagggatattggggcaatgaaattgaaacaaccaactcataacaggcactttagaaatggtaacattcccaggggattaaagcttgtcaccagggttaattccaaattattcattaaattttgtcctctatggaaagaaaagttacctcttttgggtaacttatggtacactttggctatattcaaaatggttagtggctgccattgaaaagaaatcaaataaggccaagtgatttttttttttctaactaggaaacttaggaaaaaaattaaggaggtggcacgacctgtttatttatgtgattctgaccattataccacaatagttttgcctagtggccgattttagtcctatggcttgaatgacttaagatatgtagatctaatatggcttggtaatataaaagtcctcagtttaaaaagtcaattcaatttaaaattgaatttaaaattgacttttaaaaagtcaaattcgattttaaaacttaatgagaaaaggtttttagtctcgtttccaccagaacgtgtgaaagttttctttcttttgcttttctcattttgtaaccagctactttggtcctacgttgctgtatgtaacacaggaatacaaacaggcaaatcaagccaatttcttcttctgatccctatatgtcctcttcctgaacctataaatggtttcaattcatacagtagttgttacgtatcaactctgtgccaggtaccatgccgtatgcttggggccacgctatcctcatttatttcactctttttctgaggactgttctacagcaggaattttggggtctaagccacttcagttggccccgtaagtttttatttttaaattaatttaagagtcttgcataatttgcatatgagttttaattactagaaaagagggaagaagtatgtttacttttatttaactcgcagcatttccagattcctgaagttgaaaaacatcacccaaaaccatttaaaatttttgtttgtttgtttgtatgttttaatagttcccaaaggtggaatttgtgacttgagggaggcagtgaaaaaaacataatgcctgcagttactgaagcataaaactacagggtttccatagttgctgtagtctataacccgagggcactctattaaataatcttaacttgctgggaaggagggaaaatatttagctataaactagacttacaaccgcaagtgacattttttcaaaaggttaccacatctctgtttatcaaatttatatgtacataaaaagattaaaagttagttactccagtatttacagagaacacacacctctgactaactctgtttagaatctctaattatatcacactcaagataaaggccgatcctgctaacactttgtaaccgtggtaataactgcttccaccactgcaggtctaagtttaaattatgcactgctgctttgaaagaggggatctcgacagggaaactggtgtagtccacttccatccagcctcagctgtctcactgcacctcaaggacactgttaaatcatttgcccaagcattaatttttttagcctccaccccagatttaatcacttacttatcttcctgccaaagtaattgtgctggtaaaacagggcaactggaatctaggcagaactggctgtttctgcttctgtccaaagggacagggatggaaaggctgatggtggtgattttgtgattgaatgggggtaattgttctgggttttttgtttttccctttaaagaaaattctacaggcttgaaaactctaagataaggagaaaagctgacctaaaaacactgtcatctcacaaacctttagctagtagaaaacagatcacctttgttacattttggctggataacattgcacacattatttgggtaattgaggtcaatggaaacacttggactttattttcccaggtacttttcttttctagcctgaattatgagcctcattctggcacagagtcctacttacagaatgtgttgccaattcattgggtgcatttagtaagttcatacgatagacattgaaaaacccaagagtatcattttggatgatcaggctctatagtttctcttcagtaatttttgatttatctacccgggttagcagggatatatgaaatagtgcacaatactgctaacccactcacaataccgctaacccactcacaatacggctaacccactcacaataccactaacccactcacaatacggctaacccactcacaataccgctaacccactcacaataccgctaacccactcacaataccgctaacccacttagatcacctgaaaaagtgtcaaccattttgtttagctcagttgccagcaatgtaacaaaaacattgtccagaagtattctttaggacatttgtggctatgaaacaaagattcaaaatccttagcctaaccggtgaatgttttcccagttttgactcagcttgatcttttggccttctctgcctccacttctatgactccagccttcccactttacaaaaatgccttgtttctttctcccatctggagaatgttaagttctcccctacttgactttcatccatctaagcatatctttcaaagtgatagcccaatctaccctttacacaacaccttttcagaagaattacaccaatcatgagtaggtcctcctcagaactcactcatgctgtctacttcctctcctactcatttgaccatcatctgtcaccatttcccactcatttgactgttaactaaaataaaattgaagtcaaaacacaacttaagtgataagataatttcctgtttgttatatcttgccttctaaatagcttactaacttcctgtggactacaatcacgtcttatacatcataaatttgctaacaaccagctaccctcctccaacacagtgcaggagaggcctatggaatagtacgcatttacaggggtcaaagaatcaaaatttaggcttaggaatgataaataatgggattttctccttaataggatttgctgcaaacaagtaaacatgtagtatttgtttggggtgctccttccactcagcaccccaccttatcccccagtacacatacacacacacacacaccactcctctgatgtttccatggcatctattctactggttgcagaatatagttttctgctgttttcccagataagcctttagtttcttgctattacctaggtagggcttcattagacacttaagggctgctttgcttgaactgaatgcatacccttgaatcatcctgatgtactttatcaagagtcacctctcccttacttatttccagggcaatatttacatttaatcggggagtgtggagttcatcagtctatgcaagtaaatgttaacattccatgtcctgtcacagcttgggtgagagctgtaatttattgggttggaggggggttgtggttatttgcattgtgtaagctaagcctcattcttaacacagaaaaaagaatgctacacaacaccaaaaaggctaaaatttgttttgcattataaataacagaaacctaaaacatctacctaaaagtacattggaatgaaccatagcaagttcctaattttgtttttcattgtgtttttattgttttatgagtcttagtttccatataggatcaaaatgactcaaatcacatcttttacataagtgttttctacttttagcctgtatatttacaattatggaataaaccatatatgcaagtttaccttcctccaagaaaatatggatctgtagataccatgtgaagtcaaagaacaacattttaagatttttatcacttcctgaccatgggatgttttacaacctaagaacagcatttctgaaaaacaaactcagagcatgagttatgtaagaggcagttggttttacagttagaaataactgaaatatgtactagtccattgtattagtcaaggttttctagagaaacagaaccaatagatagatagatagatagatagatagatagatagatagatagatagatacatagatagatgatagatatagatagatagatagatagatagatagatagatagatagatagatagatgagattcataatgaaaattgacttattcaattatgcaggctaagaagtcccacaatatgccatctgcagctggagaactagaaaaactgtgctgaaattcagtctgattaagaaggtctgagaattttgggagccaatggtataaattttatttaaagtccaaaggtccaaaaacctgaagctctgatggctgagggaaaaatatggatgccccatctccagaaaaaggaaaagatgtttgtccttcctccaccattttgttccatccagaccctcagcagattgcatgatgccccccacattagcgagggcattctttactcagtctactgactcaaatgctaatctcaaatgccagacatcctcacagacacacccagaagtaatgttttaccagctatctggccaacccttcgccagtcaagctgacacataaaatataaccaacacgtccatcaatttgcaaaggttgaaagttagtaaaagattcctcagaaaggaagaaatggaagaaaatctaaaaaaggtgaaataaccttttggacgcaagtgtggatgctctatagtattatttgtctaaggctgctttgacaaagcattgcaaactgggtggcataaaacaacagaaatgtattttctcacagttcaagaggctagaagtctgagccaaggtgtagtgttgggagggccttgctcctcctgaagcctctaagggagaatgtcccctttccacttttagcttctgctagccccgggcattccttccttgtagcagtgcaattcatcttcacctgaattcttctgtgtgtgtgtgtctgtgtccagatctcctgtaaggacaccagtcgtattggatccgggcccactctaatgactttatcataacttgattacatctgcaaagaccctatttccaaatcaggtctcatttgcaggtactaggagttagaacttcaaaatttctttttctgggacacaatttaacccataatagatagtgatgacaagaaaatgagagactccaggagattccatgctttccttataaaagggtagagaaacatagtgaaatgaaggagggctttgttttcattttcttactaataattctttcttttactgtgcttttagtttcttatggccattatggggaggtaagataataccacatggaagcacttatttttctacttattatttaaatctttcattcttttcaagaggcttggccaattgttctgtaatttgccataactattggaatatggttaggtgtcagcaagcaggcgatcttagtacggataacaaaaaatagaacatgtttcacaaggagtaaggaaaaaaaaaacaaataaaaagggcaaataaggggaagaattaatgatggattaggaaaggtgaaagacatgaagcattgtcaaaaatatgtatcctataaacttggtttaaattgcgatttggtattgatgcaatggctcatgactcaggttttcttccataatgtctcttgtgccctagacagccctgtgttctgaagcttcctttatattttccagaattcacaacctaaagagaaataacaattgtgacatttgcatttacttaaggctttggaaaaactcaaagtgaaaataaaagtaaccttcaagaattgtctccatggaataactgtctcaactattttggccaagactgtctttaggtctttattttcatggcaggaatagcaatagtttcaagctttggagggtaagggaagttggaaaggtgggaatatcaattgaatctttctacaagagaaaacatctacatgaagaaaacagtagtaagtgttgcaattagaaatttgagaaattgtaaaggttgaaagaacttgaactgctaacaattaataaaagtatgtattttatctacagatatcatctagaatgaaaggatgggaaggtgaggtatttaaattattgtaaccatccattgcacttatttattagtcaatgaggtgaaaggtggggggaatgataacatatattttcttaattttttgtgattaaacaaattcgaggtggtagatttgatagggctgaaatttattatatcactgtcccccgcaggtttgaaacaatttaggacgctacatagaattacacttgaaagtaaattgcactgtaggcaaatcatgtttccaagaacatgacacatcttactggctagagttaaccagtcctgagaaacggcaggaactcttgctctccaaatcctatcttgcaaggccgtagaatttgtccacagaaaatcatcaccagtcatcactgagcatttgtcacagtaggttttattaagttcagacagattcaattataattaaatcaatcaacctttaatatattggctaacagacagacttctaagaaaaccaagcttccctaaaaaaaagcaattagatattattttcttgattcaacttatgtgagcatctgaataatttacttttgtttgtttaattcacaaatagctcaatttataagtattggtgtgggctataggcttaagaaacatgtttgtgtaaagctgctgtcccacgtagcatttaccaccatactatgttttttatcttgagatgctgaatatacaaataaatactggccagaccatgtaagacaaaattgtctctgaccataatctctgcaggaaccagcccaggaagcccaatcataacctttgtagccatttggcccaaaatggtcagaacttggtcaatgactctcagctttccttatgcttgccttcacttgtaacctagaaccaaccagagaaagaaaatgtgctcctcaaaccatttatagaggaaacccggcttccacatagcctacctccagcttcctcagccaacagcttttgatcaggacaaacgtgaagcttttctactttttctactataaagattttccactcctctgcctgcctgtgagtctctggcaaacaaaagtgatcgtgcctgtcttccttgcaagctctggataaataatttctgcttgttctggttcagatgatcgttgtttatttccacaatctttattaggatctctatacagaatcttttaaatggcaagattagccctgcccagatttaggaaatcatttagggccactggatatcaaatgtggtaccaaaaaaaatgttgcaactgattcaaacttgggtaaagatccctttgatctagctcaaatctgtgataatttggcattttatattacttaatcctcttttttttttttttttttttttttttgagatggagtcttgctctgttacccaggctgtagtgcagtggcactatctcggctcactgcaagctccgcctcccgggttcacgccattctcctgcctcagcctcccgagtagctgggactacaggcgcccgccaccatgtctggctaattttttgtattttttagtagagatggggttttgctgtgttagccaggatggtcttgatctcctgacctcgtgatccgcccacctgggtctcccaaagtgctgggattacaggcatgagccaccgcacccagactactcaatcctttttccagtccatttcagcaaaagcctcactgcttgtgagtgtcctgcatacagtctgatttgggtggttgttttctttgtggaactacttagaggtcatatgacatttgcctgtgcatagttcaaattggctctattttcttaggtccattttgcccttattcactgagaaatatgtggtctctgatataagattgtttccattgaaattctgccaataccttttattcatcttgtaagcatggaaaagtattatgaacttatttaatttttaatttgtttatttaaaaatttttatagtaacattagcacctaccttctaaagttgtttgagaattaaaggataatttctgtaagacaattaccaaagttccaatatgtaatgcttattcaataaataataactatcattattattacaccataataggtgcctatatttctaaattaacaatcttttgtactattgatgtgacaatatgtacattaagtggggtgaagaattaagtcattctcttcataatcaggtgataacaaccttctcctttattgagaatcaagcatctcagagcgagcgtgaatggatattagagtttctgcctcagtgttctcaacagcttctactggtaaagcaagttacagctagtaacttggtcagggtttttggatataaactttattgtttagagtgtagaccaacctacatttaaaatgtgatacttcagaagttcagaaaggtacgtgacacagccaactgaagaggtaacatgtcctaacatattaaattttctctattctcttttcaaccctattacaatcaaagaaatctccatggtgaaatgctcattttgcagacacgatattgtgtaagttttatttcataatcacacaaaggaaaaattcctgggcattttatgtgcacttttgttaatgtgatcacagatacagagttagctgttcaaccccaaacgagacatgacctcactgggaggtttgttcgttcactgcattacggggatccatacaaaggacatgtcaatggcacgacccatgcgcccctgtctccccactcttgtcaggatttgtcctgggaagtctctagcaaacatttttggagcaaatattttgtgagaatgtcactgtttttgttagaaaggccatttaggggtctaactaggaaccaagaatggaatgagttaccttattaaaaattttaaatcaaaaagtgtttatattgtttggtgagtttcagtagaaattagaggaggaggtcaggagcaggaggatggagaaataagagctccatcaggagcaccaggaatgctttttaaaaacatacatattctattagattctcaaggaaatgtgactaagaacaggccctcatcgcagccccatatagcatagttttcaatttttctacagtgactatttcaaatattttctgttctcttcaaatctctactcttgtctcctttacccactacccctatttaacagggaaaataaaatcacaaacttcttgtctaccatccatagacctgattgcatctgtatccactctttccttgcaaagaacctcgactctttcccatccttctactctgctccttcacctccattttcttctctttccttcattatggatttctaattattgttgattctgacttccaagtccctcttgaatctgtttcctaggttatgacctcctcctcacttgtctgaccaatctgttctcaacactagagccagaatcttaaatacagatcttcagtgttttatctttatgctaatcagattgtgttagtctcctgatcaaagctctttaatgctttcctagaataatacaaattctttaacatgaattaccagatgctgcttaccactccagctctacctcatacttctccccattttagatcccaggatgcagccaagtaataatttaaaaaaattttcctagtaactctcattcagtgtgaacacagtttgtctcaacgagtttggttcagtatgaatagagtaagggtgtaaattgcacccttggggaaatgtgactcaacaagtaactactgcagaatggattcactggagaacaaaagcaaacatattcgtgctttgaagaatttaggagtcaatcaagtgtggaaaaggctaaacataaaaataattttattcatgagtacagttctaacttgaatattcataacattttattaatttatcataaggacttaaatgctgagttataggaaaacaatttaaaaatttaagataaatcatttttgccatatgcctcttaacaagacagcagttgaaatcttctttcttttccctttgattaaaaaaaaaaaaaacctttatggcctagtggcatataataattgtattacgtgtgtgtgtgcatatagatattattaaattataatgtacactgatatacgggctttccccaattttatttctagcactgtcatcgaagattaatttttttctgactcaaatattagaagctagaagctttttctatgactttatgtatttcctccactcatagtagctttgaagttgaattttcagtggaatggaacctttgaagtagaattttgaacagaatctggactgatatggggctggtcaaacggcacctcaataattatgaattaaaatatataacattttttaaagacattcaaagaacaaccaggtgttgagcaaattctaagtgcctgagccagctcccactagctcacaagagctaactgtttacacctcttatcaaatccacattctgaagcctcatatcagtgacctgacatcagccatgcgtggagtatttacaccacagaaatgggaaactctacaaatcagtcctttgatttcctccagagaggcagttaaaatgcaccagcactctgcttcctatgaataagttgaccatatatcacagcagtattgattgatgccagttgtacttctgacccatgattttcacttttgtccccacccttttctctgtcaaaagtgacagattcaacaatcactatagatatcaaggaaaataatataatggagatttttcactgcaagaaatgaagactgggttagaaggtaaagaagcaactacaaaatgtttatctttatgtgaagaacaggctcctggaagtagtacgagacttgttttgcagagcttcaggggacagcatgaggacaggaagatcttgtgaaagctatagggagacacatttttatctgagtttaaggaaggacttcctcatgggtaatgtcgagtcatcataaaataggaatagaatgcatttaggggtgaatgaggtcttagtccacgaaaacagtcaagtagagacggacagccatcttgaggggtgttgtggaggagctggggcaataaatgcttgggtgttaatgcctttctcatgattcatattgtgggttgaatctttctcatggcatttcttcactcagtcattttggcaatcctcagagggtctttgcctggtgctatgtgtgtttgggagtagatacaaggagaagaaaaaaataattcgctcaaattcacacaaaaaagtgacccaaaccaaaatccttattaagcctcactgttaagttttaaaatgatatgatgatcactaatttgagaggaactacatgttagccaacccatcactgatttatttgtgatttcagattttgaaatctattaggataatcaatttcacttcagcacggtttggtcaaagaaaggaaaatacatcagagggattcaaataactttagaatcataagtagtgtgagagatctacaggaggaaagtccgtttagcagtgagaacttcagacacttcctctatatcctatggtaaccaggcagttagaataacaggaagccctcaggccggcaaaaatggcacctgtgaagtttgtttgggtctatctgaaggcaggatttcagcaggggctgaggctgtacagaacaacttaaaattttcagttggataagaaaaatcggtaaaacttaaaaattgtattcatttcctaatgcctacgtggtattacatataagtcagacaattgttttctctatttcaaattactggattagtttgattattatacggactatcagaagaatagtggtacagcttttctccaagatcaacgcctttcatttgtggatcttccatcttacctgatacttctctgcccgtgtcttcagtactggaatttactccagtacttcttattttctgtttgtcttttcaccacccgaaaaacattactctcactcaccaaactatgtacacctttctttatattctcccaatcagacttaacaaacacttagatgacatttatttttgcctggtactgttttaagtgctttacaaatatgaattcatttacttctgctaagagctaatatatttctattatcttccttttacagaatgggggattgaggcacagagtgttaaaatagtgagacacaggattctaactggcagactggcactttatctcaattcttaactgctgtgttgcctctcactttaaaggtaagaaattaaaccaattttaacatgattctccgaaaaaccaatacttgcactccttcctccatgaaaatgtgctttatccctacgcatttttccagaagtccagctttctacttatacgtttatattttcataaactttgctacagagcaaattcggtgttacaaacattgcttccttttgttcacattttacacgtttactgcctccttaaatcattcaccttcactgtattttaggaaagaaatgctatttatatattttgtgaatccatagtctattatacattctgctaactaagaataaaacttgtctacttggttatttgagtctagagaatgattttcaacctggagtgactttgctcaccaagggacatctggcaatgtctggtcacatttttggatgtctctactggggtttggggtcatactggcatctagtgggaagagtttagggatgctgttaaactaaatgccataaccacaggtcatcttcccacaacaaagaattttctggccctaaatattgaggttgagaaacccagatctaggatattctgtgcatttaaaatgattccgttcagaacaatttaggtactttctcaatagtactgcaaaagctatatgaaaactatatgtatataaaaattatatctatctgtctctagctacattaacatatcaatctgctaggttaagtagactcaatttaaccatctggtgtttcatgtttgcttttgatttgtaaaagactcagacctataacatagccttaatgctaatatcattcttgagataaacgattataattgcagatttctttttttttttgagaaagagtctcgctctgtcacccaggctggagtgcagtggcaccatctcagctcactgcaaactccgcctcccaggttcaaacaattctcctgcctcagcttcccgagtagctgggattacaggtgcccgctaccaatacttgcagatttctttagtgttatgttatttagccactcatccatttttttaaagaattaagcattcactgtacaccaagcaatgttcttagtgaacaagtaatttagaattagattacaattaaattgtggattttaggacattttagttaacgtttactgaaaagtattatcacagaatttatattttctatagtttatgttgttttatatgattataaaagcaatgatttaagaattaagtgaagtattttacatgatgtggaaaaaatgagagaaaaagatggaaaagagttgattgaattattcattttcacctgattagttgaagccagtggttagtaacatcacatgcacaaaggacccagtggctgattcaaaatagtattccattctctccccatgattttacaatgaaactacgagaccaatcaggacaccttcttctttcttcttgttcaccaaaagtacttttttttttttttttttttttttttttttgagatggagtctctctctgttgcccaggctggagtgcggtggcacaatcttagttcactacaacctctgcctccccggttcaagcaattcttctgtctcagcctcccgagtagctgggactacaggcatgcgccaccacgcctggctaatttttgtatctttagtagagacggggtttcaccatattggccaggctggtctccaactcctgacctcgtgatctgcccgcctcagcctcccaaagagctaggattacaggcgtgagccaccgctacctgcacaagtagttatttttaatagcaatgacacacaagagtaattgcaggacatttacttaactaaaaaaatcagttggcaaaatcttatgtgaaaaattaaaacaaaacaaataaccatttccctgaaaaattaaccccacttggacctccacatcctttcccatccatcaccacatttttctaccccatttgacagcggaactctctgtaggctttctgcatgctttcaacacttcctgtcaccgtttttactcgtccctagtcaaatcaggcatttatctccaaaactctgttgtgacatctttcatcaaggtcaccagtgacatcacactgctaaatccaatggtcaattcttgtccttatcctgactgattgttagtatctaacacacatgatcactgactttttctttttcctttccttttttttgagacagggtctcactctgccgctctggctggagggcagtggcataaccagggctcactgtagccttgacctcctgggctcaagtgatcctgccaccttaggcactcaagtagctgggactacatgtgtgcaccatcatccagcttatgtatattatatatatatatttaatatatatatttatatgtgtatataatatatataatttatttaatatatatttatgtgtatataaatatatatgtgtatatatatttttgtgtatatatatgtgtattatatatttatgtgtatatatatatttatgtgtatatgtgtatataatatgcatatatgtgtgtgtgtatatatatatatatatatatatatacacacacatatatatatatttttttgtcaagacagcgtctcactattttgcccaggctggtcacgaactcctgggctcaagcaatcctctcgccttagtctcccaaagtgctaggattacaggggtgagacactatgcccgatcacactgccttttgcttgtaacactttctttacttcgtatcacatgtcacaatttttcctcctacttcaagcaattctttttctcagtcttcttagttatagcctcctcattttcccagacttaaattaggctgtcccaggccttcgtcattggaatccttctcctttctaactactctgactcttgtattgtttcatccatgttcatggttgcaattactctatgtacactgataacttccaatcttatatttccattctgaaattctcccctgagctccagactaatatattgtctccttgacatgttcatttggctgtcagaaagcatatcaaattttgcacaataaaacaccaattattgatttcctcactccaaaactccttttctaccagctccattatctgagtaaacagcacaagtatttactgtgctatttattgggtaatggttcatttttattttattatctttttttttttttttttgagacaggatttcattctgtcacctgggctggagttcagtggtgtcatcctagcaaacttgcagcctcgatctcctgggttcaagtgatcctcccacctcagcatcccaggcgatcctcctacctcagcatcccagatagctgggactacaggcacatgctactgtgcccagctaatttattttttatttttagtagagatgaggtttcactacattgcccaggttggtcttaaacttctgagctgaaaccatcctcctgcctcagcccctcaaagtgctggaattacaggaatgagccactgcacctggcaagtaatgcttctttacaagaaacttgctccctctctaatctgaaatttagaggaagcaaatgaacaaacagcaaaacaagaccagcatgttgaaagaacatctaaactttgtccttggagtcactactgaggtggctgatagtctttctgggggcatacgcttccttgaaacccaaatgaaatgatgttgggcaagatgctgtttgccataggtatagggttacatagtcagacaaagtgtgcatttgcatagaaaaatctttgctgtcacaatcacagagcacctacacttaagaagaacacacttggaagaggttgtacaagacctagaggtgtcagtaagagaaaatgcagccttccaggacaataagaaatttaggggtaatgtgtggccacttttgtgatatggaaagatttttattattatataagcttccagaggtttgatcagaaaacaaagatgtaaataggcatggaagaaggctattcttggttcttgttttctgtccgccaccattggcaagactatctactatgcgtaggcatgggaaccagttaaagaaagtgtcgattcactagagcgaagctgagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaaggtaagatcgtgttgtggattaaaagtgttccaagcttgaactaattgcttgtcggctcttttaagctcatcctttttgcatgtatccccgctaatatgcatctttatgatgctttttttggctcagcagtcatgctttatggaggcatgctctatggctgggaataggttttctttctctcatatatctctggggaatgctgagccaaacagattaaaaatgtcagtgccatttgcagatccattaagggaagtaacattcagagacagagggagactaaaaggatgatgacttagccagctgacataacttactgacgtggagcaacgtggaagaggtgaatctttcatttcctgtggaaaacagtcattcataaaaccatcttttttgtatgtctttgtcactcttccactgttgcaaagtgacagcaaagtagcatcgcaaatttgaaactgtgtaataaaatacgttgacatcaatttggaattacatcttcacaactaaaaatatagacagaaatgccgtaaagactctttagaaaaacaactgctaaaaggtaacttcaataaataataagcccttcaagcattgaaatctgactaagtataaaagcacggggctttcgaacttttaatgtttttcttctgctcattgctttctttcaatttgtaatctggactgttgctatggagtaaataacacctactacattccatgccttcaggtttccatttcactagaagaagtggcacaagttgaaggaaggcagcttatccatgtgaaaattctaagacagtatagatgcctggccatgggtttagccataaatgacttacttatgaaacatgttaagcttttctgtttaaaatccctcccctgccttttaaaaaatttcccatgaatcttgaaataatcctgagaattcagatggagtgcgggtattttttctaattgttgctcagaaaatccttgatccagtctgagtgttttgttatcattgagccatatgcagaattacaaaatgaaaatgaaaacaggtcagctaaaattaagaagtcaatgcaaggagtaaaggcacagataataccaaaacatgagtcaggatgatctgtcttgttggcctgacaaatatggctcaaaattattttttttaaaaaagattagaagttctgaaagtctacaatctgcaaggtagagaccaaattggctacgcattggcagtgtgaccttcccccaaattactaagcttctctctgcctccttttcaaaagcctttactagtatctatatcttagatattatttaatttcatttgataattgtgtacctgacacacaaggagcacagagtaaatggagacaattattgttagctccattttagagaggagagaaactgatagagagagtgatagggggttaatagctaagctctcagtaatataccaagtggtgcaattccaaagatacatgttttgctctcaagttaagaaaacacaagccaattgcaattttgtgatgaggaagatgggatacagttgcaatatcaaagctgcctctgacaactaataccagccctgacctgcttctgccatggttttctgacctgcaatatttaatcttcagctttcagacatccacattccaccctggaccttgcctgtctggtaagcccaatctctgcaggtcagccatgcagctgaggtgagggaaggtatgttgggatgggctggcatgaggagtcatgggggtcgagaagaaagttatggcaagagacattcttttgtgcgtgcatagtttaacagagacgaataatgttcattttgatctttattaagaggtggcctcttaataggccacccccttaataggcctcagaatatctgctttaaagtggctttttcctgatggtttcttctaccattgttacagtagctgcctcaaatcagccaaagcagaagttcctattttgcttgagagcttaggcttcaggcaaaaactactgacatttatgagatacctagtattttacaatgctatctggttaaattcttataattgtccttttaaaaagacagagaacacagaggtaaaataactgctctgagttcacataggcaaatgttggagacgagattcaaacagaaactagactgactcaaaaatcaaatctaagtgatgaaagtaaaggtactgttttgtttgcatcacttaataattcatctggaatcacaagtcatgataagaacctaataagccatatcatcaaaacctgagcttgggtcaccttcaagatgcaacacacccaacatcacagtagattcaggggcaccctgaaacacaagagtaagaaacagaaacatctatccttagagactacccttgtagccattctgctgagttgtatttttttttcattgttgcttagaagatccttgatccagtctgagtgttttgttttctttgagccctatgcagaattacagaatgaaaatgaaaacaggtcagctaaaattaagaagtcaatgcaatgagcaaaggcacagacagtaccaaaacatgggtcaggatgatctgtcctgttggcatgacaaatatggctcacaatttttttaaaaaaaaaattagaagactcaagtcttttgactttactgagaagatgaagtctgacactgtttatttccaatcttcttggaaagactttcaccactgtttatctcataaaattggagtgctatttaccagttaataagaaaatggcataacataaaacctttaaatactaatgttaaaagagaacttcagagttttctagttcaaccacctagcaaactcatgaagctcttccttaaattcttcaagttgattatccaaattcagagttaacactcagtagattgcttctgttgtaaggtactaacaataaaaacattcttcatgatacagacattaaatctacatccctgtaaaattcataagcagattctagccccgccctttgtagcaccatagagcagggcccctgtctctactgcatgaatacagagtattcgtaactgcattcaagggtgtgaaccaattgcagccagggccatgttttgactatctcagcatacctagatcacagtacagggaacatagctggtgttcaataaaagctttgaatatgcgagtatatatcacctttaatagtttcttctctgttttttctttttcctgatttcagacatccacattccaccctgggccttgcccgtctggtgagcccaatctctgctggtcagtcacgcagttgaggtcagggaaggtatgttgggatgggctgacatgaggggtaatgagggtcaagatgaaagttaaggctagggacattcttttgtgtgtgcatagtttaaaagacaaatcagtcattttgcatgttgatatctataaatgaccacatcaacatatctgctttaaagtggccgtgtcccagtggcttcttctaccactgtcacttttgaaggagggtcctgttccactccttcatcactatagtgacctctattaaacaaaagaggtaccaggaatcaaacattacatttcagatgtgaaatatctcccaataaaccagcattcactacttccactgggaattctctgtggctagaaaactatttttgttgaatctttgccttgattttctgggaaagatatatttttaaccccattcaccttcctccctccctttctccttgcccgtttttgctagccctctgagcttgacattgataactgtttagtataatcagttgcctaaatttccctgcttgtgagtttctccaatccctagagctgagggcatttgattccacacgcacgtccttctgctctgggccgtgggatgggtcattcctagaactcctaagtgagtggctctaaaactcatctcaggtgacttagcgagcatttcttgcagtgagttctgctctgaacctgtgctccagtcctagtgactgagtgttgtcttttcctgagttcaggtccaaatagccaccatcactctgattccatgtccaacagttccttttattattaaggcttaaaactttagtaataaaatgagataaatttctcatggctttttttccccaacatgtattatcctgtgaccctgaataaatatcccaaactagttaagattcaattctttatctttaaaaaggggataatattgatcccttgttctcagggtaactgggagaattaaacatatttcatgggcataaaatgcctggcatgtaagaagtgtttctctctggctgataattgttatctgattatcctctctcagtttggaggtcctaaaccccagctccatatctggatctgttacttttttttgccatacctatttgatgcagacttcttagctacataaatatctacatactgcctattatcccttttcctaacttccccaacactgggttttcccctctttctcttccccctgttctctcactgggggcctgttaagctgattaaataagccctgcccctctttactccctgttccagcagctcaactgaatttccgtcctttcacagtcatagctggatgcgtcccaagaacagaaaatgccacactccagtgggcaatcctaaactcttggctttcgaccttagaagtctggccactacattgcctttgaatccacatgtgtcagatctaataatacttagttgaagatttactatcttctccctaaataactgctccctgccactgggatgatcctctcagctcccagccccacaatctgctagcatggagctgtgaaagctgtattccatcagcaaggatctcccaaggctaaaagacccagaaacctggccatctgcacctacaatgtcaggagatataccctcttcaaaggggaaggcactgcttctacttaaacagttctccattgtgatgacaatacatactttaatcctgtaaagtttctccagacacgaagatggaaatgtgcttttctgcttcccagtctcaggcattcttttatctctaatttgacatgacaaacagactctccatcgtcacctgttatggtgtgaatgtctcttcatttcattaatgcagggctgccactgacataaagggtttttttgttttgggtcactcttctgtacccctatccttcccatatctaataatcaccattattatattaaaaggcaaatgttctgatcacagcttgatagtgtccttgaagtgaacaggacgattttctgtctacccagtgaaaacagcctttggtccttcacagtgatttcacagacaacctagagcctacgaggagactggaatgttgatctctctcaggtcaggaaccagacttacacacctacacacttcgtgcgcgcacacacacacacacacacacacaaactcatttccggcatccagtctttataatgagagctagttcttcagtaagagtccagcttctggctgcagaaggaattaatgccaagataatcctgtgtactttggatccacgcagtaggaagcttcatgcttgctgctttcctcaggatgccctgtgacatcacccacactggattgtttttccttttgtgttaaaacactttggcttcattccaaagggtgtctgaagacaacaagccttccctccagtctacccactggccacgtaatcccacaactggaaacattcttctgcatgaaaaggcatcactcaattagctctcactcagagcacccctcccatgtctcagcttcctttgacctctttccttgccgatgttttagattcttaatggtttggtctggtggaggtctgctacagtcacttgatacttgtacttgtgtcccccagtgtgtatatcaagggctgatattataaggagagtgagtagatgcatctcaggaaaaattaaaaatcacttcagatgctgaaatagttcactacaaccctggtgtctggagttgcagggaataggatataatctcctcaattctagaaaacatggttcaagctgtatacaaaagatatacacatctgagggtatgagtgtgacattaaccattatgcaccactcacaccagttacagagatctgggttgcaatgctagtttttttgcttagcttgttaatttgcaaaacacaaaagatataatttgcaaaacacaaaagatataatacaacctgcttttcaagatggctattaggattatgggagagtgacacagcactgagccccaaaaagaggagatggagctgggctaaggggaacgtgtcactaaaagcagaagtggggagcacacagaaaaaccttgattagcatcatagattgtctgcgggctggaccttcaaagttgtaccacgctgaatacttggttgcactattagacttcctggccattactgcttggatagctgagattttgattagtgctgttctattaaactggtagtaaaatatctttggggaaaggaatggggtacatatgctcgcagacaggcaaggtcactgatatggtttggctgtgtccccacccaaatctcatcttcagttgtagctcccataattcccatgtgtgtgggagggaccagatgggagataattgaatcatggggtagtttcccccatactgttcccatggtagtaagtctcacgagagctgatggttttataaggggaaaccccttttgcttggctctcattctctcttgctgctgccaagtaagaagtgcctttagccttccaccatgattatgagacctccccagccacgtggaactgtgagcccattaaacctctttttctgtatataaattacccagtctcaggtatgtctttatcagcagtgtgaaaactaactaatacggtcaccaatctcaatgtgttgctttcatacaaagaacattctttgattcaaatgagaagaatatacatcagagtggtcctgctcaggagaggaagtggagaccccctttgcttgatggcacagcatagatgatgtgttgccacactcaggtgcccctgggaccaagaacccgagaaccaagtatgagtcctggagggctaggggttgatgggcagggccttgcactccttttggttttcacaaggttttagcgacatttggccaaatatgaataacaggacaaatattccttcagcctattatgtcttctctcgtaaatgtttctggataagggagctggcatgggcatattcacaagttgttgacaatctgtctttgaggactggtttctaattttttttttttttaatgagggcatccagtctatgtttctaggggaaaattacatgagatttgggagttcaaatgccaatgatgtttataattctcagctaaaatgccagtatttctttcccttgtcttgaactctatgaatgaaaaaaaaaaatagtgttggtttatagtataatccttccagttatgttttaaagttctgcagtactcccaaacccatcagttgaatgatcttttcataaatattatctatcatttatgtgtacaaaatggcattttgattaagttaaagcaaaaggtaattttattaccagagaaaatattcatctcatccctgtccccttctctaatcaacctcaaataaaacaagaccatgtggtctacagttaaaattgttataaataatatttaattaaatcagtatctaaaattattgatttttaaatacatattggaaatctttctccatgtagccataccatacacattcttggctaagaaataattttgttctggatgcaggaaacctacttgttcaatgcaagcaccactcaaattttcataggcagattatctgccggatgaattagcccaaggaattaaaattaaaattcctaaacttccttctgctcaacaacccagaatgttttccttggttacatctttctcatctgatagcttgatttcaagggaacaaaaaatcagttttaatggggcattcttttcaaagcaaataatttattccaagtcaaatgcaaattgatttctcactattttccttttatggcttatctatggcaccaacttccttcattcgcctagaaaatcaagaagtaaccacccaagccaaataccagggaagcatctttgttccttaaatgctgggaaaagtcttaaccctagtcacctttcttttggatctagcagcgtctttctcactttgatattattccaccatagaagtctatattctcaaagagctgtactgacagcagggctgtggtttacttggcaagactgaacttctcaagggcagtgatactgctcataattcttaatcatagtcttcacaatacttcagatatagttgaatgttgattgaatttaaaaatacacaaagatgtgtccatagttttttccagtcccttactgtcattggtgtatttggctgaatggtacagaaactcttcccgtgaaggtttaaacaccttaccatcatggtttcagggaaaagtgctcccatcttccccaaactcagttcttagttgcccatcaacatgaatattccagactgagaaatactgggaaagtatcacttttctttttaaggaaaatattactaacttgggttgccgctgtgtgtgtagacattcatagataataaaattccaaccttccaaatcaggacaggatgattcgttattcttctatagcactatcatggagataaaaagtgtgattggaagagaaagtattaaaaaaaacatggaaattcaagattctatcaaatacactaactcctgtcagctctctaaatcttctattatctgtagtaagtggtaatgcttccctgctaagaggccttgagaaggcacacactaatagaaagttaatctcatgtgacaagcaacatatagcttaaggtattgtctcaagatgctatctatctggatcttcctaggaagatcttttgtcttatattttaaggccttcttaatttatctatatccacagggaaaatgggaattgagacatcagccaataacacttactttattttcctttccaataaagatgtcctgaattttcattgcaacagcttaaaacagaaacccaatcacttaaaggtcaaagaagttgtagacactatccagggagtttctggtctacgagtaaatcacatctgtgagttcagtgattcccagcagattgaatagactaataaatagactctctgtaaattgccaaagaggacagtttgcaggcagtactcacaaatgggaaaatagcaacagagagacaggagttggatttctgttggcataccgtaaatgccaaattttgagaaggtcaaaagtcatgacacatatgccttccacaaattacatttgttttgaaatgcacagttaggttcaaccaaagcagctcccatacaaaactacatgggagctactaaagattagtcataggtaacctggcattcagaaacaccatggagagtgttatcattctgttgagaaacacaaagcaggtaactagtacaaaatgacttctattcttagcaatacttgtagttcctctgggcagttctatcatgtctccttgaaggtaatgaaggtcaaggcaattagatgctaaaacagaattctgaaacaagtctgggaaattgccaattttataattaatggcgggggaaaaaaatgccagttaactctctccccatttgggtctacacttgaaagatgatattaatctacataagataattccactttccattcgttatttggtttggctaagactgtagtcatagctacatgcactgtgattaaaaactaaacaataccacctagtatgaaaggaggtttagaaacacagcttctttttatcctcatagcaatccactgatgtgcattttcagatgggcaaacagaggctcaaagacgtcgattagttggtgcaaacgtgcacagtcttactagcaatcaagcaggtacttaaacttaaatccttatgtatcagaatctaggtctcaatttttgaaacttaaggtctcaatcttcaaaatgcataagaatcaattgaggaccaatcaaatcaggattggggtgaaactcaagaatctacaagtgcaagatgttctcttagaatctgaaagaaaatagttgactacactttaaaaaacaccactatactatactgcttgtagggatatctacatgaggtgttggaggttatgaatatgtagcttgaggttatgcctaaatagctggggacagctatttaggcaaacctgcatcatgaatacataattgccctcctcagaactcattcatttaaaggaccatttacttgagttttgtacatctagcaatagagacctcaaagtaggaaagttgcagaatagcacaatttttaacattttctttccaaagttattgaaaatattaagataaaagaaagattgttaaaacagacattgttacacaagccaagaaataaaggtattaacagtttaatatggtttggaatgggaaagagacaaaaggaggcaccaaaaaggggaaatgcatttggtgcccatttaatgctaactctgcttcatccctgatttgttacccactgttttcatgatttctccaattgctctccagtggccaaatgtgatctgactccctcttctccctcccacctccttgttttaaatgagatctggttttacttagatgaattaaatgtcactatatttgtttttgtaaattgttccagcaaaaattacagcatcgatggctgactttaaatgtctgtacgactgtcctgccttgctgggctatttatagctgccttttaaaaagtctaataaatgcttttagattgctattgatttgtttcccctttacaaagcctcagaattaatattcttcaaagtattaactgaaaacaccttttttctttctgcaaaagtcatgcatgtttactgttaaattttagagaatataagtatgtgaatagaagaaaaaagggaaaactaatcacatcaaaattaacattttgttgtatatgattctgttttttctccatttttaaatatatttaaacttaaaaaattttattgtatgagagtttttatagccctgtttttactttcatttaaaaggcccacatttttttcccgtcactcttctactccattacttttaatggctatagagtaatcatatgattgtaccattacctatgaaatcaacctctcatttataaaatagctaattcacatccagattttgtcactacaaatagccctccaatgtagtcgtgtctttgtattcatccgtaataatttctttagaaaaaaattgctgagaacggaattgctgcattggaggttgtaccagattcatagactattgtcacacatagctagcttacctccagaaatagttcaaattaaatgtatacatttgaatatatctttaaagtgacaatataataacacattaatattgggggagtcacatttctagtaattcaattatagccttaacaaatttaattaaacacttttacacaaacagacacttttcaaaagaagacatacaagcagtcaacaaacatgaaaaaatgctcactatcactaagcatcagagaaacgcaaatctaaaccacaatgagataccatctcacaccagtgagaatagccattattaataactttaaaaacaacagatgttagcgaggctgcggagaaaagggagtgcttatacagtgttggtgggaatgtaaattagttcagccaccgtggaaagcagtttggagatttctcaaagaacttaaaacagaactactattcaaaccaacaatcctgttactgggtatatattcaaaagaaaacaaatcattcaccaaaagtctcatgcactcacatgttgataaaggcaccattcacaatagcaaaggcatagaatcaacctaagtgcccatcaatggtggactggataaagaaaatgtggtcaatatacactatggaatactacacagccataaaaaagaacaaaataatgtcctttgcagcaacatttacgtagctgaaggccattatcctaagtgaattaacacaggagcagaaaaccaaatactgcatgttctcacttaaaagtggaagctaaacattggatactcatgaacataaacatggcaacaacagacaccgaggactactagaagggagagcgggcagggcttcaaggtttggaaaactaacctcagcatcacaccaaacctcagcatcacacaatatacctgaaccaaacctcagcatcacacaatatacctgaataacaaacttcgacatggaccccagaatttaaaagctgaaaaaataataataatataaaatttcatactgaactccgttatcagtcctgaggaagacgataacataaaaacaagtagtatcacctttgtgttttctgtttataagctggtatctgcaacagggagatgtaggataaatgggtgtttggagaactgtcaacactgatgtttttatagtcttaggagtactaactctcttatgagtgatgaaatttccttgaggataaatatcatctttgtattattcaattatttattcatctatttcttcaaaatataattagtaagtgcctatatatcacatattgctttagctgttagggatacagtggtaaataagacaagcatggccctcgtggagcttacaatttatttcacagaacaatctaatcaacaaaaaagttaatcagtagcagaaacatccttgggctttagagcagggtgtggcaaactcttctgtaaagactcaaagaaactaggataatatttaaggtagtaaatattttaagctttgtggaccacatggcctctgatgcagctactcaactttgtaagtttgtgtgatgtaggggagggaagactttccctctagcctcaagttcagtaattcagtagaacttatgattgttcagaacttgagtctataaaataagctgacaagaggcagattttatcagtccattcttacattgctataaatatctgagactgggtaatttaaaacctaggtgatttaaacctgttttaaagaaaacaataacacagggacacagagaggggaacatcacacactggggcctgtcgggggttcgggggctagggaagggatagcattaggagaaatacctaatgtagattacgggttcatgggtgcagcaaaccaccatggcacatatatacctatgtaacaaacctgcatgttctgcacatgtatccaagaacttaatgtatcatttaaaaaaagaaaaataaataaataaacaaataaatgctgaaaaaaaagaaaagatgtttaattgggtcatagttctgcaggttctccaggaagcataatgccagcacctgcttctggggaggcctcaggaaacttacaaaatggtggaaagtgaagggggagcaggcacatcacatggtgaaagcaggagcaagtgagagagagaattgaggagggaggtgccaccatttttaaatgactagatctcataaaaactcacaatcgtaaagacagcaccaagccatgagagatgcgcccccatgatcaaaacacaaaacacctcccaccaggtccccctccagcactggggaatacatttcaacatgagatttgggtggggacaaatacccaaactatattattctgccctggaccaccccaaattttatgtccttctcccattgcaaaatacaatcattccttcccccaaattcccaaaagtcttaacttattctagcattaactcaaaagtctgaagtcttatctgagacaaggcaaatcccttccacctatgacaggttagttacttccaagatacaataggggcattgtacaaacaggcgttggataaacattcccattccaaaaggaagaaattagtcaaaataaaagctctacaggccccacacaagtttaaaacttagcagggcagtcataaaatcttaatgctccaaaataatctcctttgactccatggcccacatccagagcacgctggtgcaaggggttaggttcacaaggccttgggcagttccacgtctgtggctttacagggtttagtccctgagactgctgtcacaggttgttgaatgcatgtagcttttccatgtgcaaggtagaagttgctggtggatctactcttctggtgtctggaggatggtgaccctttgtcacatctccactaggcagtgccccagtggggactgtgtaggtgggctcccacccatgtttcccctctgcccttccctagtagaggttctctgtggaggctccacccctgcagcaggcttctgtctgggcacccaagctttcccatacagcctctgaaatcaagtaagaggctaccaagcctcataactcttgcattccatggacctgcaggcttaacaccacatagaagtcaccgaggattatggcttgcactctctgaagcagcaactcaagcaagctgtgtctggggccctttgagctaaggctggagctggagtgacctggatgcagggagcagtgtcccaagtctgcacaaagcaacagggccctaggccctgcccacaaaaccactattttctcctagacctttgggcctgtgatgggaggggttttctagaagatttctaaaattcctttgaggccttttcccattgtgctggatattagcacttggctcccttttagttatgcacatatctctagcaagtggttgctccacagcctgcttgaatttggctccccaaaaagcctttccttttttgccatgtggccaggctgcaaattttccaaacttttacactctgcttcccttttaaatataagttccaaatttaggtcatttctttgctcttgcctctgaacataggcagttagaagcagccctggtatatcttgaacaatttgctgcttagaaatttcttctaccagatacctaaattatcactatgaagttcacacttccacagatccctagggcagaggcacaatgcagccaagttcatgcatgagtcacctttgctccagttcccaataagttcctcatttccatctgagaccgtgtcagcctggacttcattttctgtatcactattggcattttagtcacaaccatgtaacactaagcaattccaaactttccctcatctttctgtcttcttctgagtcctccaaactcttccaccctctgtctgtcattcagtttcaaagccactttcgcattttcacgtgtctttgtagcaatgccccactctcagtaccaattttctatattaggctctttttgcattgctataaatacctgagactgggtaatttataaagaaaagaagtttaattggctcacggttatgcagactggacagtaagcatagtgcccgcttctgcttctggggttgcctcagaaagtttacaatcatggagaaaggtgaagggagagcaagcactccacatggtgaaagcagaagtaagcaaaagagagagagaagtgtctggggggaaagagagatgccacacacttttatatgaccagaccttgcaagaactggtcgtggtcatgaagacagcaccaagccatgagagatctgtctgcatgatccaaaccacctggccccacggcaaccccaccttcagcattagggattacaactcaacgtgagatttgggcagggatagatatccaaactgtatcacagattaacaggagaaagtgtatatgcatttatcaagtgcattttcttttataggaaagaaaagtgaatactcaagaaaccagttagacttaaaagcttattaccctctctttataagggagaagagagtggggatgcagacaagttagggggtataaatgatttgggggaagatgatggggtccatagaagaagaggtgacagtctgtgacaaagtttgtctgggtgtggcatgaacttccagttaccccttctgggatatgagttaatctctggttgataaaactggaggatggcaggggtatcaatgacaattaagaagttctttttggaggatctgtccctaggcagataagaggatcccaggagaaagactctgcctgcatctgttgtcccacagaaactccagtttaatgtaatcagctaccaaagtggcatattttggggtggcatttcctgaacattttcaggaacaatatgtagccgcagaccttaaacaatggtctggctgtattccaataaaacttcatttacagaaacaactcaatactcagatttggccctcaggctgcagttttctgaccccagtgtttgttagtgaaaaaggaagatacggtgaagatctctacctatcacagaacggtgagaagagtagtaggaaatactttagagagagggccagatgttagatgtatcaatctgcttaccatacagattatgcaaattattctaattgcaatggaaagaaactggagagttttaagcaaagagtgacatgttttggctttgttttaaaagagggctgcgtgtagtgggtcacacctgtaatccgagcactttgggaggctgaggccagcagatcacttgaggccatgagttcaagaccagcttggccaacatagtgaaacccctagtgaacattttgctgcttagacatttctctactgaaaaaaaaaatacaaaaaattagctgagtgtggtggcacatgcctgttgtcccagctacgaggttgaggtatgagaattccttgaatctgttaggcagaggttgcagtgtgccaaaattatgccactgcactccagcctgggcaacagagcaagactctgtctcaaaagaaaagaatagaaaatagactgacgtgtaggaagggcaaaaataggagacctcttaggaagttgttgccatggcctactgaagacagtggttttgacaacagtgagaattgagtagatttaatatctacttagaagtgaactaaagggcttgctggtagttgacatgatgatttaagggagagtcatgagaccatatgcttgcatatcggatactttttttttttttgagaaggagtcttgctgtgttacccaggctggagtgcagtagcactatctcggctcactgcaagctccacctcgcaggttcacaccattctcctgcctcagtctcccaagtagctgggattacaggcacccgccaccacgcccagctaattttttttactttttttagtagagatgtggtttcaccatgttggccaggctggtctcgtactcctgacctcagatgatccacccaccttggcctcccaaagtgctggaattacaggcgtgagtcaccacgcctggccagaatactttttaaaaaggtacatgtaattaaattttcactgatttttgttgttgatattgttcaagcaacagaaattatccctggttaacaccagcagaagaaaacattattggaaagataacagtttggcttatagcatcaaatataagaagatacaatctgatttgagcagaaacaagaggaaaggcaaaataacaatcctgtctcagagactgcctcgtagggagctgtgacttgcctctctctttcaacacctagatgtacaccacctcaccactggcctcttgactgcctgccattcccttaaataacaggagtcagtaactctgcgtcgcttcctcaagattcagcctagttcgtgaagttctgattggccactcctagatcatgtggccctgccgcacatgaagggtgagaaagcactgtaatgagaggtggcttctgataccttctctggcctcatcctaatcccagtcatgatcatctcttacctcattgttgaaacagctttctggtttacctccctccttctgctcttaaatttcccccaactgattttccaatggacagccggcatgatcttgttcaaatgcaaaagttatcatgcaatgcccttggttcagatatttcaacagctttcactgttcttgggagaaatatccaaatctttacctacgagatattttatgctctggctctctctttctagcctcaattctccctcatttcaacccatgcccacactcaggtctttggaaagcatgtcctatgcacctttgaaaagatattgaaaagataacagtttagcttatagcatcaaatataagaagatagaatctgatttgagcagaaacgagaggcaagaaacctttgcatgagtcatgcagcctttgcaaatattgttttctctgcctgggaaacatttttgcttcctcttcttattgagttaattcctcttcctctttcagattatagcttggacatatatctctcccagactagataaggccctgtatgataagctatcagaggagagagatttattgaagttaagggataaggatgactataaataaaagagagcttcccaggtgctagctattatgcgctttcattttatgtcatttattcctcataaaaacattttgagacaaattgactattgtccccatgatttcaataaatacaatgaggcttacagatgctgattccatgcagctaagatgtggcaaaaaaaaaaattataataatgagaatccaagtctttgatcttcatattcctgccctttgactattctgctgttagaccacattctggagcttggactgtaaccacggtagcagaaggagagatacttacatttcaggtttagaaatgattgctctggatgaaagaggcaataaatgagttgaaaggctgttatgtaaaccaggtgaagccaggtgagagatcaggaaagcctgcattcaatgataaaatgcagatgcgttcctgtaatgataacttcttatggaaaccaggtcttaaaattagcttagaaagagggaggctgcagccaaatcacacctatcaatagtgctctcacttaacaaccagatagtgactgtacctcaaacaaacaaaataagatagggagcaaggtctgagttgagagcattttaacctaaggctcggaatgaagagctcactctgaacttgaatgtcaggccctaggccaaaccttcttggatggccctggttcaatagtaacctccctccttgctccaggcccttctccatagtatcactttcttttgtgtcctccatgatagttactgctatcagagattgttcctttgtatggttttcatgtttgttgatacccgcctctccaatgtaaactgcaattctgttttccggtgcctaaaagtggatgggtctgtcacatagtaggaactcattttttaaaaaaaaactgaatgaaaagaaaacaagaatgaaaataattagtagcaactactcccaaggggaatgtagaggctgttgggggaagtggtttccttatacaatgaaaggaggctgagctgtggtcttttacaggaacatcagatctcgtgttatctgacttctttgccaacccagatccagctcaaggtaaaaatctaagcaacttgggctaacatccaaccaagacagggatgggcaggctgattttcaagataagaataagagaaagtttcagaaccgtcttagtaaaacatgtacacacaatttaagacaaagaataagcatgataatcaccttgtggatttctttagcctgttaactttgctaatcttgtcagtcctgtctcctttaggctcgttcctaaagtaatacatagcaaaggagtaagcagtgataaaatttttaaactgagttgaatagatgggtgtgtgtttgtgtgtgtgtgtgtgtgtgtgtgttcagatatgggtgttgacaacaaggagcaggggatctcccatgtagtgatggttgtaaaaagaaaggaaagttggctgggcacagtggctcacatctgtaatccaacactttgggaggccgaggctggaggattgcttgaggtcaggagttcaagaccagcctgggcaacacagcgggaccctatctctaaaaataaataaaaaattagccagccatagtggcacacatctaccgtcccagctacttacttgggaggctgaggtgggaagatggcttcagctcatgagatcaaggctgcagtgagctcggatcatgccactgcactccagcttaggtgacagagcaagatcctgtttcaaagaaaaaaaaaaaaaggagaggaaagaaataaaagtcaccttgtccctggggctttgaggaactagtgaaaggacagaaaagtggcccaggttgctttgtggtaggaaacagtggcactattcctgagcttagatagaaatatatactgggaaccacaggctctctgccagtgtcctgccagtggagcaccctttgagagagtgaaagcaagtgttctgatattctacagaggatgaaactcagttctcatggtgttactggaaaaggctcctggtccagaccccaagtgagggttcttggatcttgcgcaagaaagaattcggggccagtccacagagtaaagtgaaaaaaagttaattaagaaaacaaaggaatgggccaggtgccgtggctcacgcctgtaatcccagcactttgggaggccaaggagggtggatcacgaggtcaagagatcgagaccatcctggccaacatggtgaaaccccatctctactaaaaatacaaaagaaattagctgggcgtgctggcaggcacttgtagtctcagctactcgggaggctgaggcaggagaattgcttgaacccgggaggtagaggttgcagtgagccgagatcgcaccactgtgctccagcctggaggcagagcaagtttccgtctcaaaaaaaaaaagaaaaatagaaaacagaggaatgaaagaataaagaatagctactctatagacggggcagagcattcccaaaagcaagaggaggaacatgcccaccttgggtgcaatgcttttatatatataagataacaaagcaaaaaaatcatgggggagatgtgctttactacaagagcttttgacaaataattgttaattcttgtgtaactacagtcttctgcaagaatttatattattatctttaaagtgaaactgattcttagtttaagaatgcttttgttcttaagatatcaggacatcaggacatttcctgggtctgttaggtcgtaggtctgttcagtaaacacgattaacttattctcttaactgtaaatatcctgttaactaagaatgcctaacctcctggggaataaaacccagcaggtctgagcttcattttacccagctcctactccaagatggagtccccctggtttgaatgcctttgacaatggggttcagattcaaacaataattattgaatgactcttgtgtgcctggcacattaaaaggtggcttcccattcattatctcattcaaacttcacagtactttggtgacataggtatcataaccttatttcatgaattagtaccatgaggctcagagaaaagttatttccacaagatgcccaggaagttgagggcagacctggaactggggtccgcctcctgattcgggccctctctgcaataccgaaaaccattttattttagactatttattagattggtgcaaaatcattgtgattttaagttttgcaccaacctaatattaagggaatttgatttctaaactcggtaacttaaaattataatttatattgttttggtgcaatcctgacatccagaaccatggagaaacgtaatcccagattctacatttcttctacttctttataaaacagcatttggggagaggtaggatttataatcagatgtagatactacttaaggaaaaactgggctagaaacaggatctccagataacgttactagtgatgctgatacactggatttcttcccagctccagctttcatttagttgtttgctcataacatattataacccctttctatagtaaactggcacaaggttttcttaaattgattcaggaggataaattgtaaagttatatcaggagaggggtaaaatccacattcaccaaaatggaggattagggttaggggttagagctgagagggagaagagatcagaaagggaagaaaaggtgtaggacaccctgctctggggatgagaagggaagctgagaatgccattgacttgtcaccaaaggagaaactgaagttagagagtcagggagtatttggagaagcgtggacagttatctagtaggttctgggtaaagcaagagttcagtggccgaatgaagagctccacctaagcgggtctgaatgtcttaggaggattccaggcctcaggctcctgcataattctacggcaagggcaagaagttgtaaaacaggttttgagcaaaatagccacatagactaatttggcctggcattgtcctaactcttaatacctctctctctctgctcctcagcacccaaagcccacccatatgtaccaaccaactgcaccttcctctaccggcctactcttcatctaccctgggtcccatcctcccgtctcctcctcctcctccctcagagctccacctaagcctgtcttcaaaggcaatgacctgcatacagaattaggccatctcttctactctccaccccatcagctctcaaatttccaccaaaacttatctcatcttatagttgtcaggaaagcaacttgaataatgatgacttcatgtgttaactacctcaggtcctttacatggtaaagaaggcactcattacctcaaacaccacagacattcagaattgtgttttctgaagaaattttagaccttttttgtggtgcatctcaaagtatacaaagcacacacttcatattaacatatcatgttaagtagatgctagaggaaagatccagttttatcaccagtgtcttaaccactgtgttgtaccctcggcatgagcttacctttgaagagcaatctacaagaggagtttacctggtaagtcgctgaatttgagaggaggtggcaaaatggcagaggaattgcttcaaaatggatgagtctgattgagacgcttttgtatactggaaacggggacaaataagcaggatgtgcatttgttatgttgagaatgttccttgctgtgtttatagcttatttgaaatgtactaaattattaaaagtttctccttaaatacaaagatttagaaagctgaggcctaaaagtagatcctactggtcacagtagattaagaaatgtttctgtatctgagcttaagacaatgagtaagatacgagaaaagtggttatcagggttggggttactgacccttctaacttcccctctctcagacctcctcgtgggatgaagtaaatcagggagtctctcgctgctttcctcagtgtctgtgggtatttaataaacgttgatggaaacgcttcaccaacctgagtgcattgcctctcttctctagcctcatctataaaagaactctaagtcatttctaagccaagaaacggctgtgcttttactacctttgtcattattatatgtcagaatagaccttacctgattcagcgttttccttcgaacttcatattctacagctttgtaatgatagttgatagtaattttcatttgcaataaaaaaataaaagtttaaaccaatgaaatagctgcaagcctgctgtatcggttcgaaccccaagagcgcggtaacaaacaccacaaggcggtgtggagcaacacgctgttctaatgagcgcctgggtacagacgggctgaggtctacaatggcgtcagcaccaaatgagtatgcggcaggggtttataaagtctcctgtaaacaggaagtgtctcagtctgatgtaactgctacgcagtacgcggacggcctctctttccgtcttcagcgggtacgtgtcttccgggcagccctcttcctgcttctgctatcttgctgacgcaggctgctgactcaagtggtcttgagccttgggactgggcctgagaagggaggagttattcaccctccaccccgcagcttccaggcccagtggaaagtctttcaatagccaccatcagtttctacggagcaacatgtaaaaaattacaaaagtaggaacattgcaaatgctttctcatggcggaattaatggcgacaagaaaattacgaaagcatcgaagcacttttaaggctgagttttaatcctaagaaacacaaatgctaaatataaaattccagtcaatcaacaagtgctagcctcgattatttaatggtaaacagttgggaaaaagctcaaattaacacgaaatactaaataagagactaataaatatttcatctagttagtgtgacaaaaaggcctccataaacttctttgctcattgggtaggctgagaaatgggtcagattggatatggtttatttggttacaattgatcatttggcctaaagacaactgtcttttaaaaaatgcgttatttatatcgttggagagtcaagaaaaggatgagtgtatagacctaaacagaatctgaatgcttgcctttggctaagttgaagttaatgatcacaataatgaaccacatcaggaaacatggtgagcttggggccgaattttcagttgtaacttgtacctctcaaattgttacattattcaacaatacattttccacacactcaaatttgttcacttgtaacttgtattaattgaaaattcattcactttggaaggtgttttgaaagaggcttgtgtatagcagttgctggtacccctggaattcaaaatgatgccaactgaatgccatttcaaataaaacctttcatttatttatttatttatttatttatttatttatttatttattttttggcagaagaaaagagcagagtcacacagtagctctcgatttatgaacagtgttttctaactctcagactcccaccgtgtgtgtagttcccttgaaggaactaggttggacacatttaacaagaaaataattgtatctctatatctgctttttaatttgaaatcatatggacctttgattatacttcatcccattctcatgcctcctatgaccagttgagagggtggacactgagaatcctacagcagcttcttctgtttgtaaaatattgttcaatgacaagtcagacagatagaaacctccaaagcatggtggctattgtggacaaaatttgtgaaaatattttacattggaccttccagtaagcattttcgcagccctaggtcacatcttgaaattatacaattggatccccccaaattgggttgaagtgctgacaaacgagaggatgtaacagatcaaaactgatctggatgatgggtgagtgaagtgcaggcagatagaggacagagataaacccatacatgccttacgggagtttgtggctttaagtggagtccatccttgtaagtggtgcattaaacaaagagtttattgtaaagtgggcctgatccctggaggaaaagaaaattgattctttttcactggagggaagttaactctttctgtccttttgcagcagagaaggtgctgaacacatatttagtgatgaatttccctggttagttccaaggggtctttatgtcaggaatagtatttattcatactgcattttctatgtaatagagaggcaggattccctaaagtcccccgttataatcccttcatcccatctagcacaggtagactgtgaaaaacacatattctaatagttactaagctgttaaaattggctacaatacttttatttttgtttgttttgcacaggagtaactcaagatgattttgatgttgcagttttaaatttcactttgacttgagctgggaaatcctttggcctattataccatggatgctaaaaatggtaagagctgcatgttctgccttgatgttttcaagactgaatttggagggagaaaaattattttgcctaaggatgtccgtgaaagtatcaggaaaacactgaaaagccggagagaagggttcaattgtagcgtgctccctttaagagggaaacgagattagcaactttggcaaatttttgggactctattcagagggaaagagaagagctgccagtgtcaaaaaaaaaaaaaaagaaagaaagaaaagaaaaaaaaaaggatgaatgttatgagacaaagacagaggcaattttacacctttctgaaagcttacctgggagtagttttaggtccactgaggttaagaaagatgcatttttttttcttttctttcaagactaaaggtggagttagggggaaatgagtttaatgtgaagtagtactcctgtcagttctgtttgtcctgggaagtatacaaggaagaaaagcctccgtggaagagagagcaagcaccaggtgctgaaggtgagggattacctattacactaacaattatgaaagttacattatgatatgaaagtagaaactctttattgcatccttcttttaaggaaaaacctgatttaaacagttaggaagcttatgactgctagacacatatctgaattgaattttgccttttcatattagcaattactttgttttctaaatgccctcatgcaagaatagtttacaaaaataaagcagatttttttttatatcaggtcagaaaagttagtgaggcatcatttgggataatcacagtgtttacccaagccttattcatatataaaaatgttattttctctaattgcatattttgcctctataatgactggttaaattctaaactgaaatgagtaatcaatactgtgcacctaatgttcagatgaagtcgtagctattttagatggtatgacactgctccaaatttggcaaattgctataaagatggacattgaaagctaaaaagtgtgtttttgttgttgttgttttttaggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttccctttttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctactgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaactgtgtgcatatacctatattttcagtggtataagttctctttgctgatgtggtcagaattgggtacagtgcaccaaaaataagaatgctgcttcatagaaagagaacataggcagcattgtaaagcatttttatgggttttttaacagcttgtacaacaggtatatctgaagtaaaaattagttgcttctgtaagtatcacaagcaggttctatgtaaaatggcaattctagtttcaaatgccctgccaataacgagaagttggttgaatattttttcttatgccatccactttttcccccaaaatgaaattattcaatgaagttaaatagatttaaaatgaattgtggcatcaaggtattgctctaccatgtgctatagtttctgaagggggccctggagaagtgagtaagactaaggagagagaagaaaatattattttcatgtgccaccagattagtgagtattatcaagtgattgatgcatggatttaatccccacaataacatagtaaggtggattttttaaatttccatttcatcgactctcccatcatcttcttttccctaacaaattcctaattggaaaacaatgtgttcgggtttataaaaaaaaaaaatacagctgtatttccagtcccgatgcaggttgctggagggtagggttaactggcatagttctggcacataagatgttagcaggaatctatgggtgcggcttttatgaaagcttttaagctgacttggctggctcatgccctgttcctctccctgctcacctttctctccatctggacctctaacttggtagcttatgctcttgaagccaccttgtaagaatgcaaatcaaggacaccccctacaagggaaaatagaaaggtaagaaagactgcagccctagattgcacatctccagacgtctttttcataagtgaaaataaatatgatttctaattgacacagcaatatatctaagggaaattatccaggaaacaagcctggtttaaaaaaaaaaaaaacgatgcacagcttaggtccaacttgtacttgtccatgacagttgatggagttgatcactgtggaaacagctagctttctttcttgcttttttctttctttctttcttttttttttttttttgagacagtcttgctctgttgcccaggctagagtgcagtgtcatgatctcagctcactgcaacctctgcctcctaggttcaagccattgtcctgcctcagcctccccagtagctgggattacaggcctgcaccacacccagctaatttttgtatttttagtagagacagcgtttcaccatgttggccaggctggtctcgaactcctgacctcatactttcaaaggagttgaggacatgccactatcgtaagacacacacacaaaggattgcttttggcctggaaatccctctgagatgctggtggtggagtgaccttgataaaaggattaaccaggcccactgctcttttgcttctttcttccccccaacataaaatccacagaaacctggataaagcaggcactgtacaacttgggcaaaaaataaaactgctaatactgtctcagaccctctatccctcaccaagaccaaacttcatccatttagaatatttgagaggatttttaatacacacaaaggaatccagatttttctttaaatatttgtatttcatcatttctgagtgggccaggacatgtgctgagtggattctctgggccacttttatgtaaatttttaggcaccagattctactcagtttaatatattctatctattagtctcatcagttacaagccttgattcttctgttctgaatgttctgtaaggcgtgtgcaaagtcctgtgtcttttaaggtaagacttgcctgtggatatctagaaaccacgcctattcaccctgcgtactctataaatcacaaagccctgactcaattctaaaatcagcgtggcctctctctctctctcactttcattt

SEQ ID NO: 12805 - DNA, 421491 bp, Human
  misc_feature (1)...(421491): n = A,T,C or G
ctcaacatcactgattatcagataaatgcaaatcaaaaccacaatgaaataccacctaacaccggtcagaatggctattactaaaaagtcaaaaaataacagatgctggagaagttgtggagaaaaaggaacacttttacactgttggtgggagtgtaaattagttcagctattgtggaagacagtgtggtgattcctcaaagacccaaagacagaaatattgtttgacccaacaatcgtatgactgggtatacacccaaaggaatataaataattctattataaagacacatgcacacacatgttcactgcagcactattcacaacggcaaatatatggaatcaatctaaatgcccatcaatgataggctggataaaaaaatatggtacatatataccatagaatactatgcagccataaaaaagaatgagatcatgtcttttgcagggacatggatggagctggaggccattattcttagcaaactaacacaagaacagaaaaccaaacactgcatgttctcacttataagtgggagataaatgatgagaacacatggacgcatagaggggaacagcacacactggtgccttttggagggcggagggtaggagaagggcgaggatcaagaaaaacaactaatgagcactaggcttaatacctgggtgacaaaatactctgtacaacaaacacccatgacacaagtttacctatgtaacaaactgaacttaaaagttaaaaaaaaaaaagaggttcttattatgttgcccaggctgatctcaaacttctggactcaagtgaacttccaccttggcctcccaaagtgcctggccttagatattcatacatttatttatttttagagatgtggtgggggtgtggggggtctctctctgtcacctgggctggagtgcagtggccccatcatagctcactgaagccttgaactcctggactcaagcaatcctcccacctaagcctgccgagtagctgggactacaggagtgcactaccatgccgggcaaacacactgattttaagtacaactgtgtgctttcagtcttaagatcttcagcttttgaaggacctcagccttcctctagttctaactcctctcgttctaaggagatccttcccattcctgcagaacgtctccccaacccttcttcttcacagttctccctcctatccctgaaccattgcaagaggttttgtgccaagcctctggcacatggcacattctatctcatgttgtgatttcgttttctatgcacgtgctctccttctagcctggaggtgagctgcttaagggcaaagagctcatgtgtagcccttccttgtacccattgtcctatagcaggtgctacctagggggtgctccagtagcttccttgaatgaaccaaagagaaggggtgaaggggggagtcagttgcctaggagcttgcatggacttctgtgtcctggaaccagcccggagctgctggaagatgctagaagttggaatcctatctcatttctaaacatctgctcccactcatctctttccagggtcatcagttatccccactcctcccccccgcccccactttgtataaatgagcccctcacatccctccatcttctccatcactgtgtggtcacttcttaaatcatgcgtctggaaggcgccctcctgtaccccatcctggaggcttcctgcacttcccctcttgtttcttccagaaatgagtcagagtgaaagcaaactttctgaggtcctgagatccccgagacaggctgtgagggccgctggccccgcccgctccagcagcgtgtgtgtgtatgtctgtgtgtgtgtgtgtgtgtgtgtgcgcgcgcgcgcgcgcgcgtcaggggccaatgctggaaaggaaacagcggactcgctgaggagaagaaaggagccgcccccttcgtcgccagccccctccccacttcccgtccagcgcgctgctcccttccccccgcctctggcctcggggaaggagcaggaggcagcccaggcggagcgggaggagctggcagcggggcgcatgccaggcgggggtcctcagggcgccccagccgccgccggcggcggcggcgtgagccaccgcgcaggtaggggagctgccacagagtcctagcacgtcctgggggggtcctggcaaggagggcgcgctctggcccccaggaagtcgcgtaggtcagggcgtgcctctgttaacaacccctttcgaggtgagggaaactgaggcaggacgcgaggcgtgcgaggttgagagaagagcgagtcttgggctgccagcccggcaccagcgccgagccgggccaggtccctgacccaggactgtgcagcgatccccgggacccgcagtttgcgaaactgtaggagtctgacccgcgcccccgctgcgtgtccaggtgaccgggaaaggttgcaggggcgtgcttggggtttggatccgtccccgtcctgggacacctgcgccgcctgcactctcgttgcggtgcgccccagcctgcgccccctcgggacaggggacgtcccgcccgccttaaccccaagacccagctggatctcgggttccaccccttcggggacctggagggaggaggctgggagcgggaccaggaactggtgcctgtgccttccctaggggctgctctgaaatcagtgtcaccgcccacttcctacttggctacagtaacggggatggcccaagccggagactgctcggtttccaccgcctggagcgcgggtctcgctgtcaactcttagtgatgattgtggatggttgtttttcaacaatgacaggacttctaccttctcactcttaaaatgtgaggttttccaaagacagtgagatttggagttagggagtgctgccttgtgttcttgctgggtgaggacagggctgggtcagtcgcttaacctctcagagcctcagtctcctgaaatgtaaaggagaacactcatagcctggcctccatgtgtcgttaggtttgttgtatgggaaatcaatttgcaaagtgttatcatcaactggacaaatttgaattggacagcactaggaccataggaactggggtttggagacagtctgcctgcatgtcaatcctggacatgcaggagactatgacagtacctgcttcatagggttgttatgcggtttaactgtgatggtggaagtgaagcacctcgcccaatgcctgaaatacccagtgcactctcaaaaaaccttagttgctatttttcctaggcaaaatctaaataattgggagtaatgtgagaataccagtttgatttgattaatgcaggaatagtagggcatttaaaaacacatgtagttctcctgtgctcggcatggtacatgaagtcctctgaggttcagttctgtgccacagagcaaaaagaaccgtggacaagatacccgcttttcgggctctttgactttgagcctgttttctcatctgtttacaaaaaagataaaagaaaaatgggggtagtaattactgccttttgtactgatcgcattgcctgaggattaaatgaggcaaaagatctgaaagcaccttgtggagtatgagtcactatgcacatataagacatgatagtactaggagggaatggtaacatctgcaggtttttagaacttacaatgtgccagacattttattatgaattcctttgatgaaatcctccctgcatctttatgggactgggattacagtcctcatttccctatgacaaagctgaggttcagggtcaccctgcttggttcccaagctcacagagctcttaagtgtaaagccaggattagaaccctggtgtgggtgccactcacaactgtgttcttggccgcttgccaaactgaacttatagagtggagctgtgattcagaacagacctatattagaatttaggtaatttttttttctttaggagacagagtcttgctctgtcacccaggatggagtgcagtggcacaatcatggctcactgtagccttgaactcctgggctcaagagatcctcctgttccagctttttgagtagttgggattacaggcgcatgccaccatgcccagctaatttttttttttagagttggagtcttgctatgttgctcaggctggtctcgacctcctggcttcaatcattcctcccactttggcctcccaaagcgctaggattacaggcatgagccaccaggcccaacctccatcctgcatatctatagacccaaaatgtaagagtgaactgttaatcctggcaaaagaggctttggcataattttaatttccctcagacttattttataaaatatactttaaactatcttcttgtaaaacaaatgatgacaatttgcagaaaagttattaaaacattgaaagaacaggttgcaagatctcatcacaaatctctaagtggtatctggattgttttgttttgtttcaacactcatttgccagaacccttaggatagcacatgaggtgtaaccggaaatcgaggcgttgggtgtcatggttactttgcagggctgggccccgggacttttctgcaggaagttcattgctcacccaagatgcctccagaagaaagcagaaacttccgagaggagcgtgaatgctctgtttctgtgctgcagaaacaattcctagtttatttgtttcctaaattaagtttatcttattggtttttgtttttccaaaagcaatgcatgctcattacaggaagcacagaaagctacaaacaagtaagtgaacactaaaaaatactgtaatctcaccaaggtagacaaatagcttggtgtctctgtccttgtaacccatttctatgctgcatgcatccatccaaaagtgagaggcaaactattattgttttttgttaaatgacaaaaatagtacttgctaattgctcaaacattatgacattaatgtagaacaaagccaatttattatgctcattaaaactttttctttttttaaaatctaaaaattttgattggagaaggattagagactaaattgttgatatttgaattttattgtggttttggttaaagtttgatgcaggaccttcagagcaaagagagggtacaatggtgacctttaaacaatatatatattttttgagacggagtctcgttctgtcgccaggctggagtgcagtggcacgatctcggctcactgcaacctctgcctcctgggttcaagcgattctcctgcctcagcctctcgagtagtgggattacaggcgcccaccaccacatccagctaatttttgtatttttaatacagacagggtttcaccatgttgatcagcatggtctcgatctcctgaccttgtaatctgcccgcctcagcctcccaaagtgctgggattacaggcatgagccactgcgccgggccctttaaacaagatttaaagaccagcacacaaagtttctgagtacaaaaataggtaatattttaggttagggtcattagaccagaattagaatcattctttttttttctttttttaattaaaaaagatggggtctccttattttggccagattgaccttgagcctcaagcaacttctgcctcgacctcccaaagtaccaggattacagatgtgaaccattgcacctggccagaatcattcttttgataataatgatggtaattgagtttatatgctgtgttctcatgaatccaagcagagcccactgtttccagagattcccttggcagccaccctgggttgaggagggtcccctcctggcacagctggaaccaccggtgaagagccatttttcagtcagcaccgtttagtaatataagacttttagcctcgaggagtcttccgttgttagttcctaactttaatgactttgtggtaaaaattccttagcgaatgacttctgtgcaacaatcatgtaatttttaaaattccagatgctttagccgttcagaatccattttttctttcaaaaccagagttcaccagctgtttctcttgagcgaagactttgcaatgagctttcaaatgttcacaccaagtagaagcaggaagggagaactgtggctgggcaatgaatgaaatactgacatttagctgtagaaggtaggcaggggctcacatggtgtgcacagccccttatatgactactggtcctgtatctgcttcctttccctgccccatttcccctttggctttttgtcatgactcagaaatggatgctagacattatggggctccctccagtcactcgggtcactcgtcacagacttataaacagaatcacagaacttattgtcagatgaagcttcaaaacaccagttggctaaactccttgtgttctggcaggtaagatgtcggcatccttatttaacaaatgatgctactgagaactatgtatgcagagacatagtctcaaaataagtgcagtcatgcctcgcataatgacgttttgtcaatgtcacatatgtgagagtggtcccataagattatactgggctgtcaatttcctaatgcctagtatttactatacattttaatgttattttgtgtacttctacttagtaaaaaaaagttaactgtaaacccgcctcaggcaggtccttcaggaggtatcagaagaaggcattgttgtcataggagatgatggctccatgcgtgtttttgccttgaaggccttccaacgggacaaggtgtggaggtggaaggcagggatagtgatgatcctgaccctgggtaggcccaggctagtgtgtgtgtttgtgtcttagtttttaacaaaaagtttgaaaagtaaaaaaataaaaattaaaaataggagcttataggataataaggatataaagaaaaaatatttttgtacagctgcacaatgtatttgtgttttaagctgtgtttttataaaaaagtcaaaaaattaaaaaaatttaaaaattattatatataaagtaaaaaaagttatggtacgctaaagataatttattgttgagaaaaaaatttaaatgaatttagtatagcctaagtgtacagcgtttataaatacagtagcatgaaattatgtcctcaaccctcacgtgcactcaccactcactcactgactcacccagagcaacttccagtcctgcaagctccatgcatgataagcctcctatagaggtgtaccatttttcatcttttatagtgtatttttactgtaccttgtctatgtttagatatgtttagatggaaaagtacttaccattgtgttacggctgcctacagtattcagtacagtaacatgctgcacaggtttgtagcctaggaacagtagctatacaatatagcttaggtgtgtcatagcctataccatctaggtttttgtgagtacactctatggtgtttgcatgacaaaatgacctaatgacacatttctcagaaagtgtccctgtcaataagtgatgcatgactgtgattgaaataagtagccccacattatttttctcatgtcaacttcaggttaattttccagccacgtggccttgtgcttgctcatcataaaaaaatgtggataaaattctacctgttaagccacaacatttgcctgtcatgggtggacatttaccgtttattttcagagttcaaagtttgaactctcagagaaatgcaaataagacagtaaactcctcgaggtgaggaatggcaatctctgaagataaatcatatatttattgtacagtattgaatgttgtaagtggcagtagagatcatgtaatctggccttcttcttttacaggtgagaaaagtgagaaacagcagcagagtgattgttagaacctggctcctcttcttttacttagaactgttttcattaagttgtgtttcatttcatagttctgtataattcatccctgcttaagatacattaaatgaattgaactgaatcccttttttttgagctatgatggctcttaaaaacttagattttcagccaggcgcagtggctcatgcctgtaattccagcagtttgggaggccaaggtgggcagatgacctgaggtcaggagttcgagaccatcctggccaacatggcagaaacccatctctacttaaaatacaaaaatcagctgagcatggtggcgtgtgcctgtaatcccagctacttgggaggctgaggctggagaatcgcttgaacctgggaggcagaggttgcagtgagccaagatcatgtcactgcactccagcctgggctacagagagagactccgtcaaaaaaacaaacaaacaaaaaaccacgtagattttcaagtaattactattgttacactaaatgtcaatggatccttaagaatctatttgttcatgaattcattatttattcattcaacgtttattgagtggctacttggttcagaattagaattagcatgacagccacacattagaaaggtatcactttttgactaaattaaaaacttgctaaaaatagttatccattgatggaataggctaccccgaaaggcagagagcattttgtcattggaagtatgtagggcagtgtggatgactctagggtgactgtcatgagggttctgcactggggagggggctgcgttggatgatgaatgggaacccttccagtgctaagatgctgtgatcgttgtcctgcaggattgggattgtgcaggatttgagctactgtgtaaatttcctattccctgctcattgggcttccacattttgcttccttcccttgcccaggtggttccatttcaggaagcctagatagcttctttgcagtcatctgcccgaatgtcgtagctactttaactccccagagctgtacatgtctaggattgatattgatcattaacacaattatgttcgcccagatgaacaaatctaccaggagtagaaacgtgcatttgacaggtggccttgcatggagactaatcgctttcacaggttgaaaggtgaaatatctaaagtttaatgagtaagttgtgtcctgaatgtggaatctgagttgaaattgcattttgtgacatgtacgcctacctaacttttctttttcatacctgtcatctttttttttttttttttgaaacggagtcttgctctgtagcccaggctggagtgcagtggcgcagtcttggctcactgcaacctccgcctcccaggttcaagcaattcttctgcctcagcctcccaagtacctgggattacaggcatgccccaccacgtgcagctaatttttgtatttttagtagagacagagtttcaccatgtcggccaggctggtcttgagctcctaaactcaagtgatccgcctgcctcggcttctcaaagtgctgggattacaggagtgagccaccgcgcctggcctgtacctgtcatctcttggtttgtgagtggattgattattggactttatttttaacacaggagaatgtgcgtgttttgcatttgtagtgaaagcatgcctcatcttactccaacactgataggaaaaggaagattattttacaatggtcaagtgaaaaaaaaagtaaatacagagataaaacggggttctaatatttctgctacactggaaacttagagttgcaagagctgttttgggatcacaaatcttctgaagaaaaaaagtttgcgtatttcagtacaagtcttaatgtttccctagcgtcttgtgttatagctgcaggccaagcaaaatgaaatgtgagacactgtccttggggatagagcatctgtattcaatttaaacagtagatttgggggccttaaattgcctcgactctattaatcattttgtgttccttagtttatagaattatctcctagagacattaacttatccattaatttcttccattgtgtttatttattcattcacaaacactagcacctactgtatacacagtacagtgttgtacattgcagggtacttaaaaatgtagagtgccaggcatggtggtgcatgcctatagtcccagctccttggaaggctggggcgggaggattgcttgaggccaggagttcaaggtggcagtgcgctatgcttgtgcctacaaatagccactgcactccagcctggacaacatagcaagaccctgtctcaaaaaaaaaatgaaaaaactcccccaaaaccaaaaatgtagattgttctcaagggccatccagtctagagagaactaagggagcctggtattcttaggccttagagcttaacagccacacctaggatgcctcttcagaaggtgttccagcccttcctgtgtcttcccagttctgatactggattatgtcattatgtctctgttgagtaactccttccaatcaggcctgcacactgctgccaggacagtcctcacaaagcacagatctgattgggttattgttcctctgtggaaggggctttcagagactcattatctccccccaagcaaattcttagcatctcttttcaagctttccatacactggcccttaaacacttaaaacggacactctggcctttttattatgcacattattctgcccaccgagaatattacagaatccgtctttcttgctcccaatctgaacgcatcaaaatgtcatccctcatttaccacctagcaaatcaataatgcttctcagccttccctggttctctggaatcgtctgctctctccttcttctgttatagtttgttatggatataacctgtttttctgactccaatgtagacttcttcaactcaaggtttcagttctggtttatctccttactccctcatctatgtagtacacttatggtttactctgttctcactggattagaccaaactcttaattatatttaggatgtattaatccaatgcatagattaaccaagtctattatttttatatcttttgaaaccaatcaggagtttcagaagttcagttcagtttaaatatttattgagatgcatacactatatagtcagatactatgatagctcttgaatataaaaaatatatatacttatgtttgtatatatatgtgtaaattgatatgtaaattcaaatagatagtgttgtctacaccattgagaagcctatagtcccgtggaaaaaagagaattcattctcatgaagtttccggatattgtttcatcagaaggactgggcacatcggggtgtactaaaatcattaagaagtatttagcaccagtagatgcctaataaataccttacagtctagatggatggatagatggaggaagaaagaagggctcctttaatttataatttacctattgctgggtttactcctaggtatgacaattttgaaaacaatttactcaatgtttatttccacactgtgtatgaaatatgctgctcttcattcagaaagagatatataattctccatttgtagaacactgagttaatttcatggttgtgatgttgcttttgcttactttcacccacattttctcctctgtagggtggcagctccgtagggtggacacacgctttgggagacctgcagctgtttgtgtctgggggcaatggtgaagggcagtgactcattggcccagaactcatgatctcatctctcacccagctggctaatcggccttggggacaggaggatgagcgctgcactccctcctaatcatgcagcttttgtatgtctttctttacttgacttaaattgtaatttgaatggaaaaatggacaaattctatcatttgaatttaacttttatatattttcttgactctgatttgggattatctaagtgcatttattcaaatatttattgtgtttttgaaactttttttgaaaagcataaggtaatacatgataaaagatattgttattacccctgtttttgccatttcaaggagtcagaacaggctcagtggaaacaaaatgagatgtcttatgggagttactttcccttcagctaatcttggtatgaatttatattgacactacctttaaaattttattctgctttttaaattttactttaagttctgggatacatgtgcagaacatgcaggtttgttacataggtatacatgtgccatggtggtttgctgcacctatcaacttgtcatctaggttttaagccccacatgcattaggtatttgtcctgatgctctccctccccttgacccctaccccccagcaggccctggtatgtgatgttcccctccctgtgtccatgtgttctcattgttcaattcccacttatgagtgagaacatggggtgtttggttttctgttcctgtgttagtttgctgagaatgatggtttccagcttcatccatgtccctgcaaaggacatgaactcatccttttttatggttgcatagtattccttggtgtatatgtgccacattttctttacccggtctatcattgatgggcatttgggttggttctaagtctttgctattgtacatagtgctgcagtaaacatacgtgtgcatgtatctttatagtagaatgatttacaagcctttgggtatacacccagtaatgggattgctcggtcaaatgattagttttttatttatataaatttatggggtacagtgcaatttcattacatgcatagtttgcctaatggtcaagtcggggcttttaggatgtccatcacccaaataatgtacattgtacccattgagtaatttctcatccttcactcctcctatcctcacccttctgagtctccattgtctgttattccactttctacatccacgtgtggacatgatttagctcccacttgtaggtgagaccatgtgatatttgtgtttctgtgtctgacttgtttcatttaagataacggtttccagttccatcgatgttgttggaaaaggcatgagttcattttgtatggctgaatagttttcccttttgtatgtataccgtattttctttatccagttctctgttgatgaacatctaggttgattccatatctttgctgttgtgaatattgctgtgataaacatgtgagtccaggtatttttctgatacattgatttattttcctttgggtagatacacaatagtaggattgctatattaaatggtagttttatttttagttctttgagaaatctccatacttttttccatagagattttaataatttacattctcaccaatagtgtttaaaatttcccttttcacttttcactgcattctcttcaatatctgttattttttgactttttaataatggccattctgactggcataagatgacatctcattgtggtttcaatttgcatttctttgattagtagtaatgttgaacatgttttccatttgtatgtcttcttttgaaaaatgtctattcatgtccttttcacactttttaatggaattattttgttgttgttgttgaattgtttgggttccttgcatattctggatattgttggatgcatagtttgcaaatattttctcacattctgcaggttgtctcttaagtctgttgattatttcctttgctctgcagaagctttttagtttaactaagtaccatttccctatgcttttttgttgttgttgttgttgcctgtgcttttgaggtcttagtcatgaattctttgcatagaccaatgttcagaagagttttccctcagttttcttctagtatgtttatagttttgggtcttatttataagactttaattcatctttagttgaatttagttttgtatatgatgaggtataggggtccagtttcattcttctgcatatggccatccaatttccccagtatcatttattgaaaggggtgtcctttgcccagtgtatgttcttgtcaatgttgtcaaagatcagttggttgtaaatatgtggctttatttctgggttttttattctgtttcattgatctatgtgtctatttttataccagcctatttgttacctattgctgtgtttactcgttattctcttttttaatgagtaaaataccctttttaaaagacaacatccaaattaggagactgcctttgattaaaatgaataactattaatcatcacagagcagggaaagtgtgaatcatcaggaatttagtggagagaaatccactgttttgggtatgtctttgtattagtctggggtaaatttcttgaggacaaaccttgtctcatttgccttcttataattcatgttagacttatagtaacagtaaagacttactgaattgggttgctttaaaacagcatgtgtaatatagccaccatggcatgcaggagtaggtagaattgcccccaaccaggagtggctcttgaaacatcacagggagaggattaggtaacggttgggttagaaagaggagcacaaggcacttgtcttcatgttgcttgggctcacaagcacacttttcatgtagattgcgtgttcaagatcaacatgccaaaagtggcaaaaatctctaaaggagcctccatctacacatttcgtgagagaaaaatgtccattctccatatcaaagcacattatcatgattttaatttggagtggatttaggggactgatgaagcatggggcactgcagcatccccctagccaacccttacacctgtggtgctcccaacacctcctgcgttcatcatttatcatgaagtatggtgcattcctgaaacactggacaagtgcatcttctcctagaagcacggaggtacattccaaaggcaaactcacttaaattgtgatcagaatacttcaacttgcttgctattgttgtggataagtgatagttaaccacaaccggctgagtggccaggtggaaaggacatggatggggaaggaggttcagggtcctgcataagtcctctagtgtctgtagatctcagtgtcctcccttgtgaaaatggggataatatcagccctcaatttacacagttgtagtgaaggtccaatgtgatcagtgtttgtcacaacctgtcatcatttatgtgtatagaactgcttttactataaacttgcttgtattgtccccagcagccagtcctgcctataatctgttggcttcattgcttgtccagtgatctgtggctccctcctgtcctaatccaggtccaagtggattaatgttatctgattcacgttagtgtttctacagatatgtaatgttatctgaatcacattagtgtttctacagcaaaacagatgcttgttcccactaagtaggataaatgaagactctaaattgcttcacatctgtgcacatgaggttctgccaccatgtgagttcagtcaggtcagattactgccagatgaattagagaaggcttgaggttctcagagaattttggattttggaattagagatgatgcatcatggatttgtgcttaatagctgttttgctactttccctccccttcccctctctccctcctcctccacttccagttcttagcctcagttactattgtactgcctccgtttcttgagacaggctgctgatatgctgcctttggtctctgagccaccaggtatagcgctgcataatggaagaacagatgaacataagagtgtcttggggaagatgagcacaagacatcatggggttgtattgttacccccagcttcagcacattcccggagtgtaagtgcaggctggcttctccataaagcaacacagcagtatgctctgagtgggagtacctccgaaactcagcttccaaaactgtgggctcaccagacctccttggtattttttttttttttttttgagacaaggtctccctctgttgcccatgctggagtgcagtggcatgatcacagctcactgcagcctctacttgctgggctcaaatgatcctcccatctctgctctgcaagtagctgggactataggagtgtgtcacaatgcctggctatttttatttttatttattttttgtagagacaggatctccctatgttacccgggctggtctcaaactgctgggctcaagaaaacctcctgcctctgtctcccaaagggctgggattataggcatgagccaccacgctgtgcccctccctggtttttgatccttggtctgacccctggattctcctggttgacttacactctttggagtgctgactagtatagactctcccaatgctgccttttggatgaatcctgtgatgccacattttccagccttaggacaaatgataacctaccctgtagtctgtccatgctctggagaccctgctggtcttacaagatgaactggacaactgctttcactgataggcctgaaggaaaagggttggaactgtcaaggttccccattaaataccaaccagcaatgacaatcaaggtgagctattcttgtgctgggtaggatgctatcttgggctctgagtgtgtccggaattggtgggttcttggtctcactgacttcaaaaatgaagccgcggaccctcgcggtgagtgttacagttcttaaaggcggcgtgtctggagtttgttccttctgatgttcggatgtgttcggagtttcttctttctagtgggttcgtggtctcgctggctcaagagtgaagctgcggaccttcgcggtgagtgttacagctcttaaggcggcgcgtctggagtcgttcgttcctccttgtaggttcgtggtctcgttggcttcaggagtgaagctgcagaccttcgtggtgactgttacagctcataaaggcagtgtggacccaaagagtgagcagcagcaaggtttgttgcaaacagcgaaagaacaaagcttccacaatgtgcaaagggaccggagagggttgccgctgctggcgcctgcagcctgcttttattctcttatctggccccacccacatcctgctgattggtacagcccagtcgtctgttttgacagggcgctgattggtacgtttacaatccctgagctagacacaaatgttcgccacctccccaccagattagctagatacagagtgtccattggtgcattcacaaaccctgagttagacacagggtgctgactggtgtttttacaatccctgagctagacataaaggttctccaaggccccaccagactcaggagcccagctggcttcacccagtggatcccgcaccggggctacaggtggagctgcctgccagtcccctgccgtgtgcctgcactcctcaggccttgggtggtcgatgggactgggcgctgtggagcagggggcggcgcttgtcggggaggctcgggctgcacaggagcccacgaagggcggggaggctcaggcatggcgggctgcaggtccccagccctgccccgcgggaaggcagccaaggccttgcgagaaattgaacacagcagctgctggcccaggtgctaagcccttcactgcccggggccggcggggccggccggccactccgagtgcggacccgcggagcccatgctcacccggaactcgcgctggcccgcaagcaccgcgcgcagcccccggttcccgcccgcgcctctccctccacacctgcctgcaagctgagggagccggctccggccttggccaacccagaaaggggctcccacagtgcagcggcgggcggaagggctcctcaagtgccgccaaagtgggagcccaggcagaggaggtgccgagagcgagcgcgggctgcgaggactgccagcacgctgtcacctctcgtgagtatctctagtgctgctggcgatgagatgattcagtgtggatgattgataccaaatgtatcatggacagtgaaggctgtgtaacaacacatataggtaggctctgttacaggagttacagttctaggcccagtaaatcttttttttttcactgtgcaattgaattttggttttacctatataacattttcatctgtatgaaatgtaagctctatacaattctccattaggacattgtgtggattttggtgtttctgaatctcttctggctcagaaaattccctgctcttgctggtataatttcatacccaaagagggcattctaaccttgaaagaagttcagctcagcagagcgtctgtcattgcctttctctgtaaacacagttttccttcttccttggcttctcaggtgttttagctccagggaggaaatagtcacagtgaaaatctatttaataaaaccgttatgaaaatgtactcaacctgagcatgcactggaacagcagaagatgaggacttggtctactgccttcccaccaaaccttgccggctctgtaaattttcagagctgtcacttgtgagctatttccaccaagggagagcttctgtaaagttggggacttggcaggccatttcgctaattctttgggtgttcttttagcattgtctgcagtgagtgtgggagtcaaaggcccttcagtgcagagataatgccatcttgttccctggaaccccgaaagagccagagtcaaaggagctttttgtttcactcatagaaaaacccacaggaaatcccagcttcagatattcctattcagtttccttgtcccttcagatctcactgtgtttaggcctcctttgagtgaggcaataactagtaaaaaaaaataaaataaaataaatgaaagaatgccattcatggtggcttggggactgggcacacacactgtatacacggtgtgggggccttccccgggacgctgatgtccttgttctcctagcagtcaaaaattggccagtgaaatacagagaatactagctacctcatactgttaagagaattgactgcggtcagatgtgtagagtttcaagtacatacagtttctgcctcactgtaggcgctcaatattattattgaggagctattattagatttcacatctctgccagctcttgtgtcacttattaagcatatgactgggaataagctatttaattctcttcgtctgtaagataggaagtaataatgcttattttgtgggcctattgtgaggatcatgtaagatgagagataaaagggcttagcaaacggtagcatattacaggtggcctgcagcctgccgctgtgcaggtgacgtcccacacaatggtactggccgaggggtgaatggagccctggtgctgaggatggcgagcctttttctaattcatcagctcagaggtgccacctttttctaatttaccctccctaagaggacatctttttatattttaccagcccacagaagataccttttaaaaatttgcacaatggtaccatatgtgctagctgcaattctgtcaacaagagaaagatgttatttttagtgtagcagacagagaattctggagagggcacatggcatgctttatctggctccaacttggtcatttctgtttaatttcaatgatctgattgccatagagtcagaggagcaattttgctattgcccaaattctacattttcactaggattttccttgaaggcaaggactataacccccaccctgcccatcaccttgcttgctcaccactgccctgtacatatccttcagaatggacatttgttaacaatgggtaagagtgtaggctggcctttcacttaccttcctgtgctttgctctttactgctagggctagcagccggaaagctacatatcccaggctttctcgccagctcatttgctgttaaattctgttaataggaggcactggtgggagaccagtaagacggagagaaaaacttcctgattctgggttttactgtgaggccattgcaagcagttgctgtagtgatagtaaggaaggggtgagttggaacatcagcaaccctgcaggtaacccccttattggggctccaatcttagttgatgtagcacttccttggtggcttcagagccaaatggcacaacctcctcaacagtacagcagattgagaaggctgagggacatcgtttaggagcattaatgatgggtgtctagctatgacccccttttccttttcacttctgtcctctccttctcctttgttctcttctagttctttctatatctttgtaacaaattccctatattaaatttcttctgcttgagatacttgaagtggtcttagtttccctgcatttagcacgtggactctctgaatctgttgggtgcttagggcctgggtttgtgccctaggatcctgtgactgaattcttcctttctctttccatcctcatcatgcatgcaggattgtcgcagtagcctttaaatagattttcagccaccagcctctttctgttcactgtggacattattggtagtttaatttttctaaaaatctattttctggatccacatttctgctcaaaactctatttttatgataactatttaagcataggtatagtcatctatgacctaaaccccaaaggcaggatcgtcaccatggccaccttttctgtgatcctaataacagagagatctgtgtcagaagaggattggttgttctttcaccctggctaactggaaggcagggagctcagtggtagacacaccggtcatcatgctggtgtgggaaagatttcaaagcctggccatagctcccactgaagctcctttctgcaccttactgcttccttgtacaagtcaaaccagggcctttagagcagggaccttcattgcactgccctctcctcgcctcccaaatgataatatccagctttcaaggtctgcctgatgtcccagggttaggagggcagagaccaggcagtttatgtcatgtcacttcttttttttttttgtcttttaaaaaatttattatactttaaggtctggggtacatgtgcacaacatgcaggtttgttacataggtatacatgtgctatgttggtttgctgcacccactaacttgtcatttacattaggtatttctcctaatgctatccctccccgcaccccacgacaggccccagtgtgcgatgttccctgtcctgtgtccaagtgttctcattgctcaattcccacctatgagtgagaacatgcactgttcggttttctgtccttgcgatagtttgctgagaatgatggtttccagcttcatccatgtccttgcaaaggacatgaactcatccttttttatggctgcgtagtattccatggtgtatatgtgccacattttcttttctttttttttttttagagataacaatactcactttcaacaatttctagaactacagagaagaaaaacaaggaaatagaagatttgagcaacacaattaactagacctaacacacatctacagaacagtctatccaacaatagcagaatatgtacttttctttttttttttttacaataacagtgttatcatttattattttgattaactcgtcatttagcattaggtatatctcctaatgctatccctccccactccccccatgccacaacagtccctggtgtgtgatgctccccttcctgtgtccatgtgttctcattgttcaattcccacctatgagtgagaacatgcggtgtttgattttttgtccttgcgatagtttgctgagaatgatggtttccagcttcatccatgtccctacaaaggacatgaactcatccttttttatggctgcatagtattccatggtgtatatgtgccacattttcttaatccagtctatcattgacggacatttgggttggttccaagtttttgctattgtgaatagtgctgcatataaacataagcgtgcatgtgtctttctagtagcatgatttataatcctttgggtatataaatagcaattttgctattgccccaattctaaatttttggggcaatttagatcgctgggtcaaatgggatcactgggccaaatggtatttctagttctagatccttgatgaatcgccgcactgtcttccacaatggttgaactagtttacactcccaccaacagtgtaaaagcattcctgtttctccatatcctctccagcatctgttgtttcctgactttttaatgatcaccattctaactgatgtgatatggtatctcattgtggttttgatttgcatttctctgatgaccagtgatgatgagcattttttcatgtgtctgttggctgcataaatgtcttcttttgagaagtttctgttcatatcctttgcccactttttgatgggtttgtttatttgttttttcttgtacatttgtttaagttctttgtagattctggatattagccctttgtcagatgggtagattgcaaaaattttctcccattctataggttgcctgttcactctgatggtagtttctgttgctgtgcagaagctctttagtttaattagatcccatttgtctattttggcttgtgttgccattgcttttggtgtttcagttattaagtccttgcccatgcctatgtcctgaaaggtattgcctaggttttcttctagggtttttatggttttaggtctaacatttaagtctttaattcatcttgaattaatttttgtataaggtgtaaggaggggatccagtttcagctttctacatatggctagccagttttctcagcaccatttattaaatagggaatcctttccccatttcttgtttttgtcagctttgtcaaagatcagatggttgtagatgtgtggtgttatttctgagggctctgttctgttccattggtctatctctctgttttggtaccagcaccatgctgttttggttactgtagccttgtagtatagtttgaagtagtgtgttgcctccagctttgttcttcttgcttaggattgttttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcgttgagcagtagtttgtagttctccttgaagaggttctttacatcccttgtaagttggattcctcggtgttttattctctttgtagcaattgtgaatgggagtttgctcatgatttgggtctctgtttgtctgttattggtgtataggaatgcctgtgatttttgcacattgattttgtatcctgagacattactgaagttgcttatctgcttaaggagattttgggctgagatgatggggttttctaaatatacaatcatatcatctgccaacagggacaatttaacttcctcttttcctaatggaatactctttatttctttctcttgtctgatggccctggccagaacttccaacactatgttgaataggagtgctgagagagggcatccctgtcttatgccagttttcaaaggtaatgcttccagtttttgctcattcagtgtgatattggctatgggtttgtcataaatagctcttattattttgagatacattccatcaatacctagtttattgagtttttagcatgaagtgctgttgaattttgttgaaggccttttctgcatctgttgagataatcatgtgttttttttcattggttctgtttatgtgatggattacgtttattgacttgcatatgttgaaccagccttgcatcccagggatgaagctgacctgatcatggtggataagctttttgatgtgctgctggattcggtttgccggtattttattcaggatttttgcatcgacgttcatcagggatattggtctaaaattctcttttttgttgtgtctctgccaggctttggtatcaggatgatgctggcctcataaaatgagttagggaggattccctctttttctattgattggaatagtttcagaaggaatggtaccagctcctctttgtacttctggtagaattcggctgtgaacccatctggtcctggactttttttggttggtaggctattaattattgcctcaatttcagatcctgttattggtctattcagagattcaacttcttcctggtttagtcttgggagggtgtatgtgtccaggaatttatccatttctcctcgatttttctagtttatttgtgtagaggtatttatagcattctctgatagtagtttgtatttctgtgggatcagtggtgatatcccctttatcattttttattgcgtctgttttattcttctctcttttcttctttattagtcttgctagcggtctatcaattttgttgatcttttcaaaaaaccagctcttggattcattgattttttgaagggttttttgtctctatctccttcagttctgctctgatcttagttatttcttgccttctactagcctttgaatgtgtttgctcttgcttctctagttcttttaattgtgatgttaggatgtcaattttagatctttcctgctttctcttatggacatttagtgctgtaaatttccctctacacactgctttaaatgtgtcccagagattctggtatgttgtgtctttgttcgcattagtttcgaagaacacctttatttctgccttcattttgttatttacccagtagtcattcaggagcaggttgttcagtttccatgtagttgtgcggttttgagtgagtttcttaatcctgagttctagtttgattgcactgtggtctgagagacagtttgttatgatttctgttcttttacattttctgaggagtgctttacttccaattatgtggtcagttttggaataagtgcaatgtggtgctgagaagaatgtatattctgttgatttggggtggagagttctgtagatgtctattaggtctgcttggtgcagagctgagttgaagtcctggatatccttttaaccttctgtcttgttgatctgtctaatattgacagcggggtgttaaaagtctcccattattattgtgtgggagtctaagtctctttgcagatctctaaagacttgctttatgaatctgggtgctcctgtgttgggtgcatatatatttaggatagttagctcttcttgttgaattgatccctttgccattatgtaatggccttctttgtctcttttgatctttgctggtttaaagtctgttttatcagagaccaggattgcaacccctgcttttttcttttttgctttccatttgcttggtagatcttcctccatccctttattttgagcctatgtgtgtctctgcacgtgagattggtctcctgaatacagcacactgatgggtcttgactctttgtccaatttgccagtctgtgtcttttaattggggcatttagcctatttagatttaaggttaatattgttatgtgtgaatttgatcccatcattatgatgttagctggttattttacctgttagttgatgcagtttcttcctagcattgatggtctttacagtttggcatgtttttgcagtggctggtacccgttgttcctttccatgtttagtgcttccttcaggagctcttgtaaggcagacctagtggtaacaaaatctctgagcatttgcttgtctgtaaaggattctatttctccttcacttatgaagcttagtttggctggatatgaaattctgggctgaaaattcatttctttaagaatattgaatattggcccccactctcttctggcttgtagagtttctgctgagatatccactgttagtcatcagacttccctttgtgggtaacccgacctttctctctggctgcacttaacattttttccttcatttcaaccttggtgaatctgacaattatatgtcttggggttgctcttcttgaggagtatctttgtggtgttctctgtatttcctgaatttgaatgttggcctgccttgctaggttggggaagttctcctggatagtatcctgcagagtgttttccaacttggttccattctccccgtcactttcaggtacaccagtcaaacgtagatttggtcttttcacatagtctcatatttcttggaggctttatttgtttctttttactcttttttctctaaacttctcttctcgccttatttcattaatttgatcttcagtcgctgataccctttcttccacttggtcaaatcagctattgaagcttgtgcatgcgtcatgtagttcttgtgccatggttttcagcttcatcagttcatttatggtcttctctacactgtttattctagttagccatttgtctaattttttttcaagggttttagcttcctagcaatgggttcaaatgtcctcctttagctcggagaagtttgttattactgaccttctgaagtctacttgtgtcagctcgtcaaagtcattctctgtccagctttgttctgttgctggcgaggagctgtgatcctttggaggagaagaggtgctctggtttttaggattttcagcttttctgctctggtttctccccatctttgtggttttatctacctttggtctttgaagatggtgacctacagatggggttttggtgtggatgtcctttttgttgatgttgatgctattcctttctgtttgttagttttccttctaacaatcaggtctctcagctgcaggtctgttggagtttgctggaggtccactccagaccctgtttgcctgggtatcaccagtggaggctgcagaacagcaaatattgcagaacagtaaatattgctgcctgatccttcctctggaggcgttgtcccagagaggtgcccgcctgtatgaggtgtcagtcggcccctacttggaggtgtctctcagttaggctacacaggggtcagggagccacttgaggaggcagtctgtctgttctcatagctcaaacaccatgctgggagaaccactgctctcttcagagctgtcagatagggacgtttaagtctgcagaagtttctgctgccttttgttcagctatgccctgcccctagagctggggtctacagaggcagcaggccttggagagctgcggtgggctccgcccagttcaagcttctccagccgctttgtttacctactcaagcctcagcaatggcagatgcccctccctctgccaggctgttgcctcgcaggtcgatctcagactgctgagctagcagtgagcaaggctccatgggtgtgggacctgctgagccaggcacaggatgtaatctcttggtgtgctgtttgctaagaccattggaaaaacgcagtatttgggtgagagtgtcctaattttccaggtacagtctgtcacagcttgccttggctaggaaagggaaatcccctgaccccttgtgcttcctgggtgagataatgccccgccctgcttcggctcaccctgtgtgggctgcacccactctccaaccagtcccaatgagataaacaggtacctcagttggaaatgcagaaatcaccatcttctgcatcgatcatgctgggagctgcagaccagagctgttcctatttggccatcttggaacagaatgcatcatgtcacttcttatacatgaatgagaataactgtgaaatgtgcacatgtgctctgagcctagataagattgttactatcatgttatattgttattattgtgttattatcgttattatcatgttattttcttacccataggttttccaacttgcttgaagtaatgctttcaggatactcaatattgaatattcaatactgatgggaaaactttcttaaaggaaatggacattacagggtcaactggaggaaaaataacacatttactgctcaaacatagcttgttgtttttatatttaaaaacataggcattgtaaaaagtcaaacaagcctgaaaaatgtatgggagaagatgaaatgatcactgaagtcacatattcctcactgttaatgatttagggaacatccttctagaaggttcacagagccatacaactttaccgaaatgggattatgttgcatcttgttttccaacctaattttttcccacttagtagtatagcacagatatgttttcatgtcaaccagtatgactttacactgttatttctttcttcttttttttctgagatggaggctcgctctgtcgcccaggctggagtgcagtggcacgattttggctcactgcaacctccacctacctggttcaagcgattgttctgtctcagcctcctgagtagctaggattacaggtgcctgccaccacacctggctaatttttgtatttttaatagagacggggtttcaccatgttggccaggctggtcttgaactcctgacatccggtgatctgcccgccttggcctcccaaagggagggattacaggtgtgagccactgtgcccggcctaatggttacacagtattccatgctgacaccataatttactcatccagttacattaaattggaatgttcatagttgttgacctttagaacatgccagtattaagtttttgtatttaaggtgatgctagttctaaagcatatattctgaaatctcagtggcttaacacctcagaagtttatttctccttatgtaaagtttaggttctctccatttgctgatggttaccttgaggtaccaggcttgcgtggaggggctgctgtgccttgcatggccatgcagggactcaggccctctccagcgtgtggtttgcaaggttgccctggcccttgctgcttagctggctgatagtggaagagaaagtgaagaagatgtcacaggaggttttaatggatcagaactggaagtggcagatactgcttctgcccccattccattggccagaatgtcacatggccatacaaaactgcaagggaggctgggaaatgccactcatctgtgtgtgtgggaggaaaggaaatacatttggtgaatactagctagtctctaacagagcttcccctactgtttaccaaattcctgttttgcttttcccctcacacacagaacacacccctcccagagtgagggaccctaagtcccatccagccctggcaccttgcttagtcactgttcaggatctctgggtgatgtgctgtcttccccatcacatctaaatgaggatccttgtggtttgatgacttatgaactagaagagaataaagttatttgcctcctccctagcgcctcccaattttcaatgaagcagggaagcattgtaacattagaagctcccatttagaacagagtaaagagcgggcagcacagtcatcacaggcccaaagcaacaatggaatccagttgggtgggcaaggtggaggttctcaaccagagggtgggagaactttcttgattagaccttgattttgccagaaaaggcaatctcttctcagttggtctccatggtccgagctctgtcctggcaagttccttcttgcactttattctcaatggctacgtttgaagtgattgcaggggagtccgccatcttaggagggtacacagctttgcagccctctagtgccctgctgttgtttcaaggctcaaatagacaaacgtctttaaaaaattttatttttagtccaggctcatggtttctttggccatacatttatgtcaaaaatttgataggattctgttttttttttaaattaattacttttatttttgacaaataatttacatatttatggggtacaatgtgaagctttcatatatttattcactatgaaatgattaaaccaagctaattaacatatccatcatttcacgtgtgtgtgtggtatgaaatttttgtgtgtgtgtggtatgaaattcttagcaattttgaaatatattgcattattattaactatagtcaccatgctgtggaataaatcttaagaacttattccttctgtctaactgaagctttgtatactttgactaacatcttcccatccacttctacccttgccccagcccctgctaaccaccattctattctctacttccgactttttttagattacacctgtaactgagatcatgcagtatttttctttctgtgcttggattacttgtttctgttctgttttcttcccttaagttttttatgccaatagcaaatccctaagtttttttcctagatattattaccaagcttgaattattatattactttctcaccctaatacccttttctgtcaatgagatggtgacttccttgaggccttcagggtcagatgggaaggcaaaattcttaattagctctttgctacaaggctgaatcttttacctgtgtcactcaaaagccttttcaatcttgtttcttactcctcagactttagaagcagtcatttcttccaaggctttacactcagaagtttctggacaaacatctggactctattccctttcattttatgcttgcaaaccaacaaattctttttttaaaaaagtattttaatagctttaggagtacaagtggtttttgcttacatggatgaatggtatagtcctgaagtctgaaattttagtgtacccaagttgcgtacattgtgcccaatatgtaacttttaaagtcgcccctcccacactcccctattctgagtctctaaagtccattatatcactttgtgtgcctttgtgtatccatagcttagctcccatttaccaatgagaaagtacagtgtttggttttccactcctgagttagttcacttagaataatggcattcagttccatctgagttgctgtaaaatacattatttcattcttttttatggctaactagtattccatggtgtatatataccacattttcttcatccactcattgattgatgggcacttaggttggttccatagctttgcaattgtgaattgtgctgtgataatcatatgcatgcaggtgtctttttgatgtaatgacttcttttcctttgggtacctagtccagtagtgggattgctggattgaatggtagatctacttttagttctttgagaaatctccatactgttttccatagaggttatactgatttatgttaccaccagaagtatataagcttttccttttcaccatatccatgccaacatctcttgttttttgactttttaataaagggccattctgtttgggataaggtggtttctcattgtggttttaatttgcattccctgatgattagtgatggtgagcagtttttcgtatgtttcttggccatttgtatatgttattttgagaaatgtatattcatgtcatttgcccactttttaaagggattttttccccttgctgatttgtttgagttctttgtagattctgggtattagtctgttgtcggatgcatagtttgcaaatattttctcccattctgtgagttgtgtgtttactctaatgattatttcttttgctgtgtggagcattttagtttaagtcttatttatttatctttgtgttggttgtttttggggtcttagttataaattctttgcctaggctactatccaaaataatttttcctaggttttgttctagaatttttatggtttcaagtcttagatttaagtctgtaatccatcttgagttgatttttgtgtatagtgagagatagagatccagtttcattcttctacatgttgctatttagttttcccagcaccatttattgaatagcatgtcctttcttcaatttatgtttgtatatgctttgttgacgatcagttggttgtaactatttggctttatttctgggttctctattctattctatttgtctatgtatctacttttataccaataccatgctattctgattacaatagccttgcagtataatttggagtcagttattgtgatgcatccagatttgttctttttgctcaggattactttggctgtctgtgctctttttttggttctatatgaattttaggattgttcgttctttctttttcttttcttcaacttttattttaagttcatgggtacatgtggaggatgtgcaggtttgttacacaagtaaacgtgtgccatggtggtttgctgcacagatcatcctatcaactaggtattaagcccagcatcaattagctattcttcctgatgctctccctcccacccactgcccactgatagttcccagtgtgtgctgttcccctctatgtgtccatgtattttcatcatttagttcccacttatagatgagagcatgcattctttggttttctgttcctgtgttagtttctggaggataatggcttccaactccgactccatccatatccctgcaaaggacatgatcttgttcctttttatggctgcatagtattccatagtgtatatgcaccacatttatttatccagtccatcattgatgggcatttagattgattttatatctttggtattgtgaaaaatgctgcaatgaacatacacatgcatgtatctttataacacaatgatttatattttttggggtgtataccccgtaatgggattgatgagtcaaatggtacgcctctaggtctttgaggaatcactacactgtcttccacaatggttgaactaatttacactcccaccaacaatgtaaaagcatttctttttctccacaacctcaccagcatctgttgttttttgacatcttagtaacagccattctgactggtgttagatcgtatcttattgtggtttttatttgcatttctctaatgatcagttatgttgagcgttttgtcatgtttgttggctggatgtatgtcttcttttgaaaagtgtctgatgatagtttcttttgctgtgcagaagctctttagtttaattagataccatttgtaggtttttgcttttgttgcagttgctttggtgttttcatcatgaaatctttgtccatgcctatgtcctgaatggtattgccttggttgtcttgcagcatttttatagttttgggttttacacttaagtctttaatccatcttgaattgatttttgcttaaggtgtaagggatgggtccagtttcaattttctgcatatggctagccagctctctcagcaccatttattaaatatggagtcctttccccattgcttgtttttgtctagtttgttgaagatcagatggttgtaggtgttgggtcttatttctgagttctgtattctgttccattggtctatgtgtctgttcctgtaccaataccctgctgttttggttactgtagccttgcagtatagtttgaagttgggtagccatgatgcctccagctttgttctttttgattatgattgtcttggccatttgggatttgttggttccacatgaattttaaaatagttttttctaattctgtgaagaatgtcaatggtagtttaatgggaatagcattgaatctataaattgctttgggcagtatggctattttcatgatattgattcttcctgttcatgagcatggaatgtttctccatttgtttgtgtcctgtacgatttctttgagcaatggtttgtagttctccttgaagaggtccttcacttcccttgttagctgtattcctagttattttattctttttgtagtaattgtgaatgggagttcatttatgatttggctctttgattgcctgttgttggtgtgtaggaatgctagcaatttttgcacattgattttgtatcctgagactgctgaagttgcttatcagcttaaaaagcttttgggctgagatgatggggttttctagatataggatcatgtcatctgcaaacaaagataatttgacttcctctcttcctatttgaacactctttattttgttctcttatctgattgccctggccagaacttccaatactatgttgaataggagtggcgagagaggacatcttgttttgggctgtttttcaaggggaatgcttccagcttttgcccagtcagtatgatattggctgtgggtttgtcatatatggctcttattattttgaggtatgttccttcaatacctagtttattgagaatttttaacatgaagggatgccagattttatcgaaggccttttctgcatatattgagataatcatgtggtttttgtctttagttctgtttatgtgatgaatcacatttattgatttgcatatgttgaaccaactttgtatcctggagatgaagccaacttgattctagtggataagctttttgatgtgctgctgcattcagtttgtcagtattttattgaaggtttttgcattgatgttcattaaggatatcggcctgaggttttctttttttttgttgtatctctgccaggttttggtatcaggatgatgctggcctcatagaataaattggggatgagtccctccttttcaattttttggaataatttcagtcaaaatgatacccctttttctttgtacctctggtagaattcagctgtgaatctgtctgttcctgggctttttttggttggtaagctatttattactgtctcaatttcagaactcattattggtctattcagagattcaatttcttcctggttcagtcttgggagggtgtatgtgtctaggaatttatccatttcttctagattttttagtctatgtgcatagaggtgtttacagtattttctgatggttgtttgtatttctgtggggttagtggtgatatctcccttaacattttctattgtatctatttgattcttctctcttttcctctttgttagtctagcaagtgatctattttattatttttttcaaaaaaccagtttctggatttgttgatttttttgaagggttttttgtgtctctgtcttcttcacttattatgccctcatcctggttatttcttgtcttctagctttggagtttgtttgctcttggttctctagttctttagttgagatgttaggttgttaacttgagatctttctagcttttgatgtgggcatttaatgctctaaatttccctcttaacaccactttacctgtgtcccagagattctaggacattgtctctttgttctcattagtttcaaagtacttattgatttctgccttaatttcattatttacccaagagtcattcaggagcaggttgttcagtttccatgtagttgtgtggttttgagtgaatttcttaatcttgagttctaatttgatggtgctgtggtctgagagactgttatgatttcagctcttttgcatttgctgaggagtgttttatttccaattatgtgatcagttttagagtaagtgccatatgtcaatgaggagaatgtatattctgctgttttgtggtggagaattctgtagatatctatcagatccacttgatccagggctgagttcaggtccttactatctttattaattttctgtcttgatttgtctaatattgtcagtgggttgttaaagtctcccactattattgtgtgggagtctaagtagtctaagtgtgtcattcttgaagaacttgctttatgaatctgggtgctcctatattggatgcatatatatttaggatagttagctcttgttgaattgaactctttaccattattaatgcccttctttatattttttgatctttgttggcttaaagtcttgttttgtcagaaattaggattgcaacccctacttttttctgttttccatttgcttggtaaattttccttcatccttttattttgaacctgtgtatgtcttgcatgtgagatgggtctcttgaagacagcacaccagtgggtcttggctctgtccagcttgccattctgtgtcttttaattggggcatttagcccaaaaaaaaaatatatatattttatattttttgagatggaatttcactctgtgtcacccaggctggagtgcaatggtgcagtcccagctcacggcaacctctgcctcccgggtgaagcgattctcctgcctcagcctcccgagtagctgggattacaggcacctgccatcttttagtagagatggggtttcaccatgttggccaggctggtctcgaactcttgacctcaggtgatttgcctgcctcaggcttccaaagtgctgggattacaggtgtgagccactgtgcctggcctagcccatttatatttaaggttagtattattatatgtgaatttgatcctgtcatcatgatgctagctggttattttgcagacttgtttatgtagttgcttcatagtgtcactggtctgtgtagttcagtgtgtttttgtagtggctggtaacagtttttcgtttccatatttagtgcttcctggtggtgatgaattctctcagcctttgcttgtctgaaaaggatcttatttctccttcatttatgaaccttagtttggtcagatatgaaatcttgggttggaaattcttttctttaagactgtagaatattggcccacaatctcttctggcttgtagggtttccattgagaggtcctcagttagtctgattggcttcccgttgtaggtgacctggcctttctttctggctgcccttcactttttttttttcatttcgacctggagaatctgatgattatgtgtctgggggttgatcttctcatggaggatcctactggggttctctgcacttcctgaattgaatattggcctatcttgccaggttgggtgagttctcttgaatgatatcctgaagtgtgatttccaacttggttccattctccctgtccctttcaggtatcccaatcagttggaggtttggtctcttcatagaatcccatatttcttggaggttttgttcattccttttcattcttttttctctattcttgtctgcctgtcttatttcagaaagatagtctttaagctctgaaattctttcctccacttggtctattctgctattgatacttgtgattgcattgtgaggttctcgtgttgtgtgttttcagctccatgagcttggttatgttcctctctaaactggctattctggctatcagcttctgtattgttttatcatgattcttagcttctttgcattgggttacaacatgctccttttactcagtgaagtttgttattacccaccttctgaagtctacttctgtcagttcagtcatctcagcctcagcccagttctgttcccttgctggagaggtgttactgtcatttggaggagaagagccactctggctttttgagttttcagcactgattctttgcttatctttgtgggcttatctaccttcaatctttgaggttgctggcctttcaatagggttttgtgggattctttttgttgatctttttgttgttgttgttttctgtttgtttttcttttcatagtcaggccactctaccgtagggctgctgcagtttgctgggggtctgctccagaccttggttgccttggtttttcctgtacctggagatatcaccagtgaaggctgcaaaacagcaaagatggctgccagctccttcctgtggaagctctgtgccagggggatactgacctgttgctggccagaacatatctgtaagaggtggctggagacccctgtttggaggtctcacccagtcaggtggaatggtatcagggacccatttaaagatgagtcttgctgctttttgtctgaggaggtgtgctgcattgtggcagacccttcctcatctggactgtttgcattctccaaagccagcaggctggaatggttgagtccactgaaccacagagatggcagccacctctccccctgggagctgcatccgagggagaggtcagagttctgttaatagaacccttgttggcgtggctgaagcccccacagggaggtccctcccagtaaggaggaatgaatcggggtcccacttaacgaagcaatctggccacagtgtggcaaagcagctgtgctgcattgtggggggcccttcctcatctggaccatttgtattctccaaagctggcaggctggaaaggccaagtctactggaccaaagagatggtggctgcccctctccctggaaactcggacctatctcaggcagattccagcctgttgctgttgtatgcctaagttaagttggtataaattcaaaatagattgttataactataggatattatatgtaattcccatggtagccacaaagaaaatatctatagaatgtacacaaaaggaaatgagaaaggcatcaaaatgtgcctctgtaaaaaaaaggtcaacaaaacacaaagaaaactggtcatggagaaaatgagggtcaaaaatactgtaagatataaaggaggcaaaatggcaaaagtaagtccttccatattagtaatcgagactctgtcttaaacaaaacaaaacaaaacaaaagaaacaaacaagcaaacgaaaaacgtccagtcaaaagcatagattggcagaatgaattaaagaaaaacatgatctaactgcatgctatgagagacccactttagatctaaaggttgaaagtgaaagcatagaacaagatgtaaatagtaacaaaaagagagctttggtgtctacactaatatcataaaatagaatttaagtcaaaaatttttacaagaaaaaaggacattatatgttgataaaagggtcaatttacctagaagatacaacaattcaaaacatatatgcaccaaacatcagagctccacaatatacgaagcaaatgttgacagaaatgaagggagtaatagacaactctgcaatcaaatgcctgaataatgcagtatgtgggctagtccagcctctctcatgatttccacatcactttgatgtggacatcctggacatctgcagttttcagttacttcctgtttcctgctggcatttaagtcccttgtactttatgtgaattcttacttcagttatactgcccctacaacttgcaatgaacattctcactttggttgtatcactttccaccctcctgcctgaaatctgatgctttccttcaagctccatccccactaggaagccttttgtatgagctaagattaacaacttgcatcctttaccctccacgtgttgcatatacctataccactcatttagcacatcacatttgatacttatttatttgacacatgtagctatatttaatctatttgtttggtctcctccataaccagagctttatttccatgggggctaatgctcctttaagtttctggcaatgattactgttatatagatgcagaatcttatttttttaatgaattaacagatgtctccctaaattaggcccaaatactgatcttaatcctaaggattagctaatagaagcatcataggtattaagttggacagatatggccaaactgtttaattttgtgagcttcagtttcatgtgctaatgccatatctatctatctatccatctatctatccatccatccatccatccatccatccatccatccatccatccgtctatctatgtctagcttgaccatcacaacagtctaaggagaagctatgcttatccctgtttttcagatgaggaaactgagacccagagacattaagtaatttgccaaaattacccaactcacacatgaaagagtcaaggtttgaacctagatctccctgactccactgcttgttattttaaacatctacaatatttacctttcagttcttgaacttaatcttgcctgagatctaagttcaagcctttcattatccacatccccccatatctaatgatagttgtggtaggcagaataatatccccccaaagatgtctgcatcccaatcctggaacctatgaatattttaccttgcatgacaaaaagggactttgcagatgagattaagttaaggatctttagatggagagactatctttgctatccatgtgaacccaatgtaatcatagggtgctcataaaggaaagagggaggcaggagtcaaagtcagagagagatttgaagatgctcaactgcttttgaagatggagaaagggaccaaagccaaggaattcactgacaccttgattttagcccagtgagactcactttgacctccagaactgtaaaataatagatttgtgttgcttgaagccactaaatttatagtaatttgttatggcagcaataggagactaatacagttgaccctcgaacgacacaggtttgaactgtgagtccacttctacatgaattttttttttagtaaatatattagaaatatttttggagatttgtggcaacttgaaaaaactcgcagacaaaccatgtatcctagaaatataaaaaaaaaataagaaaaagctatgttatgaatgcataaaatatatgtagatactagtctattttatcatttactaccataaaatgatacacacatctattctaaaaagtaaaaatttatcaaaacgtatgcaaacagagtgtacatggcatcctttgcagtggagagaaatagaaacaacataaaaaatgcagtattaaatcataattgcatacaattaactgtatacataaggtactgtggtaataatcgctgcattgccacctacattgctattgtggtgagctcaagtgtgggaagtatccacttaaaatgccatgtgatgctaaccgtctgcacatgagcagtttctctctccagtaaattgcatattgcaatgaaagttatctctttcagttctcacatttttttttgtgtttggagcaatactataaactttgagtaacacagcgggactcatacgaagtgccactactgatgctggaagtgctcccaaaaagcagagaaaagtcatgacattacaagtaaaagctgaattgcttgatgtgtgctataaattgagatctgcactgtggttgcccaccatttcggacagatgattcagcttgtaagcagacaatgtaaacttacaatatcaataagtaaagtacagtagtgtaaatacattttctcttccttatgattttcttaatattttcttttccctagcttaccttaattgtaagaatataatacatatacagaatatgtgttaattgaccttttctgttatcaataaggcttctggtcaacaatagcctattagtaggtaagattttggagattcaaaagttacagtgaattttaactgtgcaggtgattgatgcctaattcccatgttgttcaagggtcaactgtacaataggttttctgctttccttaccctcctgatgatttctgaactagttctacagagtttcctcttttcctttgcatctctccttcccactgccaccatccagattgttttcagagcggcacttcatcagctgcatcgtcaccctctgagggtgtggaagggctctcacttccacttaaggccatgccatgctaattgcctttctggctcttttctcttaaaaggtggtgcttagaaaggaaaggaatagtccatatgtggtcttagtaggacagggaacagtaggtctttacctcccttaatccgaatgttagatctcttcaatgcaatcaaggtaatgcttatttttttttggcacccacatcacatccactgctcactcaggttgagtttattgataactacaaccccaagcttttcatgtcatattaaagcaaaagccattatgagctgttcttatatctcgtagaatgtctgccatcttgtgtcatgtagcttttgtctcaggaaaaaaaaaaaaaaaaaaaagcacagtacgaattaatctctccagggaaagatttaaagactaggataataaggagagacagatggaattctgagagaaatatggcaaattctagagctaatctaattaaagggccatgggaacttctccctggcgcataaataaaatatgacaatcagtgtcagctaagaaacccttagcaaatacctaatctcatttttaaatttatcattacatagaactgttatcttttaacaaataatggtatgatgcaaaataagctgagagaagccaacagacacaggccaggcagctgcccagcctctctgcccacccctccctacatacacttcaggtggcatgggctctcccagccatttcgatacatgacacctctgtgacctcgccagcttgaaggataaaatgaaaggttcttagtgaaggaaaaaggcgttcatcttcaccccatcgtaatgggctctgaggaggactggcaacatgtagaatctggagaggagaggtcaggactggctgcagaggaggaagctgctgaggtgattagtagttctcagagagggccttgttctttccctttaaattcaaaatggcagtgcctcaaaccctctgggcttcctggaatttgtgtttaaatgtttatgtatttccaggcgaatattcaaacaatgtagctaagatgtggtaccttcaaagcaagtaaaccagctggcttccctgctatgatccccttgcacagcctggcccttcagacaggagcctgtattctgaaggaagtccttacagagcagcttggatctactaccccttaaaagaaggaggaactggtgaaattatttccattaactttaaggtactcaagaggaccacagaggtcttattcttttcagtttggataaatctggggcagtccaaaggttgccaagggaggtaggaagaaaagtttaatttgcacacttgagctttacagtctgtctgacttcattggagtttacttctttttaaattgcagactcagggcttaaatacttccttaccttcagtgacctttcctgagccctcctgttcctgataagctgcagggcagtgctttctttcctatgatgtgttgtcatattaacacacacacccagagtgattactgtgttcacttcccctggatgtgcttcatctttgttgagttaaaatcaaattgctttctacttcagtaaatccaattcagccttcttactgaccatgggttaaagttttaatttaaaattccctttcttttaaaaattagcaattcaaattcaaggtggtaaagcagcccacattctgagattgttggtgttggaaagggccttagctatcgtctgtcctgcgtgatgcttctgttgaattatctcaaggacagaatagttactactttgaacagattaggtggaatgatgtaaatgaaagtgctttgtaacttgtaggacattaaaaaataaatattattagcatttataaagatgctttttccattgttgccaatgttacttattttttcaaaactactttattgaggtcttattgacataaaaaaagctgtacatacttagctgggcgtggtggggggtgcctgtaatgcaagctacttgggaggtcaaggctggagaattacttgaacctgggagatggaggttgcagtgagctgaggttgcactattgcactccagcctgggtgacagagcaagactctgtcaaaaaaaaaaaaaaagctgtgcatacttaatacatacatcttgataagtttcaggataagtacaacacacttgtgaaaaccacctgtgaatcccacttgtgaaaccaatcattaaacatgtccctcaactcccaaagtttcttctttattattactatgattaattttttttggtgaaagcatataacataaaatctaccctaggcaaattttaagtatacaatgcagtgtttgttagctataggcattatgctgtatagtacagcatactgtacttactagcttaagctttatatattataacatgtgttttcctgttgaactcctgtcttccttcttgtgggtataaactagaataactttatagatcgcttgggaacatttttcacctcaagcggccattcctgtccaggtgtgggatgtgcaacacagtggtccaagagatgattttcagagtcacaaggacatggcatggggtaccattgactcacgttctcctgctaaggtgaaagtctcaatttgctgctagtgcatctttaaccttctctaactctcatttccctttgttataaagacagagctcagcagacttctgtcccaaaatctttggccaacagcaaaccatatttgtatggttatcttctaattatggggagtgattttcatatcccagtgatagtgataccaaaaaagaataaaagtatcctttaaattgacaagcaccatgaagtggtttgagactggctggtgtttgggacatggctttccacggagcttgagagatgggccatggatcagattactgcccactgtgacagacaacacacaatttgccatttcctatggcagtctttgacatatctgaagtcagtgctcatgtgtcctttcagccttcccttctttaggtctcacccttccagtttcttcacatgttccttatttgatgttctcctgcaatggtgactggagtctatcagtttttcttttgaggaagctccctgttcatcatttttatagaaggagcccttgttctgatatcagagagcagttcctcaagttggttgagaaagggaagtcagggagcaaaggagagttaatagggatgacatggaagaattgcagtgatagggatgcctgggaattgttaggagaacacttaggtccttagatgtctttatgttggtgtacaaaataggggttatcaaaactataaaaaccctggaagataactgaggcaataccattcaggacatagacatgggccaagatttcatgatgaagatgccaaagcaattgcaacaaaagcaaaaattgacaaattggatctaattaaacttaagagcttttgcacagcagaaaaaactatcaacacagtaaacagacaacctacagaatgggagaaaatttttacaaactgcatccaacgaaggtctaatatccagcatctatagggaacttaaacaaatttacaagaaaaaaaacaaacaaccccattaaaaagtgggcaaaggacatgaacagacacttttcaaaagaagacatacatgcagacaacaatcatatgaaaaaagctccacatcactgatcatgagagaggtgtaaatcaaaaccacagtgagataccatctaacaccagtcagaatggatattattaaaaagtaaaagaataacagatactggcgaggttgtggagaaaaaaacgcttatatgctgtcggtgggagtgtaaattagttcagccattgtggaagacactgtggtgattcctcaaagacctaaagacaggaatatcatttgacccaacaattctattgtggggtatatacccaaaggaatataaatctttctattataaagacacatgcatgtgtatgttcactgcagcactagtcacaacagcaaagatatggaatcaatctaaatgccaatcaatgatagactggataaagaaaatgtggtacatatataccatggaatactatgcagccataaaaaagaatgcgatagggacctggatggagcgggaggccattatccttagcaaactaacacagaaacagaaaaccaaacaccgcatgttctcacttataagtgggagctaaatggtgagaacacatggacatatagaggggaacaatgcacactagggcctattgaagaattggagggttgaaggaggaagaagactaggaaaaataactaatgggtactaggcttaatacctgggtgatgaaatagtttgcacaacacacctccatgacacaagtttacctacatgcccctgaacttaaaagttaaaaaaacacaaaaataaaataggggttataagcaaaatgtgtgcaacaggtggtacatgtgtaaagactgtcaagattgggttgaaaagtctgtgagagtgcctttgcagcttgcttctctgagccttaaggtgttccacctctaaaattggttgaaatgaggtattgtatggaaaaggctttggtaaacgaggaagtgctatacaaatgtcaaatattagttttttcattagttatattgttattttatgtcactgttataacattgacattctgttcagtgtttatcctggtttctcttcagatcatataaatcttgtgacttttacgaaagattcccatgaagaggaacaactctgagacttaaaccaatttttcagccttggtgctttgtataaaggatccagcactccccagtagtcctttcataaaagagccctgccattcccaagtccattgtcatgatttattgcttgcttgttgggatttcaccatctagaggtttttaatcaagaaagcctatggttgttttagtatccaaatccatgcatgttaaataatgactttttattgtctttataatgtctgccaacctggctgggtataaaattcttgagtatgccctgctccccacctccatccaaactgtatagggagtgttacttggcgttgaatattgccttggaagccagctttaattttgccctttgtacatgacttgagttttttcagagaatcagtcaggattcattcttttttctttggatttcagtgattttaccaggacatcttggtgttggtcataatatttcaatttgttttttaggagctgtgtgatcttttatttgtaggtttagtttggtttcctatttattttttcttctcaagggacatcaattgtccatatttttgtttgccttgtgtatatatcatcttccttttcattattttttttttaccttttcctttgcattttgctattttctcaagttgatattccataccattgactctattttcagctgtaactgtgcctcttgctgcttctgagatggcttcatattatgaatgaactgagcagaacacccaggcaggcatcagttggcctatggtaaatcttcctaggttatcataaaaaaattaacattaccatagctcagattaatagttggccaatagctgccttcttctccccagctcaacacatgcttgaactctccattctcctgagtaaaggaccttggaaaaacactccttaagaactggagaaggttgtattggttttagtatctgccattaattttatccacattttacagtatttggcaggtattctcatggttttaagaagcaatatagtgttaagagcatagttatggagaaaactgcctgggttttaattaaaatttttccagttgctagccatgtgaggttgggcaagctacttaacctcttgattcctcagttttcctcatttgtgaaggaggttagtaatagcactgctatgagatgaaatgaattaatatttgtaaaatgcttataaccctgctgggtacaaagtaggtgtcttgaagtgatcataagatgcattgtcaataaactttcctccccaatttctcaatcactttgctcatttcagtgggtttcacagaggtgtcattaactgtctttattccattatattgtgccagaggttgcctgatttgttttgctcataacgggattgttttaattattcatttagaattgcatccagaatatataactggctggctagtctgtgcttcttagattctgttttttttctcttcttgaaacgagaatacttgtcaatctttgatcttcagtaagtccatgatttctcaaggtctattgagtatatttctgtcatcatgtctgtcagttcttttagtactagatcctgactgatttgacctcagttggggacatgaactcatttgaaatggctaggtactctctttctatctttttacctctcttgggcttcaattcctcctaaattatgctaccactatctttttcaatctgaagatcattttctttaatagagatgaaggctgagaatttgagctatgtcattctgccctgtcttctctcttatctattatcactgtgccctagatactgggcacttccctgcctggttgactttcttgtcctgctccatttgtttgtgtgtttgtttgaagcacacctttgtgctgtccttagtatatttacaggaagtggagctcattctggcctttggtcttcttgacatttttcttattgctttgtgacccccttgggcttactcctggttgcttcccttctgtggatctttgtacatgtcctttgaaaatttctgcctttcagacagcttccttttcaatctcagaagtacttgtagatactttacccaccttgtctgccttggcattattgtactaattaatgtcttggggcacttgggaaagatacctgttgttccttaactccctgacctgggggtttggtttgggagaggtgagaagaggcccagaaatctgcatttccacaaacctcccaggtgattttgatgcacgtgacccccagatcacactcatgcctaactagtttggtgcagaagctcctaacctcttttttctgatcaagctgtccatgaagctgagttgatgagtgacctctggtgagtgcagggggactccctggggcttaccccagggtcaggtgcaatggttcttggcttgaagccagctctaattctgtgccttcctttgccactcaagaaagacaactgaatatctgaacttgaatctgttttcattataaagaattaaataactcgcagttttagtgctttattacttcctccaacatatcttccactccattactggtgtgctgtcccctggaggtgggaaaatgactcactcagcatcctttccttggctatttctttcttttcttttctttttttaagaaactggggtctctctctgttgtccaggctggagtgcagtggctattcataggtttatcataatgcactatacccttgaactcctgggctcaaggaggctgggctactcctcagcctcttgagtagctgggactataggtaggcgccaccacatctggctttcttcttggctatttttaactctagtttgacctggtcactttctccagagatttctttccttccacataatctgtaaattctgaatggctgtcagattaagtctgatgccattcactagaaaagatctttcattaggaggctctacttgaaaccaaacggactacagcacattttcaacttggaaagatttgaagaactgggaagcatgaagatctttgtacctaattcaaggcagtgatgtttggacacttcgactgtgtcgtgtttctcttagagctcttagtaggctggttattctgaaaggttggagtgtctcatagataaacaacaaacatcattgagtaattatacttttggggctcacgtttgagtattgacaactgtgaaaagaggaggtatagactccttacgagtttagtcctatgctctaagacatgtgcatttatcccagactctcgtataaaaagccagtgcccattgtgtgcagaatagggtaggactgaggccagacttcctgggatctagtcctggagctagcactaaccagctgtgttacttatctcctataaacctcagtgatcttatcttaaaaataaggtgataatgatccttacctcattcagttttggcgaggattaaatgacataaaatatgttaagagcttagaatatgtctggcacttagtaagtgctcagtgaatttatgatgcgtaaatggacatcagattatgtcagatttgtcaagctagtttttgatttttttttttccaatccctctctgatttttttctgcgtcacatctgttatatgtgccattttgaagctttgtaattttgggaggaagagtaatgggaattgaataatgtgggcagtcactgagctgttactataacaatatttgatccatagccattgggataagaccatgctatcaattgtagaaagtagcattagtaaaacatttcatttctatggcactttggagtttacaatgtattttctaatgtcctgtctaatttgaatacaaagaaaatatgaagtgcagagaaataactgattttctttttgtctcatcaccaggctaggtgtgacccgggtgtgcagcctcagcttggtgatctcacacatcatcaaagcagttctctgcagtacattgaagcacttgttgggtacacagagtacctgttgttaggttaagcattgtaggaagttgtaagaaaagcagctttgtatggccttcgtggccatgtgtatgtagttctgcctaagagcaaagttaaataaacttgtagccaatatgacaacacagcctgatgacagaaaaaaattccccagataaccttaaaactcacctagaaggagcgaggatttgtgtagtgttccggatgtccctttgttttcaccccattcctacgcccgcccagacttacctttgctgtcactggggctcttttggaggctgggaaggattttaatcctgtctggtcctttcccaagaatagcagtatgattgaaaatgtgcccacaagcataatctctgaattggtggatttaaaacaaagttgatgagagacttccaacggcaagtgtgtaaaaagaaaatatctctttaaaagatgttattgataatgaaaagctgagacccttgatactctgcacacggctagtatgggctttatacagattcagagacatccatgtgtgtcctgcttattggtccttaggctactcccgcccgcaaagtgtagcgctgtcttggtggatcctgccggaatgacacatctttttgctttgggatgattgctgggtcctggggtctctctccctgcctcttccccagccctaccctattgcacattttagtgtggcttagctctgttgcctttgtggtggttaacactcaacctcagagacaaagatctaagcaggaaggaggatctattgtgaaccggttggaagttgatttttgaccctaagaaattagttcaccttatcatcagatagagatgctatttgtacatttctccctcatacatgtacatttactctcaaaatttcctgggctagtaggtctctcaaggtggctgagagaccctagaaggtaccagtgtaccactgggccgcatccttaaagatggtgctgtgagggacagccatggaggcccatgtgcgccattgcccttatcccttgggggctctctggatgagggctttctctgtctttgtcttctcttgtcttcgaggtccttcttactcccttgtccaatgtgtgacatcttatcttttcctccatgagctccatttttctgttccaaatagctctagtctgctggtatattgtatttgttttttcttttcttttttttttttttttgacacagaattcccactgtcgcccaggctggaatgcaatgatgtgatctcgggtcactgcaacctccgcctcccgggttcaagcaattctcctgcctcagcctcctgagtagctgggattacaggcgtgcgcctccacacccagctaatttttgtatttttagtagagacagggtttcactgtgttggtcaggccggtctcaaactcctgacctgatgatccatctgccttgtcctcccaaaatgctgggattacaggcatgggccaccgcccccatcgtctgctggtatattatactcctttctctttgtttagttaaattatttctgctttgttttgatacataacagtggtatattagtctcaaccctttggaacatttttaggtcccgatgctatcatccattatgttgaagaggacaggtcaaaggaaagagccctgtgggaccttccctgtgaccatttaggatttagagtcatttggcctggaactgttatttcccagctacgaatccacctacctgtcccaccggtctgtgtctccagcctccacttctacacatggaaatcaggagaggctgcgtcttaaatccttttggtaaaatccagacatttatgacctctacctctcccatagtttaccatgcctgacccacagtagagttcttaagaaatactattgtcttttccccatttcttatttcctgtttaaataaaataaattcagtatttgtctttctagtgtgttgacatgtctcctattctcccaaattcctcaaagaccagtgcagcaatttaccaatctcattttcacattccttcagtgtaataagtgaattaaagccaatttattatccaggattgcctcatttatttcaaaataagctgtgtaccaagaaagctctattccctcagcaagagctaactccagttttaaagctcattctagagaaaaacagacttttatagtttgttttagctattaaagaccccttttaaaaaagaaataggcctttggatgttgccaggggttagaaagctagtccagagactgagaaggtaaacaaagaagcaggggaaaaactgattttgagtgtttagagtgtgtgaaatgtcacttttccccttaacctcttccttaaggaaaaggagagattgttaaagtagtgtctggtcagggcgcacacatgtagaaggtttctgtaactctagggtaaaatacagatctgttaaaattttcatgagtttcttttacttgtcagaagttgcctacagcttagatgatattttcctgatagtttgtaaacttctattgacttctctgtttttctattcgcccatacccatttattttctctttactgcattttactgtcttaggaagataaaacagaaaagcaaaacaaaacaaaaaccccaaaaaactaagtctgaagcagactgttgaataatattactttaactgatgaacagattttcctcccacaaagaaggaaaaagggagaaaattcgtagctcttctctctttttaaagactgtgctggaaaattccaaaatgttatcggaataaaggaatgacttcgggggctcagaacaactcggggaaagacactaaaatttattgagcatttaacgtcacctgccagaaatttaaaatgtgttttttaaagaacaaacatttcatgattttattgtatccttacgacagcctttcagggtatggggattatccccattttacagatgagcaaactgagacctggagaggctaagtaacttgttacggatcacccaggtgggaactgaccgaattaaaatccaacacttcatgccaggtgcggtggctcacgcctgtaatccaagcactttgggaggccaaggcgggtggatcgcctgaggtcaggagtttgagaccagcctgaccaatatggtgaaaccctgtctctactaataatgcaaaaattagccagacatggtggcacatgcctgtaatcccagctactcaggaggctgacaggaggatcgcttgaacctgcgaggtggtggttgcagtgagccaagagcgtgccattgcactccagcctggagtgcaagactgtgtctcaaagaaaaaaaaaaccaaccaaaaaacaacactttgatttgctgtaagaccctctctgtgaatattaaactggtaaacctcatacataatgatgagattagtcatctacagaagtaactcagggcttgtctgtaaacatcctatgctccaaagtgactgcagtgtaatctcaggaaggcaagactggaatgagatcgtaaataaaaaaatggacatctaatacatacattggtctcgtctgaagaaagactgttaacagagggggatggtcagtatggaattgtaaacaggaggtcaaagaggacgaatgtgttatttacacccaccagaacccagggaagtgtggtgagaagcagcaggaactcttctgtctgctcggcaggcgggcagctctgtgtggcggagacatttgcttccactattatggttgaagtcagcggccataagatcatctatagactgagagaaggcagtgtggacaagggcctcagagcacaggctctctaggggagcatgagttcatgttctccaatctttccaactaccatgcatggaagatattagaatgaacttttccccagatgagaaaacaggcatggagaagttacacttgggcaagtcaaagaggggtagagataggcttaaggccagtctaaattcagaactctcttgactacgttgctctatctctctctctctctcttttttttccttgagacggagtctcactctgttgcccaggctggagtacagtggcctgatcggctcactgcaacttccgcctcccgagttcaagccattctcctgcctcagcctcccaagtagctgggactacaggcgcccgccaccacgcctggctaattgttttttatttttttgtatttttagtagagacagggtttcaccgtgttagccaggatggtctcgatctcctgacctcgtgatccacccgcctcagcctcccaaagtgctgggattacaggcatgagccaccgcgcccggccacgttgctctgtctcttaatagtcttgtcattcctgggatgctgccatttgttttcttttctaatggatagtggatcatgaagatgggttcacatgggcgacttgaattctagagagccaggcaatgtcacagcttcctggccagtttgtgcctgttgggggattccccatctttgatgcctttgacttccagtccttgagggacactcacttccctggcaagcactgtcttggactgcatgagtgattttctattggttggtttctgaccgggcgggcacttagctccatgctggtctgtgcctggctgagatatctaagagcagctcattgccatattctgaatcccagccctcaggggagcagccagcacctctgcttcctgcctcctctggcagatggccctgatctgagagtttaagtgatagctatctgagaggagtgattggtagagacagtagcaccttattttaataatttaaaaatcataaaatatgccactttggatacaaaagcttttaagaggcacttaataaaaatgtttagttgctttccacaatgagaaaacattgttataactaaagcacacttcagatatttaagcattaaagcatccccagagacttattcttaacagtaaaatgtattgctttgttcaagatgattctgtaatggagaggcattacagaggcaagaagagacgagaattctttgtaattagtgtgcactgtttgaatgtaaatgagtacttgaaaacagtttgctctcttaaacatcctaagttttcccactgtcgtcttccataaggtattaattggtttaaacagcctctttatttgtaggcagcacaaaggttaacttcagtccagcccctgtctagttatcatcaactccaaatgctaatgctgtttgaattcatcagacagaattgagctttttgtatgtagtcatggcctcttaaaacttacaaggccaggcgcagtggttcatgcctgtaatcccagcactttgggaggccgaggtggatagattacctaaggtcaggagtttgagaccagcctggccaacatggggaaaccccgtctctactaaaaatacagaagttagccgggcatggtggtgcatgcctgtaatcccagctacttgggaggctgagtcaggagaattgcttgaacacagggggcggaggctgtagtgagccgagatcgtgccactgcactccagcctgggtgacagagtgagactcttgtcaaaaaaacaaacaaacaaaaaaccaaaacttggaaagtatatatagtgtctctatatgaaatgagactagagaaattttataaaagaagggtcctcaagtatagataaaagacaactgtattttattataaatgctttcttatatctcagacccaggtaagttacaggtcatgctcagcacctgcccccgtgcatatagcagcaggttgttgtaacatcagcttattgagaatgtggatcactataacataggagtcgtgttatgctgttcttttaattccctcataccagtgcactacattccaatactaacatgtggaaaaaaaatactgaatatccccttgttttttagtaagaccatagagcagaacatttgcaattttataatggttttatttttaaggtcaggcatttaaagtggcacaaagctttgatgtgggcttacatctgagtattataaacatttagcacaaagtaagaacttacttaaaagatgctccagcttccagtgtgctgtttctgtgtgaaatactgaaaatttgggatcattttaaaaataaacacttatctaagttggcatgcaaaatggagcatttagaaagccatgaaaataagcccatgcataaaatatggcattaaaaaggtaactgtgaactttacagatggactagcatgaaagaagctgtcttttgctagggtggatacgagagtttgcagctctttgctgcaaaaaaataagagcagaaacttaagttgtttagttgttttgaaataacagctacacagagggctccttctggttcatccatattttattagggcagcagttaaaaaattcattagagacacccatctgtagctagcagcacccttgaggggggctcagatggtgatcagattttggagtagcactttacactaaaagaaaaagacaatcgtttaggagaattaatagcacaatggagaggggctgcttgatgcatttgaagcatacccttccacatggtttatgaatcttttgctactgaattcctcagccacctgcttcagttgggaaagagagatccaggcataacaaggagagaaaaattggatcagagagttgagactgtattggtcagtggagaacatagatagagtgtctatgtgatccgtgttgggctctcactcgtgtgtgtttgtgtgtgtgtgtgtgtgtgtaaatcacgttggcctcctggggaacttcatcagtacaaaaaaaagcttgtggtcagagctgaggctgccctggtttaccttggccttgaactccacctccctggtggtcaggtccaggtgcctttgcctcatctttattcatgaattgaaaataactctagttattgaatggcaatggaggggaagtgacctctcctctaccctcctagattccctagctgggtctatgaaattgacaacagatagattaacaggagaataggcatagacatttattttttttttttagaaggagttttactcttgttgcccaggctggagtgcaatggcacgatcttggctcactgcaacctccgcctcctgggttcaagcgattctcctgcctcagcctcccaagtagctaggattacaagtgccctctgccatcataccctgctaattttttgtacttttagtaaagacagggtttcaccatgttggccaggctggtctcgaactcctgacctcaggtaatccgcctttcttggcctctcaaagtgctgggattacaggcatgagccactgtgcccagcccatttattaatttttaatattatgtgcatggggggcatcacaggaaaaaatagtaaataccccaaagagcggtgagatttgagagcttatatactgttttcataggggaaggggaggaggatataggttgtgatttttagaaatgtgctgttagaacagcagatggaagataggagagtttgtgacaaagtttgtctgggtgtggtgtcgactcctagtttcatctcctgcaatacaaatctgtcttccctggttgatgaaacttccaggaagggaattcatgacaactgagttccctttggcacatctgttttgggcagataaagggagtttagagaaaacctttccctgcacttgctgtttttcaagtgccttcagctcaaaataatcaatattccaaagcagcatagtttggagtggcttattttggtttccttcagtgactctgtgccaggcatggtatagcacggttaaagtcataatctcatctatccttccagcaatcctaggggtggagtcccatttcacagatgagataatggaagcaacagagaggttagtcacctgaccatgctcactcataagaggcagagctgaatttcatcttctgctattaagtccaggtccataaactgtgtgcatatacatgttttttttagataaactttctattttagaataattatagatttatcgcaaagctgcaaagacagcacaaagttcctttcacccagcttcctctaacggtaagggcttatataatcatggtgcatgtattaagactcaaaaatgaatattggtgcaatgaactaaactacagatcttattcagatttcaccagtatccttttcctgttccccgatccaatccaggatcccacactgtatgtcacatgcatggtttttgacccttaaacacgaagtgggctggatgtcaaactgctgggtggcctgtttctcctcattactgatgaagaaagtgagacgctggtgccatctgtcaccttccttgtggggcccaggactctcattgtctaatggaaaggggaaatcctatgtagggtagaagatttagaacagaggcatggggacaaattttaaatatagaccatactttttctacttgtagtagtttgtagctaaaaccacattcaagaaatagaaaaagattgggggagagagagtattctgcaaagcaacaacctctctagcatcattaaagtttatgatgcatttgaatcccaagtgtactaggatgttaaataggacttttccttaaaacaaagccttccagtcctgactgcctcctagaatcacctggatagtgtcaagaagcaccaataccggaggcccatccctcgatgttgtaatttcatcagtcttggttgtgatctgaacctcagaatttttaaaagataccaccatgattttttttttttttttttgagacagagtcttgctctgttgcccaggctggagtgcaatggcgtgactgtggctcactgccgccttgccttcccgggatcaagctatcctcctgggcacatctaggatgcatgtaatttgcctgtattctgtgaccaacccttctgtgaacaccccctctgtgaccaacccctcctggaatcccagtgtggtttccttggatggtttctggtcacttttttcgcaagccctcttcttctttcaggatttaccttcttaggcggtctcatttaaccctcctggctttcccacttgcatggcatgtgtttccacctctctgtggcccaggtcctgccttggccctgtcctctcggtccccacctggaagccaccctgggcctattcccatcctgtcttctgcctcttcctccacagctgccacactgtctgtacccaagtcccagtggttctgaacttcttcaagctggctgcactcaacactgcctttcacactgtgcttgctgttctctccaccggcaatgacctcaccctcctttttggcttgggaagcctcagccttccagtttactttcctggcctcctgcagtggagttgctcacagcctggtctgcatctgcttgttgacatgtctgtcttccccagggagccatgagctccattgaggacagggaccatgactttgaaaaattaataattaatttttagagatggggttttgctaacttgcccaggctggagtgcagtggctattcataggaggaatcatagctcattgcagccctgaactcctgggctcaagtgatcctcccagctcagtcttctgagtagctgggactacgggggcatatatgcacccaacttgaaaaagtattatcaaatatttcacggttataaaaactgtatttatatataattatgtgtttaatatataattacacataggttttacatgtgctgtttgaaaataatacaatcagttcctgtgtaaccaccacttaagaaatggaacattacccttgaattactatataattgcatgcattttttcctatgtattgtttgagaataatacagtaggcacctgtgtaaataccagcaggcttaaaaatggaacattaccctcgaggtcccttgcacatcacgtcctgttccctgttaagactggtttatcattcttttgcttttgtttatacttttagcacgtatctatctcttgtgctaaaagactgttacaagcagaacagtcattccagttttagtgattctgggctgagactgtagacaattaaataaaaagccaattcagtgtaggattcatgccttccgactgtgaggctgttgtaaggaagtagcgtttgtgggaatgccacccaggagtcaaatctctagcctttgggtgatcaggaggctgacaggaaaacagcgacagagctttgcctctggtggaactcctggtggcctgcagacctgttggcgtctgtacctgcagtccactcagctttccagatgactgaaatgccccaacagggtagagtggctcgcctctccaagaaagagcagttggtgaataatcatgcctgggaaaacaatccgcctggcaaagagatggatggtatccgttggtgaatgtgatggcagcaagcccagtgcaagattctgtggcgattccttgattgacctgctcggttggtggattttgaaagggagtgggaaggactgcttcacttgcgtagaactctccctctctcttgcgctatcttcatatcgatgtctacctttctctttgtgtatatgtgtttataaatatttcatatgtatatttgtgtacagacatatacacatttggatttatatttgtatacattttatattagtcagttttcatcctgctgatgaagatatacccgagacttggaagaaaaagaggcttaattagacttacagttccacatggctggggaggcctcaaaatcatggcaggaggtgaaaggcacttctttattttatcttattgtattttttttttgagacagagtctcgctctgttgcccaggctggaatgcaatggcgtgatcttggctcactgcaacctctgcctcctgggttcaagcgattcttctgcctcagcctcccgagtagctgggactgtaggcgcctgccaccatgcccagctaatttttgtatttttagtagagacagagtttcaccatattggccaggctggtctcgaactcctgacctcgtgatctgcctgcctcggcctcccaaagagctgggattacaggcataagccaccacacccggactggcaaaaggcacttctaacccaaaagtccacagtccaaagtctcatctgagacaaggcaattcccatctgcccatgagcctgtaaaatcaaaagcaagttagttacttcctagatacaatgggggtaccagtattgggtaaatacagctgttccaaataggagaaattggccaaaacaaaggggttacagggcccatgcaagtccaaaatccagtggggcagtcaaattttaaaactccaaaatgacctccagatctcacatccaggtcacactgatccaagaggtgggttcccatggtctggggcagctccacccctgtcgctttgcagggtacagcctccctcccagctgctttcacaggttggcactgagtgtctgcagcttttccaggtggatagtgcaagctgtaggtggatctaccatcctggggtctggaggatggtggccctcttctcacagctccactaggcggtaccccagtagggactctgtgggggctccaaccccatatttcccttcctctgccctagcagagattctccatgagtgcccagcacctgcaacaaacttctgcctgggcatccagccgtttccatacgtgttctgaaatctaggtggtggttcccaaaccccagttcttgacttctgtgcacttgcaggctcaacaccaagtggaagctgccaaggcttagggcttggaccctctgaagccacggcccgagctctatgttggcccctttcagccatggctggagcagctgggacacagggtactaagtccccatgcacacagcatggggaccctgggcccggcccacaaaacctttttttcctcctgggcctccaggcctgtgatgggaggggctgttgtgaagacctttgacatgccgaggagatgtcttccccattgtcctggggcttaacatttggcttgttgttacttatgcaaattcctgcagctggcttgaatttctcctcagaaaatgggtttttcttttctgtcacattgttatgctgcaaattttctgaacttttatgttctgcttcccttatatatctgaatgcctttaacagcacccatgtcacctcttgaaggctttgctgcttggaaatttcttccgccagataccctaaatcatccctctcaagttcaaagttccacaaatctctagggcaggggcaaaatgctgcccatctctttgctaaaacataacaagagtcacctttgctccagttcccaacaagttcctcatctccatctgagaccacctcagcctggaccttattgttcctatcactatcaggcttttggtcaaagccattcaacaagtctctagggagttccaaactttctcacattttcctgtcttcttctgagccctccagactgttccagcctctgcctattacccagttccaaagttgcttccacatttttgggtatcttttcaggaatgccccactctactggtaccaatttactgtattagtccatttttatgctgctgataatgacatacctgagactgggaagaaaaagaggtttaattggacttacagttccacatggctggggaggcctcagaatcatggcgggaggtgaaagacacttcttacatggtggcagcaagagaaaatgaggaagaagcaaaagcagaagcccttgataaacccatcagatctcatgagacttactcactaccatgagaacagtatgggggaaattgcccccatcattccattgatgtcccactaggtcccctcccacacaacatgggaattataggagtacaattcaagatgagatttgggtggggacacagccaaaccgtataagatttgtattatttttatatcacgcatgtgtgctcccccaacagtgttccttcatgcacatggatggtggtgttgaaaatgcactttctgttggacttccaattttaggccaagcttaggcccaggttgttgaattaataatgaataaatctagataaaaatagaatggtggttaccagggactggggcagggggaaatggggagttaatattcaatgggtaccatgtttcagtttgggaaggtgaaacagttcttcaggtgcatgatggtgatgattgtacaacaatgtgaatgtacttaatgccactgaatgatacattgaaacacggtaaaaatggtaattttatgttacgtatatgttaccacaattaaagaaaagtaaaaaaaaaaatcatagggaaaattcaatggaagcctcaggaaatggtaggggaggtcaattccaaaaccacatacattctaaaatgtcagaaatggtcagttagcaaagtaaggattaattagattttacacttgtatgtctttgttgacatttctgggaataaagagagaagagtgtgataattcctcttctatgtcagttctagaaccttctctttgttccttaccctggtgcttgtatgagtatgtacaaatgtgtgtgtgtgtgtgttgtgtttgcaaacatggacaatggcgtgtgggtttgctactctatttctagtatttctgtgccaccttattaataggagagctgtgggatcaggcctctggatgtaaccctgtccttccttagtgcttctgagttcaaactgactaactcacaaaatgcgtctgcatcgggactgacttgtggcattcattttctcaaagggcaaaaaaccttttgtttctggtagaaattaaagatgtgtttgtgacggccctcacttctttttcaccaaatgcagcacccttcttccctttaatccgatgaggtggttttatggggtggcacataacttggagctcatgggaggccttagaaccattaaccaactgagctaaccaggttcctccattagtttaatttcaaattgaattctccttcctccatgattgaaagagtacattcaattcctgtaacagtttttatatgcctgactgacatcccttcctaaagcataagcagtttgagggcagggatggtgtcttgtttatgtctgtaccccatgtatcatctagtgttcaataaggaattgttttatggaaatggattacatgattaaattggaaatagaatacaggttgatttattccacccccagcttgccttgctcactggatgcttattacagtgacctgaaggcacttcagaagacttaagtgctctctgaattattgaaggaagatggactttggctcagtagagtgtttgtgcttagtgcctattactggattctgattctttggaaacaaattaatccagagggatatattgtttctttatggttctgaatatttggttagcctgaatgtattaagatcttacaccccaaccatgacagatgggattaaaattccttccctgaaaagaatatattcctttatgcttccactataaatttatatgcaagtcatgttttgtaaagtcgtgttcttctcttgctatttggtgcattccctgcagcattctcgaggtcccagcattttcccttcaggagaccttagaattattggggtacggggcagccaagtgacctgcccaagcccacgtgtcttttttttttgttgtttttttgagacaagagtcttgctctgtcacccagactggagtgcagtggtgtggtctcggctcactgcaacctccgtctcccaggttccagtgattctcctgcctcagcctcccgagtagctgggattacaggtgtgcaccaccacgccaggctaatttttgtatttttagtagagatggggcctcgccatgttgcccaggctggtcttgaactcctgacctcaagtgatccacccacctccgcctcccaaagtgctgggattacaggcatgagccactgctccaggaaaaaaactgagtatcatgttttcttaaactgcatgtttaagatttcatatttaaaaatgaatattgtctggccaatgtgtattttaatttcttctctgatatactgtaaactaggattgttttaggaattataaggacctcaggaaacttctgtgtagtataaactggaaacaattcatatccaccacagaaaataattaacagtgctgggtgttaacaatacttaggggggaatgagtgatggagggaatgagtgatatggacaattggtgaagccctgttgactgggtgatcaggagaagggagctgatgggggagggattggaagctgaaggctgagaaggatttggatagatgaagggagaacataagagggagggctgacaggattcttgctgatccggctggttaatattggcttgccgcaattttccttctaagctaggtaaacatatatttccaggcatcctatttggactgtgtatagagacccattgacatctgggtctgttctaagctgctttcacttccctccaatcagagcttgttgggctcaataaggtggagatgggggtcatatattaccagggcaagcaggtctgtgcttcagagaggaagtaaggcatcagcgcttccctctagaattgatctgttgcggaacaagagtcctcgagcagcagagaaagctgcgccaggctccctttccctgctcagtcgttcgttcctggactagatgggtggaacgaggcatctctgggtttcacagagcacagagggcacggcttgtttcctaaccgggtctcaaaacctgcctgcactttgggctttttcttcaccttgccatatgttgcttcctgcccttttgaacctccttccggagctgattgcacttatgtgctaggaaaggagtatttgtcttcaaggtctgaatgcatcctaatccttattgaactgcaaggtgtgatggcacgacttggatatgtaagtgagaattgattctggtcacaggggatgtcataagtttcctcaaaaaataaaaaagaggaaaaaaatagtgagaaaaaatggcctttcgttatgggaaactgggagtttttcctacagatttcattcttgccttatatgggtttcctggaattcttctagcagattccagcagtgccctccggatctgccctctgccctctgagggttaggattcatagtgtgtgacagtctttgctattcaggccaccttctgggaaggccagtggccaggggatggttttcatgagccctcagcagggtgcagaagccaggtggttcccatatctcattcccacttttggtaaacacctctcttatgtttgccctcctgggcttgttgcttctggtccccggctcatcacagcttcccagggccccggtagaaacaagggttcacagtgggtaacctcactgtgctgcaactggaacctggcttgcaggatttcaggacctttggttgagtggttttagaaaaggctactcaggggctgggcgcggtggctgtggctcacaactgtaatgccagcactttgagaggcctaggcggggggatcacctgagatcaggagttcgagaccagcctggccaatatggtgaaaccccctctctactaaaaatacaaaaattagctgggcgtggtggcaggcacccgcaatcccagctacttgggaggctgaggcaggagaatcacttgaacctgggaggtggaggttgcagtggggtgagattgtgccactgcactccagcctgggcaacaggagcgagactgtctcaaaaaaaaaacagaaagaataaagaaaaaaagaaaaggctattcaggctgaagtgccctcaggccttggaaaagaaatgaaatttcaaacaaattattttctacctagcctttttcttttaacttcagaagggttatctggatgactggtatttacatacaaaaaatagttaaaagtctttttaaaccacagacagtataggtttcactggactcatttttcaagatacgaaattgttgaattgttttcctttggtaattgaagccagaattcagtgttttctctaacttcttttcggattctttgctctctggagaacgttttgcctgctttgcaagggggtatgagtagtgcgtgtgcctgagggcctctctctgccccctcctaacgcctggccaccctgttccgactgctgcccctgccggtcgggcccggacactgcagggagcctcacatcctcggatgacggattccttctgtacatctcatcacatccttttctactggcttcaacttgcatggcctctgtcttgaagaaagaaagaaaaaaatgaaatgtttcttctgccttcctgtcattttacgcattttacgctgatatacttgtaggcaaagggaattgaaagggcatgcactttggaacgagacaagcctcagttcaaatccgggctttgggaaaccatgatccgggagttctggggcaaagtaaggctttctgagctttagctgtattattggtaaaatgggaatagtaccgatctcctagggttatagtgttaaatgcctcccttcctttctttactctgacttcttccaccaccacctcatggtccctgcttccattcctcccttccttgcaagcttccggaattctttgtaccccgggcagcaatagcccttttggagctccccgcaattggcaagagcaagtcactgtgtgagcaagtcttgggctctgttatcttcagatgctcaagtcaggaaatagggggctagaggtcattgtgctcatttccccagagattatcaatgccacccccaccccttttaggagatggcatgtgccatgatcgtagctcagtgggatccttaatgcctagtgatctcggcttaacaggacaaagattccaagcccatgtctgttctgggaagcaaagcaggatgtgtgggcctggagtgaagtttgttccatttctcgccataggccatggtatgattacagctgtgcctagtgctgcctagttttactttcatgcctgatttgcaatgtggcagggtcctgagatgagagctctgtgtgggccagtagagtcaagagactttgtcctggtcacttggctacttgcagggggttctggaaagtcaagttctctgaatctcagttgcctttaatataaaaggaaagctatagtttcgggtcggattgattcacatggttttggtcgggagtgaatgaaattaatgtaaattaaaacacattatgagtagcaaagtgctatgcaatctaaaaataataacattttaatcactcttatcatcatatgtgccaggcactgttctaagctgtctacaaatagtaactcatttagttgaatgctcacaaccaccttatgagagagctactgttaatatcaccactttactgatggggaaactgaggcacagagaggttaagtaacttgtggaaggtcacacaaccagcaagtggtacaatcagggtttgaaccagtcaatgaggagtcagcatttgttattgttcctattcctatagcatagctgggaagggaatgcaatgctggtttggagaacacatcaagcaggcctcctgtcatccactgagtgagatgagatgatggccatacattgcggcacagccagctatccatggtctgcagcaacagatcagtcttgcagggacatggatagctccgctagtgaacattcacatgttcaacgaatagctagagtaaatagttggatctcatttagaggcatgctctggcattcctctttcacgtcatttgctttccaggcccactccaggatgagagtactgaggtgccataaaagaccaacaggcaagatgttggagggttcaggagctgccaaggttgtgttcatgctgacctgttggcatagcgtacagcagtgccagctgctctgctaaaccgaggagctgagatgctgtgttgatttctacatgttccaggcaaatacttcctgaggattgtcaggatttacataatggattggccctgggaccactgagccagcatctatctttgacaggtgtactgagagatgacctttaaacctagggatgttctccagatgcagttccagctgggccagtaagatctgcatgtttatggtgctgttttttcttttcttcccaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtcagtgtctcttccacctctgtggcccgagattgtcgtgagctcagattagcactgggcagacggcaggaaacgaggggttctgggctcaactgacttcctcctggaagctgcagcagctccttttggagccggctgcacaggatgttgctgcacttctgtctctttgaattggacacagatctactctcctttttgtcttctctgtcacttaggtgctcagatttgctctccattgggccgcaggctcctctgcaggccccggcttaggtgagacgtggttcatgcagcccagctctgctttgagacaggaaactgggggcaggggagattgagctgggtgatgtttggaaggacttgagagatacaaaaatggggatgccctctatcagggcgatcctgctcttcatccgcttcactcattcccttccatcctgctgcagtggctgctgccttccacagggtcgggagacttcgcttctggtcattgaacctctttggctctcagtttccgtatttagagataacaccaactcataggattgttctaaggctcaaatgagaatgtagctgctttggaaataagtacaaactggagacatctaaggcccagccttatgatgatgctgtccatccagttatctgagaggtgggtatagccggaagtaggtagggttcctctacccacaaaagttcccagagaagcccaggtagagatgctctgtggctcatctgttgccagactgtattttaatcctggtgtgtgtgtgcatatgtgtttgtgtgtgtatgtgtgtgcatgtaggtgtgcctgtgtgtgcgtgtgtgtgtgtgcatgtttgtgctgtgtgttcatgtgtgtgtgtgcatgcatgtgcgagtgtatttgtgtgtgtgcactcatgtgtttctgcgtgtggtgtgtggatatgttcatgtgggtagggaagtggagcacccactcatcaggcatttgggaggagtaatctgcagaagttcatgctcattccccgaaagagcatctcccatctgttctttatctatagtctgatgtttctagccctgtccctgtttgccctgtttcagccctcagggacctcagcccagccctctgatttattatgcagagagggagtgaggtcagagcacagatgcaggcttgtattctgggtgatgtgtggagtcttccagttagtcattgcctaaaccagtgccccttgtctttccccgaaacccgttctgaagggcctccaatattggttgatttgaatgcatagaatctatccagtttcttaggccagaaaccacaaccatcttccacacctccctctcccttgttccacatctggctggcctccaagccctctcagtcctactgctaatctgtctctcatcaccatggccgctgccctggctcagatccttgttatctttcacctgggttttgcaagagggtctaccttcctgcggtgtttctcttctccagttaattaaactaaatgtgatcatatgtgcaaagtgcttcagacagggcctggcatctagcaagtacccagaaattaaccattgtcatcattagagaaatagctccaatttagagagtttgagtcaaaagcaaatgaagctctcccttctgtccatagctcaaattaaattcctatcttatctcaaatggtagaatctggacacactttttctttagtgtaagtattgttgtctatggcagtcccacagctgggcagggaaaaacatgacactctcttcaattacactcatgtactgcataatgacattttggccaatgacggatcacatatatgatgtgacagtggtcctgtgagattatcgtactgtgtttttgttgtaccctttctatgttcagatatgtttagatacaacaataccttaccattgtgtgacacttgtctgcagtattcagtacagtcacatgctgcacaggtttgtagccaaggagcaatagactattccatctagcctaggtgtgtaatgggctacaccatccagatttgtgtaagcacactctacgatgttcacacaatgatgaagtcacctaataatgcatttctcagaatgcatccctgtcattaagtaacgctaggctgtacttgagtatctgttgtgtgacagcggaattaacagagtagtgggaatgacagaaataacacagtccagggcataggacttacaggaaggcagagtttgcctcaataggaggaagaacctcttgacagtgggaattgtctgtgatgaggtgggctggtcagggacttgttttcccatggtgcttacacagaggccccagactgctcactggggttgcggctgaggccttcgggacagggcagaaggtcggtgaaggatctccaaaaagatcctttgaaagagtaggatttctagtgtttgggggccttattgatattatattttaattccttaacctcctctcgcttctacttaagtaaaaatgagaatctcaggaatttaagtttcagcttcttctaaaagatggttgatcctcagtgtttgtggattctatatgtgtgaattcgtctacttgctaaaatttgttgttaactccaaaatcagtactcacagcacttttatggtcatttttcatttttattttattttttaagagacggggtctctgtcttccaggctggggtgcagtggtgtgatcataactcactgcaaccttgaactcctgggctcaagcgattctcttgcctcagcctccctagtggctgggactacaggcgcatgccaccatgcctggctaatttttttttttttttttttttgggtagagatgagggtcttgccacgttgcccaaactggtcttgaactcttggcctcaaatgatcctcctgcctcagcctccaaggtactgggattacaggcatgagccaccatgcctggtggtaattttgaacctgcacagagtggcaaaatatttgggtcacctgatgtacacgctttctacttaggtcaaacaagttcagaccagatgacattctaccttctctctcatactacaaactagtatcctttttgtggtctatttaatgccatctttttttacatttttgtgctctttattggtgagttaaccattgcaaaagctccctaagcatagtgctaatgtcatctagtgctcctaagcatgagaaggctgtgatgggcctgatggagaagatacaggtgctccagaaactttattcaggcatgagttagagtgctgttggccagagtacaatgcttatggatcaataatacatattaaataagatgtttttaaacagaaacacacatagaacaaggtcatgtgttgaccgatggaggaaggtgttgtgaccaggggttcacaggaacctaccctgtatttctcttaggagcaatgcttcattattccctaattcagtattcacagaaactttatagaacataactacagtactgtgaataaggagaatcgactgtgaatattttatgctgtttagaaatcgctgcttagcgagatttccaggggttgcatgggactgagaagatggtaataaaggtagttggtgaccaggcatgcagaggaggggaagtggagtgggccctgcaaggtaggctccacctaaggccatggaaactggtgaaaaatgaaggactctgcctgtagagtattataggacgttccacaggcagggttgtggcacagtgcaagacatggccactggggctgtgcctccagcaaagacgggtattcagacatatctcagggcagtccattcagggccttatagagatcactggacgaggtgggcatcgtggggtgggctttggctgtaaatgaatttttttcctgaccttgtttcctgcatttcttcagcttctgttctaataaatgtttaatgataccatcatttgggtgtggcgatggtaatgctatagctttatgtggccctcaaaccattcacacagcctttcttctgtccctaatatataggactaagttactggtaaactttgcagttgtaatatagaacaattcaaagacaaaggggttaatatgattattcattcattctttcattcattcagaaagcatttatcaatgacaacgagtacaatgccttatcctaggctttggagattgtattaggacaggctagtaacaggcactacgttagaggctcaacacaacaaaattgtgttttttgcgtatgcttcatgttccacagagatttttggggggcaagaacccagcctgcaccatctgaacatatgatccccttagtcacagacttgaggaagagaatgttagggagtcctacaagagcgatcaaatgcttcagcgtagaggtaaccccatcactgccactcataccctgttcagcagaacaaggagagaggcacttgtactctttccatgtgcccaaagcagtggaaaatcaagtcagtgtaagtactagcatcctatacatggatgcaaaatagttcttgccccccagatgctcaaggttgaatgatgtgcacagataaaaccaaacaaaggaaaatgatggctataacctggtgcaataagtactccattcttccagtgggtcagaaaaaaaaacccaaaaaacaaaaaacaaaacaaaccttggcatcatcctggtgcattttcctcagaccccacctgtgatgtattagcaaatcctgttggctctatatttaaccagcggtcttctgaatataaccggaatcagatcacatctcaccatcttcaccattgccaccatcctcactatcatccaagctcctgtcatctccttcctgaatgttcccatagcctcttacctggcctcccttcttctgctcttactaacagcagccagagtgaaactgtttaaaacataagtcagatcatgtgctcctctgccccaaactctccagtggcgccccatgaacttcagagtaaaatcagaacttttaaatggtcttcatgtctcttcttgacacagtcctcattacctgtgtgacctcattctctacagttttcccttacatcaatctgccccagatccagtggcattcttgctccctcttgcttttcatttcactttcacttcttgctttcttaccagaaacacttctgcctgagcctttgtactggctcttccctctgtgggaatatttttctcccagacagcctcgtggttcactcccttaccacttttaaatctttgtgtaaatgtcaccatctcaaggagatcagatttcaaattgcaacctctaccctctaccagcatccctgatccccataacgtggttctcccttttcctttttcatagcattaatcacttgctaaggtgccataaaacttacagttgacccttgaacaacacgggtttgagctgcaagggtcacttatatgcagattctcttccacctctgccacctctgagacagcaagaacaacctctcttcctcctcctcctcagcctactcaagatgaagatgatccactttcacttaatgaataggaaatttattttctgttttttatgatgtttttcgtcatctagtcaatgctgaatttttttctcaatgatttttaaataacattttcttttttccactttacttttattgtaagaatgcatatataatacatataacaaacaaaatatgtgttaatcaactgtttatgtttttggtaaggtctctggtcaacagtagactattagtagttaagttttggggaagtcaaaagttatacacagattttcaactgtatagggccggggttggttcccataatccccgttgttcaagggccgactgtattatgtttttgcctagaatgtaagtctggagggctaagcattttatgatgtatccttgttacatcaacacaatacaaacagggcctgataactaagaggcactcagtaaatatttgttgaatgggtctatgaatagaagaagcaagtacaggtcacaatggaggtatagaggagggacatttaacacagactggaggagacgacacttgtgctaggggttgaaggaaatgtaggtgtgagccaggcaaagaatgggaggaagatgtttttcagggatcaagcccaaatccattcattggtaggccaagaattcattgtcagtaaatctttgggtctcctgttgagaagaacaatgattgtattagtcagttctcatgctgctaataaagacgtacccaagtctgggtaatttataaagaaaaagaggtttaacggactcacagttctacatggctggggaagcctcacaatcatggtggaaggcaaaggaggagaaaggcacatcttacacagtggcaggcaagagggcgcttgtgcaggggaactcccttttataaaaccatcagatctcatgagacatattcattatcatgagaacagcatgggaaagacccacccccatgattcaattacctcccacgacatgcgggaattatgggagctacaattcaagatgagatttgggtggggacacagccaaaccatatcaatgatgctaaatcaacccattggtaacactcagagaagtaactggatcactgagtctccatgtgggttaaataagactgcccttttctgtaatggaaaatatttgaaccttagggcttctcagaagggttttgtgagagctttgccatcattcttactcaagccttcaggacagcctgctgagcttaagttcatgctctttttctcttggtttctctgccaattttggtgtgtttaccttcataatttaaatgtgaggtttagaacagagaccatttggtcaggaaatttgtattccttctcattatgcatttcttcatgcagatgagggcacagtgtgatgtttttgtttaaaataaaataacattttaactttttatgtggatgttatgctcaaattacactttttctttacatagattttttttggagaaactaatgcatctggcattgaaaaaatgtgcatttttgttttttttttaaaaagagaatgaagaagttcagttttgaaacagtttctaaatgttcttagttttcacaaaaatgtttgcttgaattctattgtaattttttattttttcccctttaaaccaacataggtaatatccttaagattaaaacttcagaaacttcaggaagatgcagttgagaatgatgattatgataaaggtgagttttaatttgtttattgattgttttgtcatcatgtcccaattttctttccatctttactcatatctaccttttgaatcccaaaagaattgtacaatctgttcctctgatcatctctaccagggaatagttgactcttttacagcattattgttttgtagatttcaaagtacttcatgaacattaatcctttgggttataaatataaccttatcaattgtccagaaacacttagcatactcacacaataaaaattatattagcttgccacctgtctgcccatggtgtgatgtatctataatccacttgttcataaaaaatattcgtctgacacctatgatatgctagggaatatgggagacaataggaaagtaagacagacatggtatctgcccttgtgatgccagtaaacttaagccttcatggggctctctgacttcataatttccagaaccagagataggaaatgaggtgaatttgagaaatgtcagactgtgccaaagggggtcacatgcatcaaatttccacatacatggcctaaaatacccaagagaaaaagaagttacaacattagaccagagatagagggactgatctgaggccaggaaaacaaacaaacaaaaaaacaaaaaaaccaattaaaatgaggcaccaaaatagaagttgggctgcaagcagatgagggctgacatgggggttgaatgggcacagggtagactgagtcaaaggaaagctttcaggtatggttgtcctgggaacaatcctgaaaactttagatgctcattgcaagatctcacacccatttctgctgggtgtgggaaagagaaagggctgaaaatgacatgtagattcccctaggcacctactaacttgatagatactcctgctattgagcaagttaggacacccaggattggtatggaaatggaatgtaggtttaaggattcttctggaagctggttagctttaaggcatgggtcttcagcatttagcccatgtgacattctcattgtatgtgtcatagactgttggaattagggcactatgggaataagataagtgatttccaaaaggaggtagaaaatcctgttctaggaaatgctgttgcatgttctcattacctatccattgcagttgggtttagaaagtcacggggcatgggaggaagggagaaaggactggagacagaggagggactcttgacattctcccagtcctccttctacaggccacttgatttcataataacactgggtggaggatgagttgcctgagagaggaggcaagtcggaggcaggggaaggcacccctcaagcccagcgtcagtggcttcagcccgggcacagctgtaggcagggagaaaatgagctattcctgggccagggctcacctgctggatttcatctatgagagataattacagctagttttgaagctgcccactattgcacagatttatttttattaccatgaattgagtcctggactctctacctttaatgacactgtaacacataaagcttacaatgcagtgaaaaagtaggccaatcaggccctagtttgtcccctgctcctgcttaggacctggtgaactttctagacttggttctctcaatggcttcattaaatggagacctcacttctttaatcttttctccaaacattccgcaacacctaagggaatggggtttgagaggatacacctcatcagggaagctcaaagaatacaggcatcttctttagtgtttctgcctttttctgttcctgttggtacctcactacttactacatcagaagtttcagggtgggctcagcattctgtgttttcccaagccttcctggtgactggggtgtgtcctgaggcttgagaaaacactggtgcagagtttatgctagtgagcactaggcctggggggcagcagccagccaagccctggaagaggggttgagtctatgggttgtgtccttcctgatccaccagaaatctgtgcagcagacaagcatcctggtaggcacaggacacacgatttacatgccactccccttgtcttcttcccaatcccacagacccgattcagtgtgttgagaggtaaatgttcttgtggaatatgcacaatgcctggcatataggaggcaggccctcagtaaatgtggtgtgagggaattaattaataaatgacttgccctctgaatgcatggaggctatggatggcaagctagagtgaatgaggggaaagcactcttgccacctgaaggtgggcttagttctcagctcatctgcagtgcccaggatggggggtgggagtgggtgaagggaaagatctttgcatagaaattggcttatgtgaaaaatatctattaagtatccatcgtatacaacagcacttctcagactttaatgtactgtgaataacctgggttggtaatggattaaaatgcagattctgggctgggcgcggtggctcatgcctataatcccagcactttgggagtccgaggcgggtggatcacgaggtcaggagatcgataccatcctggctaacgcagtgaaaccccatctctactaaaaatacaaaaacaaaattagccgggcgtggtggcaggcgcctgtagtcccagctactcgggaggctgaggcaggagaatggcgtgaacccagggggcggagcttgcagtgagccgagatggcgccactgcactccagcctgggcgacagagcgagactccgtctcaaaaaaaaaaaaaaaaaaaaaaaaaagcagattctgattaagtaggactggggtggggtgggagactccatttctaatgatctcccaaatgatgcgcatactgcgagcctgtgagccacacttagagtaataatggcatataagaaatcacaacaacgccgtgtttaaggcatgctgaatgccgtcctcaagatctgcatctcaaggagtatgcagtccaggaggggaaactggataatacacagtaagaataataaagctatacataatatgtcccttaaaatacagacagaccaaggcgggtggatcatgaggtcaggagtttgagaccagcctggccaacatagtgaaaccccgtctctactaaaaatacaaaaaattagccgggcatggtaacaggcacctgtaatcccagctactcgggaggctgaggcaggagaatcgcttgaacccgggaggcggaggttgcagtgagcagagattgcaccattgcactccagcccgggcaacagtgggagcgagactccatctcaaaaaaaaaaaaaaaaaaaaaaaaatcattaaaaaaaaaaaaataaaggcagacaaagacagtcccaaaaagggacaaatgacttctgccagagatcttggggtgggtgaagaatcaaagtagtggaggaggaggcagtttagatgggtcctgaaggatgggtttgatgcaacagacgggggattccggcaaagagaagagggagaaagggcactgttaccatgagccaccatcccaaagttaggcttgaaaggagacttgcggctgactatggtttgaaatggatcacaaaagggctcagtacttggacttgtcagtgattggtaaattattttaaattgatcactaagtcattaggaaagtttggaagacataaaggtagtgaatttgttatgagatttgttcaaataagatttgaatacaatttcttctctcatatagtttattgagggtaactattaaacattttaagaattgttgagttttttttcatagtttttacttgaatttgctcctttttctctgttaggagcagctgtgcagccctgttctgtctcaggggaaggggtctgccggaatctgagaggtttgccagaagaaatgagagggtgaccttatctcccttggtttttgctgcttttttcttttgctctttctttctttctagtttcactcataaaaatgactttgtgttccaaagaaagaagcagttggcacagagtagagagttccatgttttatctcatcaaagtgctggcaaatttccccactaatgccttgtgggaaaaccttctcaggctctaattacatctctccatcactagggaagtaaagttaatatttccttatattcttgcataaggtgggagggcttgggagaaaaagaataaggctttcattaatagcatttacatagcgtccttctccaagaggattcattagattcattgcattaatgcctatcccgtgcttatggtcaggtgaggggcaagtttgagacctcagagtcctgcagagagaggaactgtggtcagtactggagataaggattccagctctgacatgggtggggcagagaaaaggtgggcgtgggcaacaagtttctatgtggttactgttctagttgttcctgcacctgtttgtgctccataatatccccctggctgctcgtgtcccatgtccaccagtgaccatgctcacttccacttccgatgtgagcaaggagagattgtgaaaaggaaggaacacaattttgggaactcagcatttcagtgacttatatcaatgtgacatatagagcagctggcttcactctgcttgtttagaatttcctttttggagtaaaagtagccagcatcatattactttctctatcctttgtctcaactcatatccattatgacagaactctagtataataaacatttatatacaatgacagacattgaaagaaaaatgatggtggcagaggccaagcataaaaacactctagggtgagtcttttgtctaaattaccataatgtccctttgtctgaattatgtcttgagcaagatttctctatcctcagtttctcgtcactgatggtgtgcaaattacccaaccagatacccctttccttcacagggaacctgccttacacctcccatagggtttggtgtctcagtggcttccaggagcctggcagttagaaccagaatccctgccacataagcgttgatgtgactgaacacagcacaaccccagagatttccttttccctgcgtttcattccagtctagaaagaagaaaacaagattgaatagaatcggccattcttatatcctcaggactgccagaatcaatgggatgtggatgccatctgggggcccatggaacataaatgcttttcttggcagcctgtatcattttgctttctgacttaaaaagtggactgcaattgaaatctgctcagagagacaggtccagcaaaactgtcactttataatgtctgcacagaaaaaaagcaaacatgaccaccagtgcaatttccacctgcagctcccttgaacaaggcacttctctccctgcctgcacaccaggactttggagtgttcttgtctgtgctctatagagctttcccttcctttgctgtgagatctgcttgctatatcaccttgtcctggtatactaacaaaatctgctgattaaaacccaaatcaacagcacaaatctcaagtatgtgtcatgagactcactacatccttagcacctatgaaaaatgccaacacttagacctgcaaacacaaatgggaaatgctcaaagtcaccattggctatgatctctgcccttaatttacagaattgtaaattctcctgcaaacaagaaaagaagctaagatagtgcaaccaagtaaaagaaatgcattttatgtttcctctttttatgatatgtttgttttattagatagctgctgctctggtgccaatcataacatcaaaagacacaatcctgaatgccatcatcctgaatgttgaaatctcccaaaattaaatccctaaaaccccaaattcctaaagtctaaatccctaaagtctaaaatccctaacatctgcaatcctgaaaaatcacagtcctgaaagattaaaatcccacatgctggaattctgaaaaccaaatgtggggaaaggatttagtgagttttcagttgtgtcatgttagttgcatcatggtaggtggaactattacctttttattgtctttatttggaaattaggtatggtttaagaagatgcatataggtgcccagctgacaaggggtggacttgtggacttaattttaagtgtcaacttgattggattaaggaataccttgaaacctggtaaagcattattttgggtgtttctttgagggtatttccgcggagattagtatgagtctgcgtgtactaggtagggaagatctgtgtttaatgttggcaggcaccatccaattgtcaagggcccagagaaaacaaatgtagaaggcaaactggtctctctctgagaaatgagacagactttttcctgactccatggacatcagaaatttgactgcatgaaagtgcattataacaacgttgactttgtgtgtaagcactgtgcgtatacataacaatgttgggatttcctcaatagatgaagagatgtttggacatcggcatttgtgaaaaataaaatttcttgagatctctgctctctgggtggctgcatacgaccccctttgcaggtctgttccatggtgggcacattctcattcgttgcctgattacatcacgtgattactgtgggaagaattgtcactatcattggttttcaattgaggtcacggaatctgctgagagggaggaccagctgtgtgctctggccactctgtcaatttgtctcccatccctactgggtctagagcattttgtgtcccactgtggaagactgagctttgtagacagttgaggacaaaacttagctaggaagtttctgacttctggaagctcttatttacatgacagtgaggaaaggaacagatgagcgctctacacttggaggtagcaggaaaattttccacaattttatctaaaaaattagtctatttttatctaaaaaacaaatgctaattaggaaattagctcttgtgttaatcttcagcattgttctcagaagagcataagcttgtatatctgcttcctcttactttaagtaaaaacttaaaaattgggagatgggctatacattaagacaaaaataccataggaagagaatatgaacaaaatgtcatttatttagtttggttgcattgtcttagcttctcttcctgtttacaggagaatttacaattctgtaagttaaaggtagagatcatagccaatagtgactttgagcattgcccatttgtgtttgcaggtctaagtgttggcatttttcatgggttctaagggtgcatgcagtgagtcaagtgccacctacttgagattttagctttgtgcacagatgcgaaagcttattggcacctgatgtacttccctctcattcacagcataaaatgtgatttcacggtgatgccttttctccttggctttgcatctgggtacacgcttggctctttcttaggtcttggtaggatttcttggaacccctgcagctctggaggtagaagcacagtggcatgaacattccttcctaactgccatgtcgtggtgtgtttctctctgggaatgggaccatgctgctttgccttccctgcctatgaggacatcagtctgtcctataaggatcacgtggaatgttgtcatggtgcattattcatgataaactctgacagcttcaaggttaggtgtgatgctgaatacaaaacaccaagccaagccaaaagaattttttttctctcctctatgtcctctccctaaatggttcttagttgaaacttgtacatgatttcctactagctgagctgtagcaggaagttgtgccaacagtggacacatcttattcacgttttatgcatctgcctatgagaatctgtaagagacacaagctgttcatgttgtagagtccggttgatgaagcagaatgtggttcaggaagtctctcttgcgcttagaagactgattttgaagctgctctcataggttttctgcttcttctgccctcttagagtggctaggaggctgcctgggattccaggtaggtcttggccctaagacctcagctgctccatagaaggtggtcagacaggatgaggcagtgacttcgatcatctggagcctcacacctgtaatcctagcactttgaaaggctaaggcaggagaattgcttgagcccaggagtttgagaccagcctcggcaacactgtgaggtcccatctctacaaaaaaatgacaaaaacaattagccaagcacaatgtcatgcacttgtgttcccagctactcggaaggtggaggtgggaacactgttttagcttgggaggccgaggctgcagtgagctatgattgtgccactgcactgcactcctgcctgggtacagagcaagaccctgtctcaaaaacaaaaacaaacaaacaaacaaacaactcaatagaaatgaaaaggatgtgctaatgatgagatgcaaacccccaaattgacatgtaccttcccattacaacaattttaggtccaaactatgcatttggtgcaaatggttgatttatccttaacaggaaggatgtcttagtctgcttggactgccatggcaaagtactactgactgtgtggcttaaacaatagaaacttattgtctcactgctctggagattggaattctatgtcaagttgtcagtagggttggtctcttctgaggcctgtctctttggcttgtagacagctattttctccttgtgtcttcacacagtcttccctctgtatgcattggtgccttaatctctttttataaggacaccagtcatattggaataggatgcatccttgtgacctcattgaaactgaatggacctctttaaaggtccagtctccaaatacaattaaattctgaggtcctgggggttagaactccaacatatgaatattgcagggggatataatttagcccaaaacaggaagcctaaagggctcaggacagagctaaatactaaacacattcaggtatttccacaaaatttgaataatttagtttgactatctgtggtcattgtggtcatatgtagacatttgattgaaacttttttttttttaaagcagactttttgacacaagtaagttgattcttcccacaagtgaacttagctgtttttcacattttgttttattgcagagcctggctcttaggccagtatatcatggtatcccttcacacaaacaactatctactgaatatctgccagatttaccatgccatggtggacaaactatgcataaaaaaatagcccaccaccaaggagtatacagcctagttggaataaaacataaatagtacaaatatgtgaaacttcagctaccattagaattgattttttttttagaattgatgtttatttttgtatgaggacatatttctttttttttttttttttttttgagacagagtcttgctctgttgcccaggtggagtgcggtggcgtgatcttggctcactgcaagctccgcctcccgggttcatgccactctcctgcctcagcctcccaagtagctgggactacaggtgcatgctgccatgcctggctaattttttttttttttggtatttttaatagagacggggtttcaccgtgttagccaggacagtctcaatctcctgacctcgtgatccaccgaccttggcttcccaaagtgctgagattacaggcgtgagccaccacacccggccatgaggacatatttcaataggcagagacacaaattaacctagtaccagctgaaaagaggacttatgatctggtgtgaccagaggtggcaagagtgatcagaactaacatgttcttcacttttttctctgtattgtggcttattctttcaaacctcttgttttagttatttattgctgcatgtggtaggctgaatgatacccatccctccccaaagatacccacatcctactccttggaacctgtaaatgttaccatatttggaaaaggggccctgcagatgtgattgaattagagaccttgatgagggcatcatcccagattatctgaggtgggtcctatatgacatcagatcatgtctgagagacgcagtgggagattggaccaattgaagaggaggtggtgatgtgaccacagaggcagggattggagtggtagctccaagctaaggaattccagcagccactggaagctggaagagacaaggacaggattttccccaagaatgttgggagggaatacagtctgtcaataccttgattttagctcagtaaaactgatttcagacttctggcttctaaaactatgagagaataaatttatgttgttttaagcctgtaagtttgtggtaattagttatagcagccacatccaatttatatacggcataaccaccaaaaaacttaaagcagtgtcaaagagttacgttagcaaaatggtagagtttgcagctccaactttgtttccccacagaaacatcaaaaaacaaacagaaaccattagaacaaacatgatcagaactctggaaaataggcaaaagtttaagcaaccaagcaaacactgaataaagaaaaaggccacttgaaaatggtgggaaactttgtagcatttttatttgctcttgtcccagccttctctctagcaagacagttctcttgatgatgacagccttcattcccagtgtaggaccctggtccctgattacagagggactagagaagaccttacttattgtggatgtctgttctaacctgtctgggggctacgttaagtactgacataggcatgtatctctgcttagcctaacttagaacataggctggaaaaatggcaggcattgcttgcaaatgctcaaagtgagctaacaaactgcaaaaacctggggcaaaagattactggttgaggtgtacaatagaccatctaaagtccaggtgcaaaagctggaagagattctgtgggaaattaggacattcaaaagcaccatgtatacaggaaaatgtagaaatccatgcatatacttggggcaagatgcatgctcagaaaagaggagagaagaccctaagctttcatttcaggctgatccttgagttaagtgtaaggttgggtaagtattgtaggagttccccagcacagagccaatctgcaaagactgggaaaggaagtttggaaaagtatctacaaatggactattatagccatcaaaaataaaaaacagcaaaccctggggaagggtgagagtccgatagccagagtttacattataatatttaagtgcccaatgttcaacaaaatatcacaaggcatacaaaggaaacgagaacacatggcccattcaaagaggcaaaataagtggacagaaactatccctgagaaagcccagccatcaaatttattagacaaatactttaaaatgattgtcttaatgatgtccgaagaactaaaagaaaacatggacaaagaactaatggaaaccagaaaaacagtgtatgaacaaaatgagaaataaagtgatagaaattataaaaattgatcaaacagaaattctgaagctggaaactgaaagctgaaatgaagaatttactagagggttagacagaagatttgagcaggcagaagaaagaatcagtggacttgaagatactacaatggaaattattgagtttaaagagcagaacgcaaaagtaacgaagagaagtaaagagaactgaagggacctctaggacatcatgaagcagatatatatatatatatataggagatatatatatatatatatataggagatatatacatatatataggagatatatatataggagatatatatataggagatatatatataggagatatatatatataggagatatatatataggagagatatatataggagatatatatatatataggagatatatatatatctgctttcactgttgttattcaacattgcactgcaagttatagtcagagcaaaatagataaaaggcatcataatggaagggaacaagtaaaattatctctatttgcgattgacattatcctatatgtagaaaatcttaaagaatccacaagaaagctgctagagctaatgaacaaattctataaagttttaggtgtgaaagtcagtcatgtttttatctacctggaatgagcaatcccaaatggaaaataagaaataattctatttataatagcatttaaaataataaaatacttggaaataaatataaccaaagaagtgaaagacttttacattaaaacatgtaaaatagattttaccttgaaacatgtaaatagagtttacactgaaaaatggaaaatagcccagaaatacacccatatatctgtgtccagttgatttttgacaaggggtgccatgtccattcaatgggagaaaatagttctttcaactgatggtgctggggcaactggattttcacatccaaagaataaagttggactcttgtctcacaccttaaacaaagtttaactccaaactgtgcaatgattatggataaaagtttggtggttcttcaaaaagagaaacatagaatcaccatatgattcagcaattctactcacagatatgtatgaaacagagacagagagaaagagacagagagatggagatgggggagagagacagaaagagagaagagagagaaacagagagagaggagagagagagaaagagatagagaaagagacaaggagagacaggcagagaagagagacagaaagagagagatagggattgagagagagagaaagatatagggagagagagagagagagagacagaaggagatggaggagtctctttcacacatatgcacatacacagtatgctggaggaagctctatcatcttttatgaatctatcttaagaaattatgttgttacttccaccacatggattcatttgaaacaagtcatcaaagttgtcccatcttcaaggggagaagaattagaccatttttttgatggaagaatgtcaaagaacttgtgggcatattttaaaatgatcacaccactttattccatgtggcaattgaagacttttgaattaacaacacacgactagagaagaaaaagagacttcccctcttggatccagtatgaaaaccttcaggaaaggattgggttaggtgctgactccttggaccaatgaccataaccaaagggatgaggtactgtaattagccaagcctggctacctgtctgtctctgtgatgaggtgggtacatctgttaggagaagatgggggaactggtgcagtgcagataaaaatagtagctagtatgcttattgcctagtgaaacatgcacacacgaagcaattaggaatgattgagagcagcatatgaatttaaaaatgagggatgttaaaaatgcataaagaagattaaaatgaaaacactccttacagagttcattcatttggtcaatacagtcatttccatcccaaaacctggtcttacatgttagcttgaaggtgcctcttgcaacagattttccagagacttttgtctgatctttactgggaccaaagtaacctttgattgtctctgactgtggctgtttttccgggagctttatgtgctgggctcaggaaaagttcaacccatcaataggttatcacatatatatactctgggactgattggaccacattttctcactgaattgactgattgatgaattcagttggcagaattaactcttctatgtctacatgaagtgccatttagaaataatcaactcttaatcagcctgggatagtcagtactaaaagcaccttcatgagctgtgaaaaatttaatgcatttatttacatatttagttttaaattttagtatattgttagttgaggtatagtttccaaacaaagagccgtgaaatgtttagtaactgtctctgtacctctggatgaggacagctcagccgggaatggagggggactgggtgaggagaccagaatgtcagtgtggccacgcagcacacttttgttttgtcttctgtccttgagcactggcttgttcctggataaactaggcataataatacctatcctgctgtgtgggtggaaggttaaatgtgataatgatgtgtgtgagatgcctgcacagtgcctggaggtattgaagaattatttgctgccttttctttttctacctaccacttacccgctacccccgggtgctacatgttagaaaacactgtgtaaagtgtggatgcttctgaaaaatctccctgccagcagttagtgccaatagcgtgcagaaaataagatgcaatgatttggcttcttttctgtttggcaataagaagcttatttgcacatagcctgatttctttcaatctgcaaaaaaaaaaaaaaaaaaaaaaaattggaaatgaagtaaagcaatatatattaaaacatgcaaattataaagaagcatttaaagcttgactactcttcacattgtcgtatggcaaactattttttttatctgcagtctaaatttcatgacctagaatctctcgttttctgcctgatgctttgttgcatgacattggatgacattgagaaaaatgaaattgaaaccctgcttgggctttgaaagaactggcaatcctgcttttaagagtggaaggaaaaaaaatggaaagggaaggaggaaaatgggacatacatggaatactaaagacaagactgaagaaagagaggttgaaagctctctctcttctgattatgtttctgtgggtctctactgttttgtggccttcaccctcatgggcagagaaggctaaggtgtaattctcaggtaaccatttaatctttccatttaaaatggtcatttacaaacatggagtccatttcctttgcataatggcaacgagatggcgcctgtgctccttcgtggaattccttgctctgggtgatggactggacagctaatttgtttttataaagtgtctgggcacttaattaaatcttgcatcctgtctaataaaaaatcaatatcaaatccactaccaacacgttctggatggcagagaggcatgccagaagaaaatcttgagtggcggttccttccagatttagcaagctctgcagtttgtgtttggctgttctctcatcctgttgcttggcccagctcctattcctaagtcaatgagggcttcaaagcatggtgtgaatgcatcagctgctctagaggtcctgtctttgggagatgaattgtggcccattaaaaaaaagttctctagggaaatgtgaataagtttcctgcaagtctcggaaataaaaacctttatggtatataaatatttgaaggttaacaaggtcttcagttggaggaaggcaggcccttggcagaaccaaagggcatctcacgagtgggtagaaagttataggagggattggtcttttctgctttggtgttggtagtggtagctgggggtctctaggctgattgtgtatgatctggagtctggagccttgctacagtttgaactggtcagaaaagccaaggcccgcctccctctgctgactctgtctcactgagccataggcgtggggtcctgcattggccatttcagttttgcttgttgatgaggaaaggtagatcaagtgggtcaaggtggcaagggtcatgtattcagagtagggactgagtggagttggaaaataagcagcagtgaagaagagagatcactccagcaatcttctcactgccaaaagtctccaggtcccatagactgagcaccattcaataattctatgtgttgtatgaacgcatcagacaattccacaacctccttacttcatttgcctgcttgtcatagtgcgagaattgctttcattgtccatttgtttcttgacagtcaaatctcttcattaataaaaaaaagacttgaattcatggcaccattttattttccaatactattgtatagaatgtccaaactaagatctaaagactatctttttcccaccatccctctagaagttcctgatctttgttatatctcagcccagctcctcttgccatatcccctattacaatgaatggcaagtcaagcagaaaaaagcctgtgggtcattgtggactttcagctctcccgggacatgagccactacaccttttcgattttatctcttaagtatctcttccttctgtcctttgatctcgtaagtgttgtctggacacacgcactcgcctcttaatgggtccttggtttctattttcatccccctccaaagcatccttcgatcatccttcaatccctttccaatcatccttcatgttgtaaccagtcttctttctaaaactcatttacaattgcttttctacttcatctctctgcgtgactaatgtcactatcaggacaaatgttaaatatggcctgccataaccagcttcttgccctggcccttgcttagctttctaacttcatttcttgccattccttccccacttcaagcaactttctctctcttttttttttttttttgagttgcagttttgctcttgttgcccaggctggagtgcaatggtgcaatcttggctcaccacaaactccgtctcccgggttcaagcgattatcctgcctcagcctcccgagtagctgggattacaggcatgtgccaccacacctggcaaattttctatttttagtagagacggggtttctccatgttggccaggctggtctcgaactcctgacctcaggtcatctgcccgcctcggcctcccaaagggctgagattacaggcatgagccaccgcacctggctgcaactttctctttagtcccttggtagttcccgaaggcatactgccttgtccactgtttagtacctctgcctgcacttaccacctccttctcctactaggtcatccagacttggtttctggttggtcatggtgtggctcatgccacaatcctagctttttagaaggctgaggtggaaggacttgaggccaggagttgtagaccagcctgggcaaatagcaggaccccatgtctataaaatttagccagacatggttctgtgcatcaatagactcagctacatgggaggctgaggctggaggattgtttaagcccaggaggtcgaggctgcagtgagctatgatcacaccactgcactccagcctgggtgacagagcaagaccctgtctccaaaaaaacaaaaaagacttggtttcagtgccccttcttttgagtgcttggtatattctctatcctcatacatattgtgttttagcatagctattggctgtcctcttggctaaactgttagcctcctagggaaagaaagagaccctattcatttttactctttatccccagaacttagcatagtgcttggtcaaagtagcctctcaagaagtggttgttggatgaacaagtgaattcatcttattatcacttatcatcttattatcattgttacattattaatagctgataattctactaacaatagaattataaagcattagcgcttttcaggtcaaccttgttaaaaacctgactgcaaagttcaattctgccatttgctagctgtataagcttggacaaattattctttctaagctttattttttctatctataaaatgggataatagggttgtttggagaattaaatgagatggtgcatgctaaatatttgggttatgtatcattcagaatgaatgtttgttaaattatactcactggtaaaatatttaggtattttagatctgctagagataggctttttaatctctttgtgtttttttgttcaaatgtatttgcgaactgattattttcttagataatcattttcttagataaccttagcgcacctaatttgatgcctgttgagagtagagagaaaccaaaaagctcacagcagaaggactttttcatatgtcacagtagacaaacaaagttattttccgtcacagccatgtattgggtggaatgacctttagtagctgatgacagcgatgtagcagaagggacagttttccacttgacctttatacaatgtgccagcttgtctcataacacaaaataagttgcaattgacaggcttgatagaacactaacccgacaggagacagacactgaagcagcccctgtttgctaccgagcgtggcaacttccatatacccaagggtgccttagggatgactactccctaagtcatggccagaacatttagtgtaattagttcctctaggagtttattgtgaggtgagatttgctcataatgaattttcattgccaaggacttggttactcgcaggtaccccactatagtcttttgacttttctgtctttgtaagctgtcttcctctcctctttgctctttgcttttaccataggatgttttcttctttactctttttaattttttttctttaagacagggtctcgctttgttgtccagctggggtgcagtggcatgatcatagctcactgctgcctcaaattcctgggcttaggcgatcctcctgcctcagcctctcaagaagctgggattacaggtgcatgccaccacacttggctaattttaaaaattttttataaagacggggtctcactatgttgcacaggctggtcttgaatgcctggcctcaagcgatcctcccacttcggcctctcaaagtgctgggattacaggtgtgagctgctgcactcggcctcttctcagcttttctaatgcttcatttttgccgttccctaacttgactacttttagttttctaccactgggtgatttttttcccttggggctttctgcatgagggctaaaatgtgaagttcttaagtttgttccttctcccagatagtcacagggcagaagtggttctgagcagcaggtaggaaacgtgttgtcgtttcgtttacaggtttgttggaggaagttgctaccagtcatctcactttgcatacctagttctgacattgactgcattaataaccacaggtaatttactttacctctgcaggaagtcactggaagggttacattttcatttggggtgaacagcaactgtggatacggatcatgaaaattgacaatggaaaatgggcatgccattctggaacttttcccagcttttttccagagccaggtctgtcctgatgtgagaaatgatgtcctcatctgccaaatgagtacaataacattagctctacctaccttgctgggctgatgaaagaaacagaggaaataatacatataaaaactgtgctgattgaaaggagctatgtcaacatattaattcaggctgtccctggttggagtattgtggataatgttatctgctttttattcttttccacactacagatgagaaaaaaaaagaaaaaaagtttttaggagagaaaaaattagaagaaaatgtttaaaaatactctctggaaagttagaattctaataaaatccttagtaccacagttgaggatttggcttcatgctccaagtaagtaaatctggctgagattaatatttgatgcatatttatgaaatcagatatatcaaaactgtatcaaaagatataaatcttttatttttcttaaagaccttatacaatgaaatgttcatttatatcatatggacttggggcagcaacaaaaacttggcaacctggggttgctgatatttacagctgttcaacattttttggatccatgtattctcttcagaacaccagaaggctgtgcttttcaaattgtgttctgaggagcctcagagatgccttagggaaggctgaaagggaagcttcatccagagtactttggtttccatctgttattagtccagtaagatttcatctcaaaaagggctctgttgctaaaaaaaagaaaaagaaaaacaaacaatgaaaaaaaatcaagaagtaaacaaaaattcttgaaaagcactgccttggctgggcacggtggctcacgcctggaatcccagcactttgggaggtcgaggcgggcagatcatgaggtcaggagattgagaccatcctggctaacatggtgaaactccatctctactaaaaatacaaaaaattagccgggtgtggtggcgggcacctgtaatcccggctactcgggaggctgaggcaggagaatggcatgaacctgggaggcggagcttgcagtgagccaagatcgcgccactgcactccagcctggcgacatagcaagactccatctcaaaaaaaaaaaaaaaaaaagcactgccttaaggactttcaaaaatggtatctcagatatttggaaactattgttgagagaaaggaagagattcctcccaaatctgggcttctttttcatgtttgatagaagcttgaattttgagtaaaaaacacagtatgctagagatgcttaacctggaatgaccatggtatttgatacaaatgaggttctgtagaatgcggacagctctgcctggactgctctatgaaatagatctttctacttatccacactcgaacaagtgtgtccagcataaacatcacagtgcttcaaatactgttagtcccagtcaaggatgttattctgtgtccattccactcagaggtattcattttcttcttggcagctggaaccaattgctttggatccaccatggaagcctcgacatcctgaaccaaactcctattaatgaaacttcccaaatttaaacaaagcaagacaaatagatatccacacagcgtagatcatgacttctttagacatcatgaaaagaaaaagaggacccacgtggaagaatacgctcatttatgatcagggtagcatcatattcctctcccttttaacattatttcaggatagcagctgtctggatgctggccatgggcttgaaaaaaaccaggtgggcatttctgcccactgtaccgtttctcccatgcgtttcccagtcccctgtcatggcatgaaaaaaccgctattgttctgtgttgggacaattagatttttgtaggggggagaaaccacccaaaagcaaatggaaaaatatgctatgattaatgtcagttacgggaattaaacttcggaggcctttaggacaattatgaaggaatcattttccccttggtggcaatatgtactacagttgtcccttgatatccatgggggattaattccaggacgcctgtggatacagaaatccacgtgtactcaagtcttgttttcagtggatatgaaaagtcggccctccatatctgcaggttttacacttggcgaatgctgtatttttgattcatgttggattaaggatctggaacccctgatacagactgtatttattgaaaaaaaagtctgcctatgagtagactcacatgttaaaacccgtgttgttcaagggtcaaccataactgcaggcagaacatctgggcaggaagctcctgcaggaagacctgtaaactcaggtctgtggaacggcgatgatcttcttcccttgcttccagaattattgctgtgagatcaggtgcactggctacgaccttactctttgtgcagaacttatttctggtctggtttaagtgaacgttattctttctgtgcagtcctgtggttacatcaaaggttaaatttcatatagcatgtctgttatatcagacttctctgatggcctgtccagagcaaacattttaaaatattggtcctattctgtcttataacagtctgctctggtgatttttgtctcatcaattggattatgacactgtcagccactgttagtgttattctcaaattcagtcttccattcatctctccttcccttccctggcagacagacttctgcagccactgggactgttggggtgaggaaaggcaagaaccgatgtttcattctctccctcccttcttcctccctcttttttgttggttgtggggtgggctacatcttcttacccaaacaaccaggagcatttgttggcaagtttattgtgcccagtgccgatgtctggacaattaattccctaggtcagtggctttcacagtttgtgatggtgactccaggaaggaaactcaccatgaccctgtatatacatagaacaaaaatgcagcccactctgatattgtatttgttctattctagttcattaaaagtgaatgttggtcttcatcctttaaatggatattgtcacctgctaatagattggaccagtattttgaacaatggccttggtacttcatttggctttgcatgctcaattgtcatatcctctgtgtggggaagggggcagggctgcttccctgggctgtctcctgggatgcccaggggccctgcctgcctgcgtgggtccttggggacctagaagttccggtttttcatgaaacagcggggctctagaagagccttttcccttatcctgactcttccaccctgatttcttcccgaggacttcttactatgtttaaagatggcagtgaagtggcctgtgggttctagaaccctgcaaacaccgccccaagtgtgataccagtttacccttcttgtagacatccccaaacttcaaggtgattgtcttgaagcccttcacccaggagagggaaccagcgtacaataaccgctgtgctgcaggagaggggaggtaaagagttgtcacagccttgagcctagctcttcccccaaaggcagtctctcttttcttcttccttcctttagtcatctgtgtatagacacagatgcaaacttttcctggaattcctaatcttaagcagtcttcaataggagacctggcttcagagtctgtccttaaacagtgaggtgccctgtgtcttttattcttaactgtggcctatctccactcaaattttggcatttggcgtttggttgtcagtggttattttacattctcaagtgtcactgtcatttggttagggtagttgtcagggtggttctgagagccaagtgtgtagcatagctttgttgttacaaatgaaaaggccagttcccatttaaccaggtactgctggctttctctacaggatttggtctacatccattagtgctctttgttgtccatgtcactataggagagattccccgggacctacagggtcactgtctgtttccaggatcagtgagtcactccctcgtggcctgttatggctttgtgtgaccacagagagggtcacggtggtgtggaagcagggagggggagtcagccctcgctgtgcagcaaccacagtgacgtccccagtgatcaggcttcgtggggatgctcaagtccctcttgatgatcagctctagtgattctcatgttctgcacgcacagaatacatcctggaataatggtggtgaggtaggaaactggcaagacttattttgtgttcacaagcctcctgacccaaacaggatctggtccagacagggtcaagtgaagaaactgacgcaaaccagcagatggcgacaaaagccatccctaactgcccttattgctcattagcataagacatcccaccagccccatgacagcttacaaatgccatggcaactaccggaagttactgcccctttcctaggaagttctaaataacccacccctcaatttgcactagctcaccccttaatttgcctgtaattgaaagtgggaataaacacagttccgagagcccatatgttgctgactctgcattgctgcctatgagttagccctgctctgcgaggagcagtacgcttcattaagatgattgctgtctaacaccaccaggtcgcccttgaattatttcctggttgaagtcaagaaccttcctgggataagccccagtttgggggcttgcctgtcctgcattgttggtattttccgtttgctgagaaaagttcagttagtgctgcctgagctggctgaaggcccttctgggctgggtccatatgcccaagagggtgacactggctggtctcgggggtggtgtctttgagggaatgagattggtcctacgagtgctggagaaactgcacactgaaatggtgtagcctagcattgttagggagtggcagataggagcaagaagctgaaagcagggagcagacaggaaggagcacatcccctttcctcctccagccttgcagtctctttggagctggcagcaaagtcagaaacatggttggtctacagaggtccagcctcagcatcacaaaacagaagataaaaagatatgtttagaggggagagacaatagcttaataacaggcacagccccaaaataacattttgcttttccatgttatgaaccaagtgagagataacatgaaggcatgaagaagatggaaatctaaatatcagcatcgttcctgataacataacattatggaatgtggcttgggtatatggcaacagtgggcttcctaataccaaaccccagaacaagaattgcccatgcagctgtgggcagtgatgagctgcaggcaccttttttttgaggcctggccttgtaaacctgagtttctggaggagcagagcaaatgagtgctgcccaaggtcacctggcctccaccaaggagggagagaggaagcactgagttacacatgctcagtcttaggtcccagtttaccagtggggaaattcagtctatctccctggacaggtgaaagcagcggggcaacagggaaagcccctcctcatggatacctaagggcagggaagacgggctgtattccctccctacataatgtaaaagacaatattctcaaaagcagttgacacaacaggggccagttcttataaattgatagtatcaccccagaatgtgtttgggcaaaggcagttttataagtggccacatgatctggttccatgacatgctgcttaactgctctgtcttaattcaggaagtggttttagaatatcaggaaaagagagacggatggactgcatcatctttctagaaatatcatatccataatcacatccatgatctctctcttagcctatgatggacaaataagggtctgcagtgagattttacccttccctgcaagaatctggggtgtaactattcaggattattcattaagagagggctctcaagctaatagaatcaaccttggattaaggctggcatagtaatgcagtcagtacttggtaattagcaatattctgattcttttcttaaaacaccagctcatccctgcctgctcctgcttgtcttcaggtgtctgcaagatgataaaatggatgaacatagcacatgattatccgtggaatactcagaaactatcatctctcgtgttatagcttgctttttctctatttttcatggacacctgtgcttctcactctaattttacattgcacacctataatggattcttattttctgctactgatatttttgctagtgtataagatagaatttcatatatcaacatgtcccagtattcctcagagggcttaatgacttccaggtggttcagaaccactgatgcctggggccctaaagggagactgctgcatgtcctacatgtgtgaatggaggacagagagcgagtttaggacagggggcagggacggacattttacattttgaagaagtaaacactgggcaagactggccattaattcctcctctatttgaccatcctctgggtgttgggactcactgaatataggctgagtttcagagagacgccccttgagtagaattaaatctgaatcaagaagcaattaaacccatgacagcaatctcttggaatcatttttacttttgtaacaactcttctacttgtgtttttcaaaactcttcacaggcattcttttctcaccattttacaataatctggtggcatgagttggcctagtgttatttttcatatgtgagatgagtaaagtggctcttagaggggttaaatagggcctggtgtggtggtgggtcatgccttgcaatctcagtgctttgggaggctgaggtcggaggatcgcttgagcccaggagttcggggctgcagtgagctatgattgtaccaccgcactccagcctggtgacagagtgagactctgtctaaaaaaaaaaggaggggtaggggggtggtaagaaaaaaccctaaaattatattataagattgtttaggatgaatccaggactaaaatctgggtctcctgactcttaagcagataaatcagttttaaaacttgatttttttttcgtatgctagaggatttcatacaaagatggaggaatcacgctgcatccctttggtgtttacttgatcattttattcctctttagaggtttatctttaggatcacatgttgtgccatctatgatgttaatctttaagatgctagcttaaagcattataaagccaagatttgttttttaaagtgtctaaagagaatgtctcttgttaaagtgagactgtcttctcattttacaaatcctaactgccttttacagcacacagtgcggtagatgttcgggaggcagccgccaacaaggcacaatcgcccactgtcttcaggggcctctggcttagtcctcatgctcctggatagcacctaccaggagttcccatctgggtccaggagttaggctttaatacctagtaagagtcattgagctgccaactattattttgtagctcagaggtcttggagctctatccttggagttatacacttaaccagtgaagagcctaacggccaaagatgtaactgcttgacatatgaaaccacatggtgaacttagtttgttctaccaaggacctgaggtctttcttccatctgcattctgttactattgcatttttgctctggaaaatgttcccatttaacgaaattttatttctaaaatctgcatggcatctgaggagtttgagaaagtacttctaaaatgtgtcctgcagagccttctacagtgtatctttcggcttctccttagttatttatagaggcatatatatatatttttattatgctttaagttttagggtacatgtgcacaacgtgcaggtttgttacatatgtatacgtgtgccatgttggtgtgctgcacccattaactcgtcatttaacattaggtatatctcctcatgctatccctccccctcccccaaccccaaaacaggcctggtgtgtgatgttccccttcctgtgtctatgagttctcattgttcaattcccacctacgagtgagaacatgtggtgtttggttttttgtccttgagatagtttgctgagaatgatggtttctagcttcatccatgtccctacaaaggacacaaactcaaccttttttatggctgcgtagtattccatggtgtatatgtgcctcattttcttaatccagtctatcattgttggacatttgggttggttccaagtctttgctattgtgaatagtgccgcaataaacatacgtgtgcatatgtctttatagcagcatgttttataatcctttgggtatatacccagtaatgggatggctgggtcaaatggtatttctacttctagatccctgaggaatcgtatagaggcatattggagtccagtacatacacaggttcacagtgtgctagaagcattgctctttattagttattcttatcactggctgcagttttgtgatttctctctattaacattgcctttgaattgaaggtcactgttttatttgtattgctgctcttcagccaaaagaaaatagcttcattctgctttgttccaagaaactaatattctagcacgctttatgccttctgattggatttcatccaaattggaatagctcaggctagtggaaatattttatttaatcctctagggtttttttttttttttgactagctgttgtatcttgatacctttacatcactcaaagaatttaagctgttcctgctgccatgtcattagccagagaccaattttgtacaacccccttggctttgggcctaacactggtatgttccatttgtccattccagaaagggatgtacacatcactgtggtttgaattatattttaaaaaataatgatgatggtggttgctcagtggtgctcctctgatactctgaattctattatagatgaatgagctgcaaaatattctataaaaaaacaattatgtcttaaaagattataggctgcagcaattaccactaaaagggtgagagagcctgtagtttttgagcactgacaagcagatacatccagctaattttttgtgaaaacaccagcagagcaaattactcatgaaaaatctgttcacaggaatgaattaaatgccatgtccagtttaacagtgaacactgactgcaaccaaaaaccaatagagataaataatgaatggcatttgaattcattcatttgtatgattccaaaaatagcctcagtgccaatagtgtttctaatgtccaaaacccactgtagacatggagaaggataaagaagccaatgaaaaagaaactaaaaaagtgaccatttggattttattttttctccacattcctgcagccagtcacattgaccttttatttttattttttatttttaaactttagattcaggggatacatgttgtgcaggtttgtgacaaggatgtgttgtgtgatgctgaggtttgggcttctattgatcctgtcaccccaaatgtagttagtgaacatagcacccaataaaatgtttttcaatagtgcagtttctacagttactgttaatatggaattggcccaataacaactggctgaatgtataagttggatgatagcttgccagaaatttcccatggccttgttggtaggctggggtaagatatgataatatgctataaagaattattcttttaatttctctcctagttagactatacctaataaacttcagttttcagtgcacagaattggtcatttatcagctgtgcacctagattgctaagtgagttagtcctagcctaagtaattaacccattttggtgatgactgaatatatgtctaaattcaattaaaatgaagaatatggtgtaaaattatttttatgcaggagagcctgccattacattttaaataagagtttctctttcagagtttacatatttttaaatggctaaaaaaaaaaaatcacagttttttgtgtaggcatgatctatcacatttccctgtataaccccaaatgggaaaatggaagttctaggttccaagcttgggttcctgaatttcactttaatattttaaggattaagaaagaaccttgaaaggatattctgttgtagcccagtttttaggcagtattgattcaggaaaggcaagccccaaactggggcttagcccaggagggttcttggctttgcccaggaaagaattcaagggaaagatggtggtagaagaaaacagctttattgaagtggcagtgttatagttctgtgattgctcctgcagcttaaaggcagttctgcagtaatatttatacctacttttaattacatgcaaattaagaggtagttcatgcaaaaatttctaggaagagggtggtaacttctgcattgttggatcattgccatggaaaggggcagaaactctcaggtgttgccatggcaatggtaaacatggcatgctgggcctgtctttgaaaaggtgcttccattgcctccctgttttaaccagtcctcaattaggcctggtgtctgagccccacctcctacctctgtatcactcttaatactttgttatatttttattaatatatcaaggttatgttaattttgtgcactgaaagagctgtgaattttgcaaaagtttccaaattaactgagaagtgccaccaagagatatagtctattcagtttttccaaaagctgctttcttagcacatattccatttgggcataattttagcaagttgacttataaagcgtctttaagtggaatatttcttcccctgcctcacagccaaggcaatggctctccctggcactgtgcaaaccctgagccagacgctctgctctcaacagttacaacaaagtcaccaggtagatctagtttcactgtctctttcactgtcaaggagactgagtcttagagaggttctgacttgttcaacatcttgcaactagtaaagagtaaaattaaggtttgacttgagacagcttcttcagaactcatgctcttaaatcctgaccctatagtgtgaataccttggacccctgctcagccataaagtcctctcttgccctccactgtcatgaggactctccaaggttgtattgacttgaaggctacatgagaaaggtgggtgggtgcatactttacagttgagtttgatagcatagcaaggcttgacagataatgataactagctatctatgtgcctagggtttctcatacatcgcatcatgaatttttttacaaccttgtgtccagtgtattgatcagaaaggtcacagagacaagaagtgccccagcaggaattcagacccatctctgtttggcttcataatttatgcaaatcgatcccagacagaattctacttagaaatgcctcaagataccagttggaaattatctttcatttctgaaactggaaattaaaaaattatttaaacaatgcataatcattgtaaaaatatgtaggcattgggatatacagtataaataaaagaaaaatatcctttgtagagatcctttgtagacatagccaccattcatatttcgatgtgtgtcctttttgacctttttcattgtgtggctgagtggcattttgtcttttgctatttccgttgggttctctgtattatggctacttggatatgatctaaggaatgttcctctttctccagtaagtgctttcaatgcatatatcttaataaacaggtagaaagttggatagtttgctctttctactaataagtaggagccacgatagtagtattgtgacagtggtgatagtggttggagtgctagcggaggtgatagtagcagtggtcgtggtgctgatgatagtacgtgtgagagatgagttggtggtgtaggtagtgggaacagtggcggtggtagtggtgatggtagaagcagtggtagtggtgataggagtggtggtggtgatgataggagtggtggtggttgtagcagtgttgttggtaatggtggtagtgttaggagtggtggtagttgttgtggtaggagtggtagtggtggtaatggtagaagcagtgggtagtggttataggagtggtggtggttatggtaggagtggtggtggttgtagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcacttaaaaagagtggacaaactcatttctcttgcctggacagttgtgagtgaagatgcctccatccctgagtctgaaccataagcttggaccacatatataagtgattcacttttccatagcatctgtgaagacatacttatagaaacaatgtatagttctgaaaatctgagggtttaatgaaaagtagcaaaaattcagttggtcatttacttccctggcacatttgatgattgacatttggtgaaagaacactttattgtgaatctgtttgaagtggtggggcaatgagtattttggaggtgcccataatcaagctctttcttcagaagcttgtgatcctgagaaattttgtgttttctgtgttgtctataaactgcaacttaaggatgtttgcaaggcctattggcatcacgtgctctctctctctctctctcacgcacacacacacacgcatgcgcacacacacacaagcttgctagagcttgccagtcatatgacacactcaagacctggtgtaagtactttttctattttagtcattcacaacttaactggtttacttggcagattcttgctggggaagaacacttgcttcagaaccacatatcccactgaaatgtgtcagcaaagcaacaaatatgtatcaagaacaaggcaataggctaagtgctgagtgggcagatatcacagttaaattattgcttgtcttccaaaatttttgtatcatctccaaaggtttgtttttcctttcatatcacaacaaaatgatttcccagtcttctttccacacattgggcaagcttaaaatacaacatttctaaaaatcctctttggtgttccctgaaaagatctatgagctatggaaaccaagcttaccctaagctgtttagcattaagaatttgaggaaaccaaatctccacttttatgcagaaatcaaagagtagcataagtaacttgtaggttattttaataatacaataattttgtaaacaataaacagctcaaattttgtagctggctttgtaagtagagaaattgaaataaagtcactcaaaatcacactgactgattgattgtcaaaactcttagttcttcccaggactttttaaaaaacatacttttaataaaaagtacagataatatttacatattttgtatcctgatttatcttgtaatattaaaatatttcctgttttcctaattgttcattgacttactgcataccattctatgagtggatataccataatttacttaaccattcccctagaattggatctgaggctgtttccattttggagagttttttttgtttgtttctgttggctactgaatacttcctatgggaaagaggtggacgtggtggaaaatgaattgatagaatagtttgcatttgtataaagcatgcaaatatgtatttccagatatgtcacagtgaaaggatagaatctttcctgtagaaagaacacagaggttaagaatataggttttggagtcagacagaccttggctttatttctgaatccacataactgtgtgactaattttgaaaattttctcgaactttctataagcttctttctttcatttccaaagtgggagtaaccactctctcgtgggatcattgtgaggataaaatgattgatatgtagcaatgtgcttggcacatagcagtgctcataaaattgttgctattttctatgtttatcttattcctcatccaaactgtaacactcattcatttattttagtttgatttttttgagtcggggtctggctctgttgcccaggctggagtgcagtgatgtgatatcggctcactgcaacctctgcctcctgggctcaagccatcctcctacctcagcctcctgagtagctgagactacaggcgtgtgtcactgcacttggctacttatttgtattttttgtagaaatggggttttgctatgttgcccagtctgatcttgtatttctgagctcaagtgatgctcctgccttggcctctcaaagtgctaggattatagacatgagcctctgtgcccagccccattcatttatttattcagcattcaccagtggctgttgcatgcctgacactgagctttttactggcaagacagagctgaatgaggctgtgtttctgccttgtggatcccccagtatccagggacccagatcaaacagataggcaagacccctgtgtcacggaggaaactacaggggaaggtactgctttgggagtggctcttgggaaaagtaatagcaaaagcccagaggttagcaccgaaaaagatcaagttcagactctgcctttgctattttcttgctgtgaggccttgggtaaattacttaaagtttctgaatttcactttctgcatttgtattcttactctgcaaagtgttgtgaaagaatatacatatagctctgggcatgtagcagatgctcaaaaatgattattatgcttgaagtcttcagtgccccaatcatggctgattttcatgaaaataaactcaacaaactccagtgttctgaaatgtctgagactggctcagctgtgctcaggttagtctgaaatacattttattacagtctaattctctgcaaagtggtcatccacacatcttgtgtatggtaatgtggaattagaatattcagctctcagtgaatttcatttattggccattatgtaaaaaccaaagaaaaatgacttatgaagacattgattgctttgtagctttaaaagacctccttagaattagaatggctacacagcctctaagaatatggtctacactatatattttgtcatcctgcagacacaacaaggaagtgggaatcgaatctatttagcaggatgtctttatgtgtgaagatttcttgctgcttataaatgcttatttgattatttattcatagatatagaaagcacttttctttcattctgtttcctcattgtcacccaagtaagagtcacttattactgatgtgctaaagaataacagatgagcattgaccttcaattaaacattagcaaatatgttgcagtagcataaaaaataacatccacttgcttcagaatagaatgagatgatgcttaacatttctattgctgaggtcctacaagtaaaacatgtttgtttcataaatagaatttatattatcaattggaacatattcttcaatgcattattttgcctactgcttaggaatatcttcctttgttaattttgagttattttatttctactattcagccatgcttataaaatgcaagtcatatttctaatattattgctgttcttttagtcagatgggttcaaccacatttattcagcacctgctatgtgcagtacacttgtcagcatgctggtcttaaaccttgagctataaactgaaatcacattaacaatgtctagagaaagactgcagagatttaaaataaagaaaagtcagagaaaggtgagttatgttttttttgaccactgggccaaacagtgaaaggagaataggagaggaggttttcttaaaggcacaacaggattcacacaaatgaggagacttagaacagaaaggtcacaaatacagcacttgtagtgctggggatatgtattaatattttaaaaaaacaacatattttgaaataattctgcacttaaaagtcacaagtatgctacaaagagctcacatatctccctcgttctcatgcctgagctggctccttcctgagctggatacatacgcccgttatcagaacgtttttctgaccacttgagggcaagctgcagttttatttttatttttattttttgagtcagggcttgctctgttgccccggctagagtgcagtggcatgacatcggctctctgcaacctctgcctcctgggctcaagccatcctcccacctcagcctcctgagtagctgggactacaggcatgtgccactgcacctggctaattttttgtagagatggggttttgccatgttcccaggctggtcttgaactcttgagctcaagcaatcctcccaccttggcttctccaagtgctgggattacaggtgtgaatcatgatgccctgtcactcctaagtaccccattgtgtatgcccccaaacaaggacactctcccatgcacccaacctgcagcttcctccaagtcatgaagtcagcattaatacaacactcttctccagtctacagactccattccatttcaccaagcatcccagtgatgctcctttctcctttctgactcaggaacacacattgcatgcagttgttgtagctcttaagtttcctcctgcttgagcagttcgttagtactcaatcgttctctgtcttccatgtccttgaaagttttcaggagtgtagaccttacattttgttggatgaccttcagcctgggtctttcggatgtttcctcatgaccgggttcaggtcatgcaaccctaatgagaacctcttgaaaatgatactgtgcgttcacatcaggtgtcacacagtgtggacccctcccgccactgtggatggtaaccttcatcaccccatcattctgtggctgcctggtttctccagcactaagttcccatgtttcctttgatatctaaatagtatgttgtgggcatgatagtctatgattattctgatgcctactccccatcaaacctccatttcatcattcatttccattagtcagcattctattagcatggatgtgttggttcctattctattcaatgggctgtactttattactattattttgattctcaaagtgtctcaggtttggaccagaggaacttcttcaaggtgtctcttgtgttctattgacatgtccccatctgcctttgaatacttcttaatttttttgtacaacaggatgctgtagacacatctgtactgcccctgcctcagccctggcctcagccatttctcccaggagctctggttccttgtatggatggatggagtttagaaatcaggatctgtgtgcttggtgtgctcatggctactgaggtgtcattacttataggccttctcagtaggtaaatatagaaaatgtgtgtaaatgcactcatatgcttccttcgctatttccatattcacctgtgagtttgcatattaaaaactagtagtttatgctaatgtttcctattccagtgcaagtcattagaatcttttctacccttccccctttccatgattatatgaacattctccaataatcaggaatctggccctctttatcttcatatccttaactccttcatttgtttacatatttctccatgtaacctatctcccatttatcccagctgtcttccccatctgttgctgtgttcccctcaatgtgcctcatccccaggccctggcaggctcatcaccacgtgtgctgccagatgcctctgtgtggcagcccctgcatccttggtgctggtgagtggaccacctgtgtgctcctgtacaggctcccaacttaccaatggggccgctcactgccaccttttctgcacaggaagagacgagaaggcccatttatgattttgaccccagtcccaggcactgagttcttcaagggccaggaatgtgacttgttgatctttgtagcccaacagtctagcaatgttgatttacccaaagcattattaattgagtgacagatgaaataataaataaacatggcatttgaaaggtgaaaaagtcttgtcaatcattttcaaacactctcctctcccagaggaaccatttccacatcatctgtatcacatggacaaagattgccaatctgggtaaagcttcctccttcccccattgaggtgtgaaatggactgaatgcttgtgctccctaaattcctgtgttgaaaccctaattctaatgcgatggtattaggaggtggagtgtttgggaggtgattaggtcatgagggtggaggcttcatgaatggaattagtgcccttatacgaagaaaccagagaggtagcttgttccctttctgccatgagaaaaagcagctgcctgcaacgtggcagctctcaccagaacctatgctggcagcttgatcttcgacttccagcctccagaactctgggcaatacatttctgttgtttaatctacccagtctatggtactctgtaatagcatcaccaaccgacatagacaaggaggtctctgatgcacctttttgttgttttgtaacaatcatgatttaaaaacatcttgtggaggtattggtcatatttagcacatgaggctctgggacttaagtggggtaagtgatttgtcaaatagaatatgcacagttagtgtcaaagccgttgcccggatctgggtaccctgatccttagtgttgtgattctgtgttctatccaatgtcatgcctcccccacatgactcaggagcagagtgctggcatggagaagagacagggtggctgagcgagctcacttatggtcctgaataccaggggcagaggtttggactttgttctgcagcgcacatggagtcctccaggcctttgagaagattttgtattacaggttgagtacctcttctatgaaatgcttaggaccagaagtgttttaaatttccaatattttggggggttttagagtatttgcacatatataatgagatatcttcaggataggacccaagcctatacatgaaattcatttatgttttttgtacatcttatacacatagtctgaagttaacgctatgcaaaatttcaaaataattttgcacatgaaacaaaattttggctgcattttgactatgacccgtcacatgaggtcagatgtgcagttttctacttatggcatcatgtcagcactcaaaagctttcagactttggggcatttcaaatttcagatttttggattagagatgctcaacctgtaacatgtatgaaagtgcttggagtaatgccaggttctagcagatgtttttgcattttgtttatcagcttgtgcacatctgagtgttaggaaggtcgctctgttggtgatgtgtggaaaccatggaaggagtgagagagatcagacagagagtaattcatccttgcagaagtgctgacaactcgggctaggctggggacagtagaaatggagaagatgtgaatatgtcaaataccacgagagactcacgaggatgtgaaatgtaggaagaggacaaagcaaaggatctgaagctgaaggcctggatgggatagtgcccttgcaaggcagagtaacatcttgctaggtaggtaggcagtgagcttgatttaagacttgatgagatttatgtcttatattcatttagttgctaatgaaaaggatttaaagtggcttatgaaaaacataaaaaaacaagaaacaaaacaagggaatctaaagttcattgtaatcagactcattttttgaacaatttgctgtgagccaggcagcatcccaggtgcaggtcactatacaatgaccaacactgtgtcatggcgcctcttgtgtggatgcatgaggccttgaacatgtggaggtgagggtgtggtggcttgtcaaggagaacctgcctgtgcttagggagctggtggagcagggagcctacctgcagggttggcaggaccggaggagatactgggatctgatggatgaggtagacttagcctgggctggatgtggaggaagaatgactctggcaatgggaacagcagattctcctgaaccctgctcccagctcctctcacagcaactttgcttttctggttccctatgtccgatctgtcagagaacatctcaaatccgaccacttttcaccacctgcgctttcatttccaggtcctggctacccttaggtcttgcctggggaacatcaatgaccctgtgactggtctctgggctctgctcttttacaatgtgttcccaacagagcagccaggtgatcctgttaaacatgagctagatcatgccagtcctctgctcagaacccttcagtggctctcatctcccttggggtaaacaccaaagtctgctacaatggcctatgtggctctgaagatcaagcccactctcataccctctctccctcatctactactttccccttggttcaccctactaggagtgttccttacatattaaagtgtgtatttgcctcatggcttttgcactctctgggagctccctctgcctggaatatccaattagtgaataggggtgtcattcggggaacccagagagccagcttttgtcagaatggaggtaggatgcacccttatgctaaccagaggtggtgctggcagggcaagtggaagctcccagtagctgagagctgtgagagaggctggagtaggagataatttagaaattggagatcatcactgaagctatgcaattgctggtgaccatcctgatgcccttttctaatcataagataaaaaataactggggctgagcatggtggctcacgcctgcaatcctaacactttgggaggccgaggcaggaagatcacttgaggccaggagtttgtgatcagcctggacaacatgacaaaaccccatctctgaaaaaaaaaatttaaaaagcagagcctggtggcacatacctgtagtccaagttacttaggaggctgaggtgggagtattgcttgagcccaggagtttgacatcagcctgggcaacataacagggctccttagctacaaaaataaaaataaaaaaagctaggtgtggtggcacatgccagtagtcccagctacttgggaggctgaggcaggaggatcgcttgagcccaggagttggaggctgccactgcattccagcataggtgacagagcaacactttgtcttaaaaaagaaaaaaaaagagagaaagtagtagcttttgatgcctacccttttgaaggtgagtggcagcatggaacatagctaatcacagatattttctgcgataacttatatctttctttggaattcactgtgagtgtaatttttggcagccagtttaccatttccagtgtttaattttgttggatcagcctgcgctctctgagaacttttcatctggcagtggatgggtatagtttagaatatggtggatagcagagggaggctagactgggtttttaattttttttggaatttgaagacagtgcttaatgatattactaataatagacaatccttttgaacacatacaaaatgccaggcatgatgctaattgctttgcatagattatctcagttaatcctcagaaggccttatgatgtagatactattattaaccccattttttacagagcaggaaactgaagcttagaaaggttaagtaacttgaaggtcagacagctagaagtggcagaggtggggaagactcaggttttctcctaacccctatggaacagatctggatgcatctttacatacattatgactgtatcaggatgctattttagaacacataattcaagaactttattgcgtttcaccaaagttttgattttgtagaacaagaaataaagtattaagaaagaaatcatataaacatttgaacgcttggtgtcagttaaggaatgggtacatttcagcattatcctagaaggtcttatcaggccagactctactgcgtattttaagtggggtgtctgaattagcttctgcagtaacttctgaagaaggtggcacagactgagagatctgctaattacttgggacttgatcttggacagatgaccttttctagtatccttagaatgaattgttggtaaatgcttagtttccggctataggtttcaatgcatatgacaagtttatgtgaatgtctttcacttaacagcctcagagacacaagttttctgccctttcctctacctttttgggacccaggtgtgtgccttgggaatgggccagtgcaggaaaagagttaggttgagaggcacgctgtgactcatgttactctctgctggtgtatgataaaaggttttgttcaaaatgacaagcttgttgaaaaatgtgttttaatttagacttgagtcttatcgaaatggcctccttagaaaatggcttatagagccataagaacataaaggagtctttgtgatctagggtagagactcttaaaacattttctcattatgacgtaaaaaaggataatgtttgtattgcacactggggttaagtagtaagtgctcatggcccgaggtgatggcttgggatgttgagctgccttgggcccacccactgccccagggtgaagaggatcaaggtcttagtgcactagcctgccaaggaccaccagaagggaagctctgatgaatggtatcttaaaacccagtccttccatttctgcagaaatagttttatgtgaaactttctaattctttgggcattggattttgaagataagttctcattagaatggattccaatttctgcagtttatttaaaattttttaacagtttgataccaacactttattagcaaagaaaatggaatcaacttttttttttggtgccagaaagcatagttttttttccataagaaacaaaggtgaaatatatgtaatgggtgagagacaaccaaaacttgccacataagggccagtgagagaatcccaacaaatagcaaaagttcatttttccatgacctattcatcacagaacaattaaaaagctacacaaagatcagtcttacctgcattttagaaatacatttcaattcacccatggatccaacatgggtgatctatctatctattcttttagatagacagagaagtttttattaactaacttaggaaaaaacactacctgttaaactcataaacaattgtttaaagagtatctacagaatccttctctcaatgtttccatgtaaaagaaatgaaaatcaatagtccagagatcctcgttaataatgagccactgataaacacaacatatttataacttgtataacattttatttatgtgcattctttgagcattatgcaatgtaattaaaatttttttaaataaaaaaatttaatatctttattttttgtcaattgatttttccccacttaaaaaatttgcaaataataattgtgcatatttatggggtacatagcgatgcttcagtacatataatatatagtgatcagatcggggtaattagcatatccttcatctcaaacatttattttcttgtttttttttgagacgtagttttcctctgttgcccaggctggagtgcagtggcaagatctcggctcactgcatccttcatctcctgagttcaagtgattctcctgcctcagcctcccgagtagctgggatcacaggcgcctaccaccatgcctggctaatttttgtatttttagtagagacggggtttcactatgttggtcaagctggtcttgaactcctgacctcaagcaatccacctgcttcggcctcccaaagtgctgggattacaggtatgagccaccgcgctcagcctaaacattcattatctttttgtgttgggaacattcaacatccttctgactatttgaaactctaaaatatactattgtgaactatagtcattctctattgctgtagaacactagaacttattcctcctatctagctgtaattctgtaacttttaacaaatctctccctatccttcacttccccctacccttctcagcctctaatatcctctatcctacctcttacttctatgacatcaaccctgatacagtttggatgtttgtccccttcaaatttcatgttgaaatgtgatccccagtgttggagatgggcctggtgggaggtgtttgggtcatggggtggatccctcgagaatggcttgattctcttcccatggtaatgagtgagttttcactctgttagttcacatgagagctggttaaaagagcctggcatttcttgcttgttccctctcttgccacgtgatgtgcctgctctcccttagccttctgccatgattgtaagctccctgaggccctcactggaagcagatgccggcactaagcttcttgtaaagtctgcagaaccaggagctaaataaatctgttttctttataaattacccagcctcaggtattcctttatagcaatgcaaaacggatttaagcaaactcattttagcttccacatatgagtgaaaacatgtttaactttctgttcctggcttatttcacttaacataatgtctttcagttccattcatgttgccaagaatgacaggatttcattcttaatggctgaatagtatttcattgtggatatataccacatttgctttatccattcatctgttgttggacacttagattgattccatatcttgactaatatgaataatgctgcaagaacatgggggtgtagatgtctctttgagatgctgatttcctttcttttggataaatgtgcagtagtgggattgctggatcatatgattgttctatttgtagtttcttgaggaacttccatactgttctccattgtggctgtactggtttacattcccaccaacaatgtataagagttcctttttcttcacatccttacaagcatttgctgtttattttatttttttgtctttttgataatagctatcctaactggggtgagatgatacctcattgtgattttgatttgcatatacctgatgatcagtgatgttgagcattaaaaatacatttttggccatttttatgccttcttttgagaaatgtctgttcggattatttgcccatttttaaattagattgtatttcttttgttgagatgattcagttccttgtatattctggatagtaatcccctgttggatgggtagtttgcaaacattttctcccattctgtaggttgtcttttcactctgttgattgtttatatcttttatttttttgagaaagggtctcactctattccccagactagaatgcagtggcatgatcacagatcactgcagcctcgacttccccagactcaggtgatcctcccacctcagcctcctgagtagctgggactacagccatacaccaccatgcctggctaatttttgtatttttgtgtagagatggtgtttcaccatgtttcccaggctggtcttaaactcctgagctcaagtgatcctcctcgtttagcctcccaaagtgctgggattacaggtgtgagccattgggcctggccttgttgattgttttctttgaagtgcagaagatttgtaatttgataaaatctcacttgtttagttttgctattgttgtctgtgcttttaaaatcttattcataaaatgttttcccaggctcatgtcctctgttttcttctcataattttatcatttttggtcttacatttaggtctttgattgacttagactagattttcatataaggtgagagacaggggtctactttcatccttctgcatatggatatacagttttcccaacaccatttattgaagagaccttcttttccccgattagtgtttggaacctttgtcaaaaatccaaaaatcagttgacagtatatatgtggattaatttctggattctcaatactgttccatcggtccgtgtatctaattttatgccagtaccatgttgttttggttactacagctttgtagtatattttgaggtctggtagtgtgatacctccagtgttgttctttttgcttatgattactttggttatttggggtcttttgtagttccatacaaactttaggatttttttttctgtttctgtgagaaatgtcattggtattttgatagagattgcactgttattttaacaatattaattcttacaatccatcagtatgggctgtcttttcatttgtttgtatcctcttcaatttctttcatcaatggttcatagtttcccttgcagagatctttcactttcttggttaaatttatttctaggtattttaatatttttgtagttattgtaaatgaaatttccttattaatttatttttcagctagtttattgtccatgtatagaaatgccactggtttttgtatattaattttgtatcctgcaacttcactgaattcatttatcagttctaagagtttttttgctagagtctttaggtttttctagatataagagcatgccatctgcaaatagggacaatttaacttctgccattccaatttgaatgtcttttatttctctctcttatctaattgctctggataggacttccagtgctatgttgaataagactggtgacagttgggcatccttgtgctgttccatttattagaggaaaagctttcagcatttccccattcagtaagatgttcactgtgtgtttgtcagatatgccatttattacattgaggtactttccttctatacctaatttgttgagaatttttttattatgaagggatgttgaattttatcaaaagctttttctgcatctattgagatgatcatatgatttttgcccttcattctattgatgagatgtatgatgtttattgatttgcatattttgaaccaactttgcattcctgggataaatcccacttgatcatggtatattatctttttgatgtgttgtttgattctgtttgctgatattctgttgagaatttttgtgtctctcttcatcagagatgttggcttcttttgttgttgtgtccttgtctcattttggtgtcagagtaatgttaaccttgtagaatgagttaggaggaattccttgccttttaattttttggaatagtttaagaagaattggtattaattattctttaaaggttcaacagagggtgtgggataggggtagggagtgcataccttatgcttctaatctggagcaatgcagctgtgcagattcctggcagctctccaaactggactcagggcttgcaagaactgtgagattctccttttgcaaggactgtaggtgtttgctctgtcaataggagttgatgaggtccttctgtttatcttttccatgcaataagaagtccctcctgactctaggcagattcaatctgagcaggggatacagggctgcagaggctgagtgcctgcatgctgcctttcgggactgccattcatcacagttgcatcttcactcccccaccgtactccagcaccctcccttcaacactccagtcaaatcttactgtttattcattgccttggtccttttttttggtgggggtaggggggcaggcagaatgccaggcatctctaatcaaccatctgctgacagcactcttccaaatgatctggagtttatttttatttttaagaaaaaattgtattacacagattctatatttataccttgtgctagtagacttaaggtcattaaaatataatggaacccctactttacaacagaagtggatatatagtcatctatagcatggtagaattcgaacatcatttctatggctttagtaactgtgactggctctatctggatgtgcaatttctgaggaaatgttaaaatcaaaacttgggcactgattttttttaaaaaaggaattatataaaactcaccaaaattatagtttttttccccaaaatgctcattgtgcttttaaaataattaatattaagtatccctctgtgtgaagaccataattatgaccatcatatcactatgtcaacaatgacctttgagagttaaaagaataaaagataggagagccatcttgttggtgcaaagaagattcttagaagtaccaactgagagatgaaagtgctggcctagaaactagtaaccttgtcatgatgtcattaaggcaaaggttcactacaactggagctaagagacaccggggttatctattttgcatttcatggttcttttttcctctctctcatcattttgggtttccagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcagtgagtacttgttattgtcaccattttcccctcatgtttcttcctacctctcagctcccacatagtgaagagctgggaggagcttagctgtagagacccttggctgcctttcctgggaagggccctttgttggttgggaaggtggggattcttccagagtgagagatggcccatgtgggtcatgcatctctagaaagaagacttttctgccacttgacagagagagaaccttctcaagtgcagctgcatcccaggtctgaagcatctcttgggaaactacccttctaagaaggtgggggtaatttcctcttgttgaggcagcttggtgtcctgtgatcatattaagcctgtaagataaacagatggtcccctctgaccgagcgatgaaaatccatcctcctcctaactctgccctccagctcctgagcaacatttgctatttgtgtcacccaaggctcttctgagattagtaatatatagagagcagttgctgcttctaatccagtggcttgtggtcctggctgcatgtttgaataacttagaaagatttaaaacctaccaatgtccaggctcctccccaggcaagctaagtcagaatgtctaggtgtgggaggcaagggtggctcccagatattggcatgcttaaaaaggctgagaaccactgctccatctacctttgtgttccctttctccctaggtaaaggtctgagagggaacaggtgttttatgaatgctatgagcctcatcacaattcaggtctggttctacttagttatcaacatggccacaacaattccactttatttcccacttccaattggtcctgacaatcacaagattttctggcctattcctattaagtgtacatggcattatacatttagtttatcttgatacctccctgaagcctgcctgcacagtgagaccaattactttcagttttgccagtagcatgtagcagagtgaatggcacctggtaggtgcttccttataactatttgcttagtgaactttttcatggttctcctcaatagagagtgaatttcacctcgccattttcattcttttctaatctgacattgagacatcattgcaacattgcgtgttcctctttcacacatgaggccactcccaaattgactttctctgtaattctctcattcttttatctttggggttatttcttgtcgtctactccagtcttgggaaaattttagcatgtaaaaatagggcacaaagattgaggcacaataaatttagctaatttattatgtttctatttatttaacaaacactttcataacagttactaaatgctttagaagttactcatttaatttatttccatttttgaaaattgtggtaaaatacacataacataaaattcaccatcttaagtgatggtgattaagtgattaagccattgttaagtatacagttcagtggtattgaatacatcataatgttgtgcaatcatcaccaccattcatctccagaacttttccctcttccccaactgacactctgtacccattaagcaataaatccccatcccttcccctcttccagtccatgacaaccacattctaatttccatttctctgaatttgactactctgtgtacctcatagaagtgacatcatacaatatttgctcttttgtgactgacatttctcatagtatagtgtcttcaatgttcatccatctgatagcatgtgtcagaatttcctttctttcaaggctgtataatactccattgtatggatagactacagtttgctcattcattcattaaaataactcatttaatgttcatgacaattctagggggtagtattattttatatattgatatctacatgtatagagatctgtatctacatctatacctgaattttaggatgaggaaaccaggcccaatagaagctaagaaacttaggcagatccaccagcaggtgagtgctgagggagacacaaacccaactgtctggcttgcatcttggccctgaatcagtgcactgtgctgccttttaagtctgggctggcaaaggctgctatattattatctctttagccatacctgcaatttggatggagagtgtattagtccattctcacattgctataaagaaataactgagactgagtagtttataaatgaaagaagttaattgtctcatggttctacaggctgtacagggagcatgatggtagcatctgctcagcttctggggaggcctcagtaaacttacaatcatggtgaaaggtgaaaggggagcacacacattgcattgccagagtaggaacaagagagagagagaaaagagggaggtgccacacacttttaaacaacgagatctcatgagaactctatcatgagaatagcaccagaggatggtgctaaaccattcatgaagtatccacccccatgatgcagtcatcttccaccaggccctgcctccaacacttgggattacaatttcacttgagatttgggtggggacacagatccaaaccatatcattccacccatgttctccccaaatctcatgtttttctcacattgcaaaatacaatcatcccttcccaatagtcccccaaagacttaactcatttccagcattaactcaaaagtccaaagtctcatctgagacaaggctagtcccttctgcctgtgagagtctgtaaaatataaaaccagtcagttacttccaagatatagacattgggttaatactcctgttccaaaagagagaaactggtcaaaagaaaggggctacaggccccatgcaaattgaaatgcagtagggcagtcattaaatcttaaagctccaaaataatctcattttgactccatgtctcacatccagagcacactggtgcaaggagtgggctcccataaccttgggcagccctgcccttgtggctttgcagggttcagatgctgcagctgctctcacaggctggcattgagtacctgcagcttttccatgctgaggatgcaagctgccagtggatctgctattccagggtctgcaggatggtggcccccttctcacagctccactaggcagtgccccagtggggactctgtgtggggttccaactccacattccccctccatattaccctagtagtggttctccatgaggggtcctgccctgcagcagacttctgcctagacaaccaaacttttccatacatcctctgaaacctaggcagaggctcccaagcctcaactcttgcactctgtgcacctgcaggcttaacaccatgtggaaattgccaaggcttatggcttgcaccctcagaagcagtggtccaagctgtatctggacccctttgagccatgtctggagttggaaaaactgacagcagtgtgaggagcagtgtcctgaggctgtgcagagcactggggccctggggctggcccatgaaaccattccgtcctcctcggcctccaagcctatgaggggaggggctgccatgaaggtctctgaaatgcctctgaggccttttccccattgtcttggctattagcactcagctcctttttacttatgcaaatttttgcagcctgcttgaattcctccctcgaaaatggtcttttcttttctaccacatggccaagctgcaaattttccaaacttttatgctttgtttcctctttaaatataagttcaaactttaggtcatttatttgctcatgcatatgagaataggttgttagaagcagccaggccacatcttgaatgctttgctgcttagaaatgtcttccaccagataccctaaatcattaatctcaagttcaaagatccacagattccctagggcaggggcacaatgcagccaagttctttgctaagcaataacaaaattgacctttactccagttcccaataagtttctcatttccatctgagacctcatgagcctggctttcactgttcatatcactaccagcattttggtcataaccattcaatcagtttctaggcatttccaaacttttcctcatcttcgtgtcttcttctgagccatccacactcttccaacctcagcccattacccgattccaaagccagttccacattttcaggtatctttactttatagcaatgccccacttcttggtaccaattttctgtattagtccattttcacattattataaagaaatacccaagactgggtaatttataaagaaaagaggcttaattggctcactattctgcaggatgtacaggaagcatgatctggcatctgctctggcttctggggaggccttaggaaacttacaatcatggcagaaggtgaagggggagctagcatatcacatggctggagcagcaagagagagagaaatgggaggtattactcacttttaaacatccagaccttgtgagaactctatcacgagaacaccaggggatggtgttaaacattcatgaaagatccatccccatgatttaatcacctcccaccaggacccacctccaacattggggattacaattcaacatgagatttgggtggggacgcagatccaaaccatagcagagagtgatgcttttattctggtcttgcctaagtttttgatagaatatgattaactaaaagccagtgtcatgcattcttaattatattaggttacaccataaggacatctcttacatttgactgtttgaaacctgtcaaacattttatggggtttgacctaataaggcccccagaaaagtataggcctttattaaacatttatcaagccaatattaactgttggcttactttatgagctatcatcctctttccttttccttacaggagttgtctgtatactatgccagtgaatgttccattcactttttgagctcactgtgacctgatttctgtctctatcactcctcaaatatctaccaaagtcagcaatgactttctatttgctaaattaaaagacatttttcaattcttattctgctatgtatcatggcagtgtctagaatttttaataaattcattcttaaaactcccatttcccttggctttcatgatttcacccttcctggtcttcttgctacatttctggccattcttcttaatgtcttatgagctccttctctccctttcttcttaattttttttttttgagacagagtctcactctattggccaggctggtctcaaactcctggggttaagcaattcttccaccttgggctcctgaagtgttgggattacaggcatgagccaccatgcccagcccctttctctttaatattgttgttcttctgtcttctgttctagcttttcctctcttctcactttgtatcttctttctcagtggtctcaaatgctctgagtcttcagatactgtttctatactattttttcccaaatttctatctctagccctgatttatctccagaattccaatccacaattcagttttctattgagcatctcccttatttttacttaatttagtatctttttatccttaacattactatctctttatccttgccttttactaagtttgctatcttttaaactaaatttaccgttgttctccccattcagttccttctcctatatccccagtctgaatgactttcactgccatttacccagttacccaagcaaggactctgaggcatctctggatcctccctttccatccctccccacagtcattggtcaccaagtcctgttgtgtccactgtctgtctctctcatttccactcacttgtctcacctgcacgtcagtgccttagttctggtctttaacactttaaatctggattattgcagtggtctccttgctggtatttctgattccattattaccacctctcattcatcttccacaaggccatgatagaagtattatgttatgctcaatggctccccattgcttgcaggataaaattcatgttgcttagcatgacattaaaagtcttcacgatccagcccctgcccagctgcccagcatttaactagacattaccagcatctgcaatagacacttactgaaatattatatgttacccccatgttctgaatgtttctagattctatgatcttgctcatgccccattgttgttaccaactatttcccattcttccagacttagtgaaacaaatatccttgcaaagctctgctcatcagtcacactgcctctcccttgaatgacagcataccttgaatgacttcacttctgcttaggtcttaaatacatctgttttcttgaatatctgtttactctgacagatgataagctccttgaggacaagactgtattatatttatctttctatttctagagactagaatagtgtctggcccataatctgtattctatattcattgaatgtgtgaatgtgacacatatgcatatgtagctatatataggttcacaaacgtatatgtgaatatcgagagagagagagagagagagagagagagagagagagagactgacttcactttattgggattcagttgccctagaggaaaatgctccttcagcttttcttctgaaattgccagcaagaaggagttgcacagaatcttgacagaaccttggataggaggtcatttctggtcctttctcttccaccaaccagctgtatatggcttggtgtagttattgaacctctccaaactccactcccttcatcagaaaatgagggggttaaattagatcactggtttctaaactaaagttatttatgtattattaccgtaactagaaaataatgagttgaaattaactttctgaaatttttctaatgcatattaacacaattacctagttgctaaaatttttttaaaacctgcctttcagtgtgccagctacccactgctgttttcacagtgaccaccagggggccatggtggcaggctgaagctcacacagcccagagcctggacagaaaccgctctcacaggctctccgagtcaaggggtatatataatatttttgaatgagtggtgcttttcctgtagaaataaaatagttgtatcaacatgaacaatgttaaatactaattaataactcaaataagtgcctgctaacctttttgggatcaagtatttatttattttgagaagctgatgaaagctatggacttcctctattgcaaaaccacgtgtacacatgtacatatatgaaaactattgagtgtattttcaggagactcacagatctcctgagttattcgttcactccttagagggtctttggttcccaggttaataaaatttagtttaggataagatttaagaagctgtaaacatccagatacaatcagatcctttatgttttattatttttgttgtcactttgttcttaaaaatcacaatttaattcagcttttgagaaacactgtttaatcctctgaactcgtgtagaagagcaccctgggttatgttcagatcctgccagcagccaagagagctttaactatcttcaggggttaactaggttcctctgagggcagatatcggtactcaaatcatttgacccctcttctgtggggtcctctggcccagtggatttgcttgttggaggaataacttttgtgatatcctcttgattcctgtgggaagttcatgtatctttgccacaacaaatggtatatgctcaggccaccctataatagaccctctctgccctgctaggtctctctaattcctttttccctggtttacggggcagcaacacatcagaagtgagttccttagacaatgctgcagcggacagtttgggtgccctgtgtcccaatccctcggcctccctccgattccctccacaactgggaaccgtgctcacagtcggctttccactcaggcacccaacaggtttatcaggcctgtctgcacaggtgttctcggaacctgtgtgaggaggggtgggggtggataatgccccagcctacccagcctcttagggaacagttctgaggcatgctccacactgtttttttttttcttttctaggaggttcctactactaggaaccttttggccaatgggttccatttgtccgtgtggtgaccagctccacagtgaaccttttattgaattttcctctttctcactctagtttcttgggaatcacttcttcaaaatcaacctgtactcaggtccctgtctcaggctctgctgttaagagaacctaaatatagacagatatccacattagagaattagatgtcagtcttccttcttgcagggcacccccaatctttgtgagtgaatctagtggattttttttttcccactgggtttgagtagaagagtttactcccatgtgggccaggtttggataggcaaaccatggggtaggggagaaaaacgcgtctctcatgaagacccatttcctagatggccaacaggtgggtgggtattgagagtggtggttgattgcagaggtgctggttgagcagccccaggggtaggatgccccactccatcattagagattcagaatgcagagcgtttaggtctaagtccttcagctttagtttccaactctggagcaacaggaaatttctacctcaatatcctgtgacaacagggattagaagagaagagagaggcttctgttcctactgtgtcttccatccaatcaaaggaaagttatttttcctttctcctaagagagagagttggcctactatcatcacacatttggaagataattttctcatgaatacattgcatttctctaactatacaccccgtgcatttttccactggatcttcaccaatatgtacgtgaaaactggtcctatttgtaaccgaaattgtgtgtgtgcatgtatgtgtttgtatgcatgcgcacacaaaatgtcctttatcgaagaccttttcccaggggataacctcaaactcaagcaaacaaaatataacaaagtttaaaacaaagatctatcatggttttccagtggggcttatcaaggcagagccccagtttgcctgtccacatatttcccactagcatgcttcctttgagatgggaacagagaagatgaatgttgtgcagcaccatgatgcttttgggcagagtcattcttcctctggccaattgctcctcaattgcctttgaaacatgtgattctttatttccctttggttgtcatgtagggactaacacagcattcagtgtcacagaattcagtgatggtcagctctaagcccttgagattggaatcaagatacactgtatgagaccagaaaataactgttacagacacattttacccaggatataaaatgagatggctatgatacaacatgaaaattatcattactggctggacatggtggctcacacctgtaatcccagctctttgggaggctgaggcaggaggattgcttgagaccaagagtttgagacaagcctgggcaacatagtgagacccccatctctacaaaaaaaaaaaaaaaaaaaaaaaaaacaaaactagccaaatgcggtggtgcgtacctgtagtcctatctacttggaaagctaagtcaggaggattgcttgaactcaggaatttggggctgtagcaagctatgattacaccactgcactccagcctggctgacagagcaagatctcattgcaaagaaaaaaatatttgttattaccaacaaaccaggatatatttctgaaccccaaatcagatcaggagatggggaaccacaagagacagtggcatgccctgtgtcccactcccaggagaccaactccagacccttagtcatggcctcaataagagaagggagaaaggacaaggggggaaactaagttgtgagccacagaggacttctcagaacttgttttggaactattggattataaataaaagctcccaaataaaggtcttccatatcatcctctttgttcaaactcaactgaagtctgtcctgaggccagtggcatcaggcataactattatgaacccagataaatattcatgtgcctctcttgccgggtggtcatttctatgagtgggataagactgtataaaacaatgaaagtcagtttcctgaggaatgtgacttctccatgctccttactttttagacccaaatcatatatatatggaagaattataaagttacctgtattgtctctggcaattttacaacattcttttgtgctctcagaatggccttggtaatttagggcatcgtttattgaatgagcaagctatttctaggtgtaaagtgcacttcattggttctatgactggcccaaaccccttctttatcaccatcttcccaaagagggagagatgggacacacaagtcatatgacataaatttgataggatagtcatcagtagggagcagcaattagcaaccttaatcagaagagttatacccaactcttgttgccagaaatagtcatctgaaaggtggcactccctcaggaccgcatttttctaactgtgatgatgagaacatcggccttgttagttttggtcctttctgagactaaaattctgcgattccagcagtggcacaaagcaatttttctggtactctaacaacattaggggtctcagagaaggacctcctgtgttacatgtgaagatgcgtaaaccacagcactgtcactagcagttccggtgcaggattttctcacaggtggatttcctggcttctccttgccctgtcaacattctcacttgcagagccttctgaaggtggcctctcgagcaatgccaagggcactagagggcccagggggcctgagtgctgggctgggaaggaggtggcaatgtaggctcatcacaggcgtgcaccccttaacaagccggcacaggaaccacagacacctagacgatttcttcattcttttttcaatattcctgaaatatgcattcaaacagtcacatggtaaaaattgtcaatggaatgaaaacatttttcctgtgcaatttggagctaattttttctgtgatgtaggatcttattttatgaatggattttatcctcctttaaattattgatggaaaaggccaagatttttcccgtactggggtggtgccgatggagacctgtatgacactgtgggttccgggtgtgatcttggacacctgaatccccattggcactgagtgctgttctaacattctaccctgcatgtttttatttcttgcccctgagggatttgctcattttgcatactgattagtttacagcagcgatgctaatttgcagcgacatcagggattacactttgagaattattaaatataaaggggacaacattgcagaacacagaggaagcctgactcagaggacagaagatttgaaagacggaagcctgtcccttgcttcattactgagctacagtgtgtcctggggccatcactcagccatctgtggatccctttctctacctggagtaagaatatgagagacagacagaagagttttggttaatcacaggggattttcttatggattaagtaatgaatgtgattaatgataatatagagaattcccagttacccacctgtagctactctgtagctaattttcaattctgtgttgatttccttcaatgactctcatcccgacccagatggtatctatttaggaaattcaagaaacttgtactattagcataagcagagcaaattggggaataaattagtgcaaagaaatgatccaatgcaatagaaaagtgaatataaacggcttctggattttctaggacacagactcattgaatcattctataaatatttgccaagcccctactaagtgctgggcactggggccctcaccatgagatgagctcagtcccttccctccaggttcacagtcaggaacgagtaactgcaaacaggctgagactctgcagcccagaggaggaagtgcgtttcgttcccaccgacatcagtacctgatagtagtaggatggttttcttccagacatttcttctgatgcatataaatatcctcagacacattttatctttttttctttctcttttcttttttactttcttctttcctttcttttcttttttcttttctttctttctttccttctttctttttctttctttctttcccttccttccttcttttctttcttttcttttcttttcttttctcttcttttcttttctttattttctttcctttcctttccttttcttttcttttcccttcccttgcctgcctgcctgcctttcctgccttcctgccttccttcctttcctttctttgtggtattgattgccctgttgcctaggctggggtgcagcagcatgatcatagctcactgcagcctctaactcctgggctcaagtgatcctgccacttcagcctcccaagtagctgggactacaagcacgtgccactgtgcctaatttttagttttgttttgttttttttttttttttggtagagataaggtctcactgtcttgcccaggctggactagaactcctgggctcaagtgatcctcctgcctcagcctcccaaagtgctgggatgacaggcttatgctaccatgcctggcccacatctttcatcagaaagtgagtgctttggacatgagtacagtgttcattttcccgatacaaacattgagatcctggggagatcaacagcaagcttcttgaggatggaggcgttctgtctccatccccaaacagccccagtgtgagggtggggtctgtatacaggagatgctcagtggtcatttatcaagtcagtttgttccccatagttcgctccatagggaagccatttttgttatcatcatcactgtcattcttattttaaaaatgaagaaggtaaggttcagagagattaggtaagtgcggtgacacggtgtgaaaaaggcagaaccaagacccaaagcgtggcctctgcctccacaggctgtgcactctccacgttgcactgccctgctgatagccaccaagaggactcaaacaatgggtgtgtgtggatgtgactggaaggcaggggagatggaagttcctgggcttgctgagaacctaatggtgtgtggtatctgggaaagagcaggaacctgggactcagcctgatccgcattgactcctaaactctccttcctgctgtctgcatggccatgggctagaccctgacccaccgggactcggtttcctcatcagcaaaaccggtataatagcatcttcatcttaggtctgtaatgagaagcgaatgtgatcaaaagataacgtctggtgaacagtacgttcttgattcatagtactttattttattattatcagtttaaacatttttcttgatgctgctatttgcctttaagcatatgaaacaaagaatagatttctaaattatgtcatatgttacaataagtgacctttaagattattcagagaatccgatctttttggtagacttaggaacaaaagcaaggttcctttttctgtaactgctgttttctaacttacaaaaactgaggtgacatattttctagtattgtttctaaatgtatgaagcctgcttcattgcaccatggttggttggttcacttatttcgtaagtgtcaagttaagactcagcaagggggaagagtctcccccagctttaaagtctaccatcattggtccatgccttgcaattgcccatttcttcattgctttgtaatttttctgttgatgcatttgtctctcctgctccatggaagaaccaagaactgtttagcattgtgtccccagagccaagcacaatccatagtacataccaggcaagctcagtaatgttttttctttttctgaatgaatgaatgaaatggggtaggagtaaaaggagacaaacatagcacaacatatattaggatcagttactcattttcttttctaagaaatgcggaggcagtgcgaccctgtgttaatatataaataagaacatgcagcttcacgcttctcctcattgagccctgaaataagtacaaaggtggcagacaagatctagctgtgtgggagatgccacggaaggaggggataggtttaatttggcctttttaggatgctgagtttatgcctccaagtgtcagagctacagatgtctgctcctctgcaggggaagatgaccttgaaggtgatgttattgatgagctttatttaaaacacagacatgttcaagagctacaagactaattggctatgttaaaatatttaaatcaaaagtgcagctacttagtgtgtgttggcaaacattttatgttacagttgtaaaaatgatacatgctcactatggaaactttagaaagatcaatggaaagaaatgattccaccacccagagataagagctgatagcattttggtgaatatttttcttttattttatgtacatgttattaatatttttacaatggttcatttcatactttttgccataaaacctgctttagaaaaaacagcaataaatagtgaacattttccaggccagtgtatcttcttgtgtgacctaattttagtggctgcttagcattgctaagaggtcctgatgctggagcacgattagagtattttcagtcttgggctactaagaaaaaaacctgatttttgtagccgatctttgtgtaaaactatgattatttacatgcaatcaatacttggatgtgggaatgtagaatcccaagttatatttaattttaagtctcattcttattccctactctcaccaaagacttatggtttgggaaaacctttgccaggccagtttgttaggtgaaagatgatgttttatgttgtttggattttcatttaaaactatctttggaggctgggcttggtggctcatggctgtaatcccagtactttgggaggccgaggtgggcggatcatcaggtcaggagatcgagaccatcctggccaacaaggtgaaaccccgtctctactaaaagtacaaaaattagctggctgtggtggcgcgtgcctgtagtcccagctacattggaggctgaggcaggagaatcgcttgaacctgggaggcagaggttgcagtgagccaatatcatgccactgaactccagcctgggcaacagagctagaccttgtccaccctacaaaaaaaaaaaaaaaaaaaaaaaaaaaactttggataataatcattttccttaacacttcatttatttctgaggtgggggatcttgctatgttgcccaggttggtctcaaattcctaggctcaagcagttctctgccttggcctcccaggtagctggaactacaggtgtgcatcaccacgctcagctgtattccatctttttggaatttctggttggtgcacttgtcttttccttcataatttgatataactttttataaattagcaatattatccctttttctgccatatgtgtagcaatatatttttccccacttgtcgttcgcctattagttttagttgatggtgttttcttggacatagcttccttgaattgttgacgtagttttgcttagggtaaattgttttcctgcccacctgcattccattagaaatggattgttttaagggtgaatttgtcattctttggtgacaaataccaacaagtctcctttaaagacagctcaccaacataaggcccaaacctgtgccacattttcactagcatcactgtcaccaaatatgtcaactccggcaagaataagagaaggagcctaaaagattttaagtggttttgacagtctttagcaaattttttctgagaagctcgcatccaagcatctgcaaatcagtcacccctccttttaatctccatcaaggtcagctctggaatttggccctgtttggatagtccaaggcagtgctatccaataaaatctagtgtgagccatatacacaattttaaatgatctagtacgcacattaaaaaagattaagggccaggtgcgatgactcacacctgtaatcccagcactttgggaagcggaggagggaggatcacttgaggtcaggaattcgagaccagcctggccaacatggtgaaaccctgtctctgctaaaaatacaaaaattagctgggcatggtggcacacgcctgtagtcccagctattcgggaggctgaggcaggagaattgcttgaacccaggaagctgaggttacagtgagccgagattgcaccattgctttccagcctgggtgtcgcagtaagacattatctaaaaaaaaaaaaaaaaaaacaaaattaagaagaaagttaatcaagtgaaaattctgccaggagctcagttgcattttctagaactcttggcctaattttattaagttcaacactgtgataagtgctgggaataaaaaaaaatgtgatgtgggctctgcaagaagtgtatttctctgtgattaaagctgattgtgggagaaaatcttctgaaaccctcagtgacaaccttctcattgactagtgactcaaacagtagtgcaaagcagaagattctaaatgagcagaggaagggtggatgccgtaaaggcaagggaactggtgaatttcagaaatagtgagtgtgaattcaatactcctaatcatttgaataaagatcttgttatatttccccaaaattaataagaaacaggtgaaattaattttaacaatacatttaattcaatatatccaaaatattatctcaacatataatgaacttaaaaatattacgaatgagttattttgtactctttattttcatactaagtccttaaaatctggtgtgtgttttacacttttagcacattttaatttgggctaaccatgtgtcacatgtggtcaggggctaccttatcagacagtgcaggtcccataatagtattctgactaaggggaaaaagcaaaaatcacaagagattgtaattcaggtagaaacttacattaaggagctcatcctaaaaacaggtaagtaccctcctaagtatgagaacagatgggggccacttgctggagtttcttactcttaaaatacttgtcaacatgaggatttcagcttctgcatacctgtaccaataggtatgtgttgttttaagggccagcggagatgacacccacaccccactgagaatggagccgaggctgttggaacccactgctcaggacagcttgcacgtgtccatcacgagacgagactggcttcttcaggaaaagcagcagctacaggtgagcaggtgaaagatcttcaagaaatatgatggcatttttcttttctttgagacagggtcttgctctgttgcctaggttggagggcagtggtgcaatcatagctcattgcagccttgagctcctgggtgattctcccacctcagcctcccaagtagctggatctacaggtgtgaaccccatgcctggctaaatttttttatttttagtagatatcaggtcttagtatgttgctcaggctgctcttgaactcctgggctcaaagaatcctcctgcctcagtcttccaaagtgctgggattacaggcgtgagccaccgtgccaagctggcatttttcttatccatttaagccaaatgcagccaagtgggtctttgctttccttgagtgtagcaattagagccttggctgtcaagccggggagtacaaaaaggagagatggtgggaatgactagaaggcttgtaggaatctcattacaaacgagggttgaaagctcagcagcatttgtgcctgttttcgatattcctcattaccttttgaatatgcttttcttgtctgccaggccaatttgccacttcttatcattttgacctttagaagcttcctttgaaaggcagaaagacatctgtgctgtgaaaatcctttatggaaattcctatcatggtagactgtgagctgcagttgttaagagacagagttgtaagtccggactgagcaaggcaggcacatctggaatgattagccggctgcttggaagcccaaggttggcccagaacagaggatgcaagttggctaagaatcatcgaggggctacaaatctgggtgcagcactgagttaaagccagagctctggaagttgacagggcaccccagaggcagggaatcttgaaacagggtccatgcctgcttgagcctggagctgtgaagcatgagtggggagcgatgaggacacattgattagaagcaacgtgacttcatgggaagagcataggtcttcaacacccaagttcaaatcctggcttaggctggaggcttcccatctctgatctggtcatagagtattcgtgttatctgaatttgccccatccaggtcactgcaagagtaaggtggcaaagggaggaaaaagtcagggcaatttatttgaaattatttcccccattaactgagcacttacacagtcaatgtgcatcattataacgtttggatagctgaaaatgtgaaatctggtttttgatttttaataacatttgccaattaaaggtctacacaattcctgagacagtcagagtgtacagaaaataattttagccctgggcacttagtgtttgaagcactctgggaaaggtacttgaatattcatttattcaacagacatttattaagggttcactaagtgccagatactgtttgaagtgcttgagattcctggggagcttttgatccactaggggtgagaatggggagatagacaataagtgataaacataataaaacctctattagacaactggtatgttatagggtgataagagcttcacagagtagactaagatgatgtggaagaggatggagtctactcattgagaagtgagattggacccaacagttcaaagaggagagggagtaggccttgcagaaatttctgcaagaggatcctgcagggggataccaacatgaaggcttagagtgggagtgggcctcctgtgttcagagggcagctggaggcccatgtggctggagcagtgtaaatgagggggaggatttggggaggaagtcagagataaaggggccttgtaaggatgtggacttttctcagattgcaacagggaaccattggatggtgttaagcagtgaagtgacatgatctgaccacattgtaaataatttgactcctgtattaggaataggatgtaagacaataggaaaacagtatgcagcttccttaaaagattaaaaattgattgactgtgtggtccagccacccccccttctgggtatatatctgtctcaaaaaaattgaatgcacagactcaaagagatgtttacacacccatgttcatagcagcgttatacacaatagccaaaaggtgataacaactcaagtgctcatcaacagataaatgataaacaaaatgagtatgtacatgtaatgagatattagtctcggaaggaaattctgacacacgctacagcatggttgaaccttgaggacattatgctaagtgaaatacactggttgcaaaaggataaatgctgtatgattccacttgtctgagttacctagaggagtcaaattcatagagaaagtagaatggtgattcccagggacttggaggaagagaggataatggggaattagttttcaatgggtacagagtctcagttttgcaagatgaaaagagttctgtggatggatggcagtgatggttgtacaacagtgtgaatgtacttaatgccactgaactctacacttaaaaatgctcaagatggtgaattttatgctatgtgtgttttaccagttaaaaaactaaaagaaaaagaaatgaatagggtagaggaagtcaaaagtggaggtagagaggttagttgagagactttgtcagtaatactgtaatcttggagcaattggggacactgaggcattacttttttcttagaatgtcttggtagtagacattctttagtaactcccaattcttctccccactcccagacttgaagtgggttcaggaggtagaagttgtaggtgatgcacctcggggctgagagaacgtgaataagaggttaggagacacccaggattagagttgcactcttatccccacaaaacatgggagtatgttaattaagagtcttattttttattcagaatcatatgggcagtgagacgatgatctactataacactgtgcacatgacgggcattcattacctgctgcttgtttagttaattgaccttaatattaaatgatattttatggattatttggatttcagtttgctatattcgtagaaattaacatttatttatattttcatgaactttagactgcatggcaccatctgcagcatctcattcttctctcagtcctgtagacttaagaagccattttttacctttctctgtactctgaattcttgtgtttggggacagactaacaaagggtcagttgcatttcttgttttggtctgtggctggggtaacctgcttagctcagacctcaggtgcatgaggctccctgccctgtgtcctaactcatccatccgaaatgaagtaagtcatttatgtatctgctgggttcttccaagtcaaattcttggctcaccccccatagttatttaatgcttgggagggaatgtttttccttatgccaactcattagaaatataaagctggcatgatttttccagttcagcaaacctccaaaaatctgcctgcctcagaaggggagttttgtagttctggtgcatatggccaattctcatttaaacgagtcattatcctcagagcagtttgccatgagcagggttaatttataaaatcttgtctcctcattctctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggaggtactgctgatttcctaactgattttgggtcgctcgcctctttgacctgttcattggaatgattttgtctgctgtctttcatttctaaacatttcccaagcagtctgtatttttcagtggaagcaccattggtgttttgggtgggaaaattcttcacggtgtggggcagtcctgaacattgcaagttatttcacatcctggccacttaacccactaaatgccagcgaccctccccattccaatatgcaccctccccatttccaaacaccctcaggacaccctctctccctttgagaactgttggaattcaattggttagagatcctaatgccaacttttgctgaggacgatcatctggatgaactatgcctctcactaagggaagaggcaagctattgagagagggacacccaatggcaaagttcccatctggaagaatggattgttactggtagctaaaatgtattgggtgcttaccatgtaccaggcagtgttataagctgactctatgagttacttcggttgttgtattcattttacaggtgaggaaaaacgtttaagaaggttataatttgcccaaagtcctaattaataagagagaaaactgatatttacactcctgttcattaattctgaagcccggtcttctccactctactctggagtgagaatcatccctgtattctgtatcatggaatgtctataagatacacatctactttttgccctttatttatttatttatttttaagagacagggtcttgctttgttgcccaggctggagcacagtggcacaatcatggctcactatagcttcaaattcctgggtttaagtgatcctttctgcctcagcatctggagtagctggaatcacaggcttgagcctccacatctggctattttttttttttttaagttttttgcagaaatggtgtctctctatgttgcccatgctgttcttgaactcctgggctcaagcgatcctccctgcctcagcctctggaggagctgggaccacaggcttgggtcaccacatccggctatttttttgtttttatttttttgtagaggtgaagtatttctatgttgcccaggttgctcttgaattcctgggctcaagcgatcctcctgccttagcgtcctgaagtgctgggattacaggttttagccattgcacccaatctttcttgcccttcaagagctcatactctcatttctgagacatacagaacgcacacttacacatgttggacaaaaaagtgagtggcacccgaatgggtagatgagcagtaaggactgcaagtgctacgtgggtagagccgggagtgggagcaatggtcggcttggccactgtgctgaagaaaagacttcctacaactcaccacctgtagtggttgagaatacggactctgccacctgattgtctggagttgaaggttaactcctcactcaactcattattggccgatttgaggaaaggggtgttgataataatttctaccttatagagctatcacatggatgaaccgaggtagtacatagaaaactctcagcagagcctggatggtactaagcactttattgtgcttccagtcgtcgtctttacaatggaaatttcagtcttctgaaggccttcaaactacccgtccaaatatatcttactgtatttagtgaacgactgttctgtcttccacatgtatcacatcctatccagcctataaaagcaagcggcacatgctattctagggagttacttaagatctcctcccattccccttctatcccgaatatttccaggcagaactctccatggctcatgcccatggagagggggaagagatttggattgttgccggttttcatccaaatgaaacgggtcccttgaatacagcttgttctctcccacctgcactttcagaaccattcttcagctattgccttggtgtggtgggtaggctgttatgttctcattttgcaactgaggaatcaaaaactcagaaagtttccctgatgatgtagctagtaagagaccatcttgtgtacaactatggctgtctttgggcctgaatcaataaaagatggtttccttccagagagccaaggaagctatttctatgactaattctctttcctcatctaaaactaggagctccacagtgtggttggctgatagaactgagcccaggacttggtctggttttctacctgtatcctctggtttgccttttaatcaggatgagtcacagagaaggcatgaatgtgtgacttttactgagtaatctagtgctttgataggtttttatttgtttgtttgtttgtttgtatgttttgagatagagtctctctctgtcacccaggctggagtgcagtggtgcgatctcggctcactgcaacctccgcctcccaggttcaagcgattttcttgcctcagcctcctgagtagctgggactacaggcttgtgccagcacacccagctaattttttgtatttttagtagagacagggtttcaccatgttagccaggatggtcttaatttcctgacctcatgatctgccctccttggcctcccaaagtgctgagattacaggcgtgagccactgcgcccagccaattggataggttcttgaaaggcatttcaaaagttgtggctctctgattttatgatgctgttagggaaattatatatgaggatgatcttgaacatggggcactgctgtctgtggggtcctctgggagaatccaccatccccaatccgaacattcccactgagattacagaggtcaggtcaagaacaggctgccacgtttttgtgctgaggtgactataggaaaacctgggtatctcaaggactttcagaaaccatgaaggcttcatgtaggaggagatcttgggaatgtaaggatgaggctgggaacagtggctcacacctataatcccagcactttgggaggccaaggcgggaagaatgcttgagtccaggaatttgacacctaatctctacaaaaataaaaaaataaaaataaaaaaaattagccaggcatgattgagtgtacttgtagtcctagctactcgggaggctgaggcaggaaggttgctcaagccctggagttcgagattacagtgaactatgattgtgccactgcagtccagccagggcaacagagcaagaccctgactcaaagaaaaaaaaaaggaatgtaaggacgaagagtttcatgggagggtaggaataaaccagagcagttaaaaggtacaaaaaacctggacaatctaatgactagttaataacatgacctttttctcctgcgataaggaagttatacaggtgcctgcagcatggaacactcatggtgagcagaggccatcagcactggctggagttttgtgtggctggagtgtggccaccctgagacatcctcattatctgggtgattctcaagaggtgatccttggcatcagtctaatttactttgaggtgcagggaggtatcgccgcatctggagggcagtgtgggctgtgtaggtgcacactttgattggtcagcttcctttcttccaccgtagggaggtgaggcatcagactgctccctgccgtaaccatcaactagagaaacccgtcatcaatatttgggctttccatttgagaaggaagatatgtcttttccaagctgatgggctgcagcatggatctgcagaagtgaagcatttgaaagaaaccagtgtagaaccagctggctcaacaggtcagagagattgcttggtctagtatttttaactaattggacatgatcctgttaacctaatttttgctatgaagtattggttgtcttttagaaaatgctgacttagggataatatccagtaggtatatttagccaaatgaacccatcttacatacatcaatagctgccttcattgttcatgagaataggctcttcttaggccagatggagagagccagacaaattgtgaaacaggaaaaccttgaagtcttataaagagaagttgcagagactagtattgttacaaaacctagagaaacagatcactcaacatcacgactgttatcatcatctataaggattttcatagaggccagatacaaactcagggtgctgtctgtttgtaatttactcaactttctaacatgcaattgcaatatgctttgtttcgtggacaacgacccaacagcttgaaaagaaacttcctaatagcatgtgacatttctggatgtatcactggtggagacttacgtgcttacatggaggccatcgtttctgactgtggcttgttgggaaccccctggccaatgtcagagatgggctggaagtagagggcatgtgctggggtcaaggacacccagtgattttcggtttgggtgtgataacagaaatcaaagaagccatttgaattttccaatgtctgtgttctggatcaaataacttagcaggaggagatgaagtgttaccatcccagagacatcatagacactttttgagtagagccaacaaaaatggttttcttccagtgaacaaaaggagaaccctttttaagcactggagaatgaggagctccacagtatggaagctgacagagcaggggtgcatgaaaggacaggaaccacttaaaagatatgttcatttgaatttctctcatccctgggatttcaacccccctgctttaaaacaagtgccttgttttctcctgcaagtcttcctttgatgtgagggtcttagaagaaccacttttacccagtgagcttggttcttctcccacatgaaacccatggttcttgttctaccccctgctgactgcattcccattctctgtaatgggattgtgatgtgggggtgggggagggaggagagggaaaagatgggggacacagggaggaggtgacagtgtccaagattttctgtggatcacatccctccatgtgggcatgaggttccatctatttatttggcgtaaattgaggagaatggtgatttgcagctcctctctgtctagcaccattagctcagcctcccctggcttcttgttggttttatgtgtctggaaaaccaggggagggcagcctgtgacctcatgtagcatgcatatggctaacggcaaagtgagggaggaataattatagtaataatcacagtgatgacgtggagggctgcctaggatgctttctaacattctttagaaatgcttgactggcttgtattcatctggggttgagttcttcattcctcagctcctcggatttttcatgcttcatgtgaaatgtgttctggcagctcatggatgaattgtcgcttgttgtgcatttggaagaaacatgtcacatcttttgcaaaccattggcacaaagtgtgaaacaaactcaacccctggttacaggagggctggctgggccttggttggagagtctgggagcctcgcggcagggctgggctggggaggctcgcgggtggagaggagccaggccttctgcagtatccatgcccccagccactagctaaactgcccagggctccctggcggggggcactgattatgcagggtgctgcaggcatcctcatcacacctgtgctcagtccacaacatgcagtccctgctgatgtcagtcctccttgcaagtgagatttgaaataatgtaattcaccagctcacaactgaatgggaaaaaaaaatcaatagttcctcttttccctcagaaacatatcttattagagtgaggagacagtgaaacagcaaggcctgaattggaaaactgatcctgaatctaggatcctggtagagattctcaaagagggttgcgtggaagcagctgtgtgggaggggtcccattaatgctcttgccccgggggtagtgcgaggcagccaccaaactggagtcacgcacagactgcagagaatatccctgcagcatatcagcagtctccaagctgcttttccattcgtgaagattgttgttctttaatctccacttctgggctttgtctttctctctcctctgtctttgccttctacctgactggtttgccaagacaatggctttatgggactgagagcattagacatcatctggagaaagaggagagctttgcatttttctaggaaattctgattttccccctcttttttttggtaaggacttttctctcttttttagagatggggtttccctctgtcccacaggctggagtacagtggtatgatcatggctcattgcagcattttactcctgagctcaagtgatcctcctgcctcagccttccaagtgctaggattataggtgcatgtcaccatgccaggctaattttttaattttttatagagatgggggtcttgctatgttgccaggttagacttgaactcctgtcctcaagtgatctttccacctcagcctcctgggtcactgggattacagggttttcttttccccctacccccctttttaagtaaagtagacatcttgcttttctcaggaattcatgaggcagaaaaatatttgccaagacagcaaatgcagtgagacagaagtgtgtgagcaatgctggccagatgggtgcccggagtgaggcttccctgcataggcgacatctgcagcattcaggacctccctgcaggtgtgccctctccactcaaatttatcctgtctgtccttcttagttagactggtgttgatactcatacactaattttaatatctctgttatttacaaactgtcatacttgcttacaataaccctataaggtttgttgggcaatatattgtttttatgcccattttgcagatgaggctgctgagggtccaagttcacacagccgtaaaagcggtgccctcacgtctttggccaatttttaatgcagagggaatccagagatggttcacactgatggcctgggagagaccaggccttggacagagtgcttagtccagcaatggaaagaagtccagcccagcagagccgtgggtctgtgggcccaaggaaaagagaatggatgtccctccaggccagggatggttgtctctgtgtgcctagtgttgcctgattggattggagccaaggtgtatctaaaaatagacagcctgggaagaccaaacaggcaactgtctcaagtcagagaggtctgtcagacgttccaaagaaagaaatgtgagaggaagagaaactggaaagcaaggccccgccccagggctagaggaactggtattacttgtctgtgaaaagagggtttgaactgggtggcgtggaaggtcttttctggttctacaatactttgcactttagtattttatgaaataagttaaaataagctgcctaaaaacccctcataattctattcctaggagctctatgttaagttcctccttaaagttccctgggcaggctgtgaccatccacaggccacggtgctccagctggcactttccttagggctggtccctagagcatggacctgagcaaagcctgctttccaagcactgctgctgcagctcagagcttagacctcgcctcaccattgtatatcctcccgttttcttctggaaagtcgtcattacaggcaacgtggaaaagtttaccagactataatctggtaaaggaggaagaggattggaaaagaaggaagagatttgaaaatcccccttatctggctgggtacagatgctgctcaccaggaaatgtaggttcccaataaaacaggacccccatttccagttttcattgcgttgtaaattaaaaataaaatcttaagcccccaaccactgaacggattccctcttggccaaggagaccccagagactccatacaaactgagttcccagccccagtgggccgggaggtcggatttgccttgttataatccctcccttttgtagcttagacataacaacagagcagcatcaatgctaaaacgagatcataagaactgatggaacagactctcggtggcaataagataccaaattataaacaagacctaaggccatgccaggcagggataagtctcacacccctgcacctaaagagtaaactaccttctgactgccacctgggttttctttttctctagcggctaaacgagcactgtcctagagatgagctatcttaaaaccatggcagtccttgcaccgccagatgctgactgactgactctctgttccaccagctgtaactgcagctttcattagaaaagagactgatttcagtaactttcttctgatacaaagaccaactgtggactgcttctggcctatttagagacacttgagtgcctttgtgttctgaaaagaccttttacatagagggcctaattgtaatacatgtaaatgttaagtctccaccctaaggtgaacataagttgtatataacatgtatgcttattcagtatgcatgcattaggaccaccttcatgaatattcatagctcctgctataacctgtggaatatgtatacttggtcaacctattcttgtttttttttttttttttttttttttttttaagatggagtctcgctctgtcgcccaggctggagtgcggtggtgcatctcagctcactgcaagctccacttcccgggttcacgccattctcctgcctcagccgccggagtagctgggactacaggcaccggccaccacgcccggctaattttttgtatttttagtagagatggggtttcaccgtgttagccaggatggtctcaatctcctgacctcgtgatccacctgcctcggtctcccaaagtgctgggattacaagcgtgagccaccctgccggccttggtcaacctattctgtgtaaattcctgtcttacctgtccctcccttaaagtgcctgctaatggcttctgccggaggctatgcttcccagcctgttagaatggcaaccttgcaggctgtaacccccttttaagaaataaagctctccatattctcactcataggtgggaagtgaacaatgaggtcacatggacacaggaaggggaatatcacactctggggactgttgtgggctggggggaggggcgagggatagcattgggagatatacctaatgctagatgacgagttagtgggtgcagtgcaccagcatggcacatgtataaatatgtaactaacctgcacaatgtgcacatgtaccctaaaacttaaagtataataaaaaaaaaaaaaaagaaaaggaaagaatgaaaaaaaaaagaaataaagctctcctttctaaattgataaattgtgtgatttttaagttaacaggctatatttgagaaactcaagggaggaattctgttttacttgcagatgtaaaaaaagactttattaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcatctggagatatacctaatgctagatgacggttagtgggttcagcgcaccagcatggcacatgtatatatatgtaactaacctgcacaatgtgcacatgtaccctaaaacttaaagtataattaaaaaaaaaaaaaaaagaaatgcagcctcaggaaaaaaaaaaaagactttattttgtgctacagtaacatttacgatgatttttgaataacagaacaaaggagggtgaaaaaatggatatgtattttataatgttgtattttaatattttacaaattctctgggcttgttttctttaagaagcttacaacatgagtctattattcttagtattattattgtttaggtagctctttggaggcttgtgatttgtagactcatccatttctcttttatataatttaggcattagattaattattttcaactggagccccatggattatcaaagatgagagatagtcattttagaatgatcatagctagttctaatattgcagctgcaagtcaactctcacaaacatgaaagcatgtgacctattttaagtctttctcctagtcgatttcaacttttagtttccattattatcaccttgagaaccgttctgtacttaatttctctgtaatttacatgtcttttgcaatcttctgttccctttatcaaattctcttattctttcctttttgtaagttgtatgttactattccctgctttaacttttcagatgttaatttagtatgtcaggctaaactcttcttcagaccttgagctgaaactctgggagaagagcagaagttttggaatcttccagcagaaggtaatttagctctgctcagatagacccttctccagtgactgctgggaatatccccaggttggaaataccagctcattgcttgctgagaatttaatcagttaagagcacacctttttcgagctgtggaagggtgattaatctaccctgtgctgatagctaggctgctaagatgacccaaagcaaagccagacagaacctctagatttcctgtagctgctttcagtggggggtgctgtgtcttatatagagatcgttgttaaacattcatcttgactttcattgtcattactattttgtacttcctctttggcaaatttcctcagcttcctctttgagtcatgttgatattggtgtttggattctttatgcaatttctcctttagtcaactggatttttttcctactgttaattcattttgttcaccagtggtctatttttgcctttcttatccaataaagtatgtccatctttagtttacccacagaaacattttaggaaatgaaatcgacaatattccccagttttaggaatcaggctgatctgttgctttgtcaacagattttgagagatgcttgagagaaatgtgaggttaaaattgtctctgcagacttgagctgtgcatatgcttattcttagccagacgccagttaattaaagatgattcagaaaagaagaataaacccacagcagaaagtacaacgtttttggcaaactttacagttatggaaaatataaatacttagaaatttaggagaagcaagaatatattttaaaaattagtattaaatataaatgcaaatggctgggcacagtggctcatgtctgtaatcccaggactttgggaggccgaggtgggaggatcacttgaggtcaggcgtttcagagcaacctggccaacatggcaaaaccccgtctctaccaaaaaaaaatacaaaaattagccggctgtggtggcacgtctgtgtagttccagctactcgggaggctgaggtgggagagtcacttgaacatgggaggtggaggttgcagtgagtggagatcgtgtcactctactccagcctgggtgacagagcaagactgtctcaaaaaatataaataaataaataaatgcaagcagttctgggtatttatttaaaaactcagttgttcccatgggagcaactggacattacttattaaataatcagaataaagggagggtagtaattgaaatggaaatatgaagttgcctttggatcacgtaacagaataagcctggatgtagtatcattttccccttagatcaaattgttgtatttaatgggttgaactcacttgagtttttgggggtgggggaaagctctagagcccaagtactgaaatcttgtttggacatttaaatacatcgtggttatgagaatagttgaaaatatggagctgacttgattaccagtctccaaaaataagaggctggtaatttatttccttattattgtaaaaaagaatcattaaagaacttgtgaggaaggggtagaaaggagaatgattatgatctgaacataaggctgttcatatttctgattcctgttctcattttttcattattaaaccaccaaaatctcctacagacaaatgtctgtaagtcaaaatgtttttggcacatgaattacagtttcagtttggaataagattgtttgaggcaatgagaaagatctggttgaattaatacttggagtatttggataagccaaataccaagttcatcagttaaaaataaagctgtgatttttgatgaaactggacttcaatgcatgctgtgatgttgtgatgtcaggcagagcttcccagtaagcctggggacctgcaagagatggcacggggtgagggtgtgaacgcgtgtgtgtgctaccttactcatatgtgccaatttggaaagttcagcaaattcactattagggcttactcctttcctctgctcactgccttcgcatcagcacctcgatcacaggaaatcttttccaagaaaagatcagaaatccttacgttcatttttttctctccctttctccctccattatcccttatgatatgagttacatgggtgcatcttattaaaaagggttcatggtcttataaaatgtgacatcggccgggcacagtggctcacgcctgtaatcccaacactttgggaggccaaggtgggcagatcacgaggtcaggagtttgagaccagcctgtcccaacatggtgaaaccctgtctctactaaaaatgcaaaaattatccgggcatggtggtgcgcacctgtaatcccagctactcaggaggctgaggcagtacaatcgcttgaacccgggaggcagaggttgcagtaaaccgagatcgcaccattgcactccagcctgggtgacagagcgagactccgtctcaaaaaaaaaaaaaaaaagtgacacctcattttcagtttgctgagttatttggagaagttgtactttactaaaaggactcagaatatcagagtgtagcatcctagtggaagacacagtatccttgaaattcagagaaatagggagaatgtgagtcatgatgtgatgtatattcagagaaagagtcaaataactaaacgttcaagtatttccctggcctagttttctttggttcttttacttaatgtccttagccttggccagagagaaaaactctaaatatatttattccacccttgttaaaaatttatgtgcctgattttggtcagattactctaaaatattttcttactataatccaggtatggtatatgtctgcatgatttatgaaatggtctttctatactttattcctcccatgatcctcaaaagatgagctagttggtgagcacgaaggtgagtgtctggcttgagtccagcaaactctctggcttcagccaccaccgaactggaaagagataatgtgctttgccaaaggtggcaaggatggcaagcagaggccctggtgctcctacctctcagctcagatctctctccactgcaccacactggctttcccagaagtaaaggtctcagataaccagcttgagtcatttttatagccatgtagaatggcttgcttctgatgaatttatgtaccctgttgtgcctttacaagatcatctgaagtctagaggaattcatggcgtttgtgcctctgtgctccatgaatgtccgatgggtgccatgtgacattatcagctgtgaggatagaagggtctaaggaaagaaaaaggccaagtagataaatatgaatttcctaaagctgtttccacagtcattttgttatccacttgccctctgacagaaggtgaggggactgagcagtcattggcaaggttgttaatgtcaacagatttgtctgtgtgtgtgtgtgtgtgtgtgtgtgttattttatttatttatttatttatttatttatttatttatttagagacaaagtcttgctttgtcacccaggctggagtgcagtggtgcgatcatagctcactgtagcctcagcctcctgcactcaaggaatactcccacctcagcctctcgagtagctgggaccacagacacatgccaccatacttggctaatttttgtattattattattattattttggtagagacgggttttcaccatattgtccaggctggtcttgaactcccgcgctcaagtgatctgcccatcttggcctcccaaagtgcatgggttacagacgtgatccaccatacctggctgtgtgagtgtgttttcattaaaggcccaagtggcgcctgtgctaagatagctgtcattttgctctttccatcatttgtagtttgctttagtaataatctctcattcttaaactgagttttacaaaacaagaaacaggggatgggatagggaatgtagggagagggtagagagaaggctgtgcagagataaaattgaatttctcatctcctgtagctttttgctaaagtggaacttcagcataaagcctcatatacacaggcaggaagatgagcggacaactgtctgcagggagcaggccgtttgcacagttagcttcctagctgaaaaacacatccctcacttagtgtaaaaaatgacatgtatctcctgtatatttgtctctattttatatttctaatatctaatatatctctattatctattatatttctgtctcatctaatatattctgtatatttctgtctctattactctattatagagtgaaaaacaacatgtgtctcctgtatatttctgtctctattatcaatgttatctggcactttataaaacctttgtgttttttagattctctaaatatctaaaaataaaaaaggctagtaaaagatttttgaatgatagagcagttaaagaatatgggatagtagacctggaaggattttagaaataatttagtccaacttcctcattttgcaactgagaagatggagccccagatgaaagtgacttgttcaaagtcttgcagaaagttagtggggtagtggtgtaattctctaagtgtcgttaatattctttttctgcagaggtccagataagaacaggaacagagtttgttcttcaaaggctcatctttggggcagttgtgttgttgtcaccttggatgtgcctctaatgctgagagccaaggctttgcctccagtgccaggtgctaaggtggttatggctgggttactggtggtacgaggaactggtaataaactaccaaagattgtatggaatgagaggtggtttctttaggatataatattaaaggggtctatccaggcctgcctgacattgtgtcccagagtaaggggtcaaatggaacttcccaccttgtcttcctacccttgcacctgtcccacaccatggtaggttttatatggggacctagcctgtatgcccaggtaatatctacacccttcaaggtagcctgtgctcgactactgcttgggcctagaggtatgcccactgcactgcatccacccttgggagcagtgctctgagaagaggccctggcaggatgcagcctcctggctcttcaggaaggcacttctcgttttggctgcctgaaccagctttgggtggcatgtacctttggcgccccatttacccttcccctcaaggataaggaggatcaggacagagccctctaatgtggcagagagcaaggaaggcgttcttttgcctggatctaaagcaagtattggaagtattactaagagagggtgtggatttaagtatgctctaaggctcttgagataggcctccctaagggacaggatctggagaaaccaagtaaatagttgttagttgctgttagattggggcatgggattctctaaccaaatagatgcccaatgcagctgtcttagtccattttgttactacagactgagtaatttataaagagaggagatttatttcttacacttctggaggcttggaagtccaaggttgaggggcttgcatctggcaaggaccttcttactgcatcatcccatggcaggaagcagaagggcaagagagagagagagggaaagagagagtgagagtgagagcatgtgtgctagagagagcgctggagagagagagacagagagagaaagagagagacagagaaggggaggggaccaaactcacccttttgtcaggaacccactcccccagtaatgatatcaattcattcatgagggcagattcctggtaacctaatcatttcttaaaggtcccgcctctcgacacagttgccttgggaattaagtttccgacacgtgaattctggaggacacattgacattatagcaatagctataggtttttgagaaagatgagcaagatgctctaagcacaatcactctgaatttttggagccatcttctgatcttggcagcatgttggcagtgagaactcatctggcacttgctagaggcaggctcccagatgagaccactggtgccctttgcccaggcctacacctcacttccagacttctagctcttgccattctaagaggcaggaatgagtgaccctccacattgtcttccttcccatgccagcctgtattagtttgctgccataataaagtagcaccacagccacctggcttaaatacagaaattcatcatgtccagaagtccaagaatcagccgggcgcagtggctcatgcctgtaatcccagcactctggaaggctgaggtgggtggatcacttgaggtcaggagtttgagaccagtctggataatatggtgaaaccccatttctactaaaaataccaaaaaaattagctgggtgtgctggcgcaggcctgtaattgagctacttgggaggctgaggcaggagaatcgcttgaacccagaaggtggaggttgcagtgagctgagatcacaccactgcactccagcctgggtgacagagtgagactccatctcagaaaaaacaaaaaaagtccaagaatcaaggtgtcagcagggttgcttccttctggggactgttagggaaggatctgtatctctccttggcttgtagatgatcattttctccctgtgtctttttatatcatcttccctctatgcatgtccccgaatccacatttccccttttataaggacaccagtcatgtcggagtatggttgatcttaactcaaagtacatttgcaacgaccctatttccaactgcagtcacattctgaggtatggaggtcaggacatcaacatacgaattttgtggagaacacaattcaacacgtaatatagcccatgaaaggaaaccctctaacagagataaaccagagagtaagacttctgagagatgcaatttaaaaagaagagaggacatctcatgagttgactccaagtttttaacctctttctctgtcatgcaaagcttcaccccagccatacagtcaagagcagctgcagcctttaatccctgatcctgagggggcagtggtgggaaatggggataaagatggagccgctccccatcctgtggtttgagtgtgcctctagcagaggtgaggatgcttccaccccaccccaccccaccccacttatttcttagaagacaagaatgtgagtattgttcattaatcaaatactgattaggtacacactgtgtaccaaacacttcaagtacttctccaaaaatccttgcccacatgaaattctttttctagtagtaaaaggcagaaataaataacaaacataataaattagtaagttacatgtaggttagtagaaaatgaacatgacctggggattggggtggaagacgagtggatgtgaaatttacagctgtcaatggagtagtcaggccagcctcactgagagggtcagaggtgagcaaagacttgcaggtgggagggggttggcccattatgtgtgctggggcagaaggtcaaggcagtggaccctgcaccagccacagcagatttgaggaactgtcaggaggcctctgtggccagggtggagtaagcaaagaagggagctgtaggagaggaggtaagagacgagatgagagatgggccatataggcccttgcagacttggctcgactcaggtgtgatggagtgagtagtggcattttatttgacatgcttgtgaaggctcaccctggctacatctcaagaacagactgtagaggagtgagggtgaacgcagaagaactgttcagagacgattgcagcatttcagaggagaggtgcccgtggcttggagcagagtggtagaagtagagacagttctttggtcagatcagttatctttagaatagtttctcactcccaagtcattgaaccaaaattgcctggctgtctcctcctgtataaatgtctcattctggcccttgaccaagtcttggcttgtattatctagattagtgactgttattgacttaaattccatttgcccttctaattacggctgaaaagcaatctgtcccccaagattgaatttttattactcatatttttgacatcagtggttgcattctgtttgtgatattgcaagagtattgaagggagccctttttcatttctaatgaatcatttttaaataataattttaaaatcataatccgtaatcatttttaaaaatgatttttaaaaatccataataatcatttttaaaaatcaaagacattctcacataacattttcttagagccaccattcataatacttagctcctaaactatagacaagaatggtaatgttctacacacatttattgtagcagcccacagtctcccagttgggcagattgaaaagaaaccgtcagtctgaagaaaacaaaagagtgccgtgttttctgttggacctgctgctgctgctacatggagtagcaactctttttacctggatcgtgaagcaccagtgtgcggtgccctaataatacctataactcatcataccacaagaaatggaaaattccacatgcatgagtctgctagggctgtcgtaataaactaccatggacagggtggcttagacaacagaaatttattttctcacaattctgaaggctgaatgtctaagatcaaggtgtcagcagggttggtttcttctgaggctcctctccttggcttgcagacagctgtcttctcttttgtcttcagatgatcttccctccacatgtgtctgtctccgcatctcttcttttcttttcttttcttttttttttcaagatacagtctccctctgtcgcccaggctggagtgcagtggcatgatatcggctcactgcaagctctgcctcccgggttcacgccattctcctgcctcagcctcccaagtagctgggactacaggcgcctgccaccacgctcggctaattttttgtatttttagtagagacggggtttcaccgtgttagccaggatggtctccatctcctgaccttgtgatctgcccacctcggcctcccaaagtgctgggattacaggcgtgagccaccgcgcctggccttccacatctctccttataatgataccagtcatattggattggggttcaccctaatgactttattttaaatttattacctattgaaaagccctatctccaaacatcgtcacattcttaggtactggggattcggactccaacctgtgaattttgggggacacaactcaaccggtgacaggcacctttgcatttaattttcttttgccacagccaccccccaggctcatctgctgctgatgtgcgttctgtgcagcacattcatgtcagtagtctcaatttttgtaaggtttcatttgttgagggtgaaatttggtcatatgattggaacaccagtttgtgagtaaagaataatgtgtatttacaaatcatgatattgattatattgtacattgaacaaaattctgaaatagaattccaaaaatttgtctggatgacagttcattttaaataggtacacagcttctgggagcggtagttagtattgttcaatagttaggagagcagatagttagactgcctgggttactgtttaatctcccataattaccagctggttacccctgggaaagttacttaaacctctcttagtctctttgatgaaattttcttgtcttacaatgtagataattagagtttctacttcatagagttataataagaatttaaaatgctcatctacatagagaatttgggagagtgtctggtacatagtaagtgttcaataaatgttggattctattatttccagggcagccactttgaatgaagatactcatttgggtaaattaggtctggtgtgtttctgaaaatgtgttcgctaatttgtttggacaaattgtgtgtttctagggtaaggcataatttcatctgagaggataattcttgtttgttatgaataatatgcaagttttttaaaaagtggggattggtttcactcattaaagtacacggaactcctgcttgtcagcattgaactggtcttattttctggtttttggtttgtagtcctgctcctggaattacggtttggggaccacagtgtgatggcagcagcaacatgtgtgtatgtttgggggactaatgtgacatctttgtaccctaggccagacaccccacttcaataaaagcagattccctgttatctttattatgttttatagtgctgtgtaaactttggtttgagagaattcttctactataaatagcctgaaacccactagcatagtatatagattcctcatatcgtctgctcccccaacaattgcttttattctgtatataccccagggatacaactaatgttaatagtagcctgagcaaaacgtaattgggaaggcaaatctgttgcaaaaaggaatatagcataaattaattataaatcaaattaaatataaaacaatgcatttaattatctgcatcactgcccccttcctctaacatggatatctgagaggagactgattttctttctgggatagggccagatctcagcccagacaagtgaactgtgtcaacccctggaaagatggtgcttgacctccttttttgtgatatgttgggcattagctaaaggcactgctgttttggtcagctaaaatttcagtatcagtaagaggatctactacctatctgaattgttaatgcatgggctagtctttgtgtgtgattgggaacacctacttataatatactattaaatgctcatataggttcaatgatgtgttgaaccatttattaaaaatgtatttgttgaatggactctaacgagcccagcaagggaaagtgcatttctgcccaaggaaggttttcagtttgggcagcaggcattagccacccaaagctggtgctgctgttagaatcagaggaagaaccagtacgggtccatgttggatgccctctgtccttctcaccaccctaagtggtttcatctgccccaatctccatgtctgtgtgacactctgacttatgttctctcaaaagatccaatccctggccagccagagtctagcattctccaggcaggattccaaacattgttttccactgttcccactgagtacacgaatttttgtcagatggcagctcctgaattctgaagagtctggtgtcacatgccccacctctgtcaaacctcacttcttccatttgggctgatctcagctggactggaaaaccctcctctgttgaaagtaggtctaaagtggtaatgactgattagtacggacctgcaccagttcccaggtatttacaattgaaacgagtttgcttatactcagaagtgacaaattggtggatgtgataacatcaaaatatagttcttacagttgaagaacaaacaaacaaaaatcagcaaattggcagcttagctccaatacttggcaacctctggtatgagatttcctgacaccctgcacactttcccttcccctcccaacacataccccagaaaccttgacctttccttttgcaggtcatcatttaatcaagtaatcactcctcttctagcatctgttacattttctggcatttctagcagcagtaagtggttgagggcaggaaccatgtcttcatgctctaagttcctagcttgctgggtgcccagtagatagatatttgaagaatgagtgagttcatgaatgcatgaaagagtggaaaactctagaatggatgttctcactgctgtgagcatccacgtaatccagtcctgttcttccctcccctttctgacctctatcactctgcggggcccatggaccccatgacgggcttacactgctgaagaggcctgtctggttttgtcacattcagactttcttcctccaaatcatctctcatagtgccgcccagttatttttctaaaaaacaaaaacacttctttcatattgctctcttgctagaaaacggaatgatttctcattgcttgagggataaaactcaaaactccttagtctggcatttaatactgactagagcttgcccttgatatttctttaaaaatattttaattgtaaatatttcaaacatatttaaaaatacaacactcatttatccactactaggattaaacaaatagtagaatttaccccatatttactttgattttctttccctgactaaataaatttattttattttattttttggagatggagtcagggtttcaccatgttggccacgctgctcgcgaactcctgacttcaggtgatccaccccccaaggcctcccaaagtgctggaattacaggcgtgagccaccacgcccggcccctaactaactaaataagcaaacattatagatacagataggccccaccccatccttctctctcttttcctaccagaaatagtcatttccctgtttatctttcacaactcacctgtgagaaccatttagtccagttagatttatcttcttgctagaatttcattctcttttttttttccctttgaggcccagttcacttttcacctcttctggtaagctttcccaccaatctcctagttctaaattgctgcacaagttattttctccattgctcaaggcagacaatattctgcctggtgacagcttttatgtagcagttttctcctagtattgattttctattccccttatagtaattttttcctcttgctttatattatagcgaattgcatgcctgtgtttcttctctactaggtaacaaccttcagaataagatctgactcttaattgcattgattcattcattctacaggtattgactgagggcttactaacaagctccaggaattctttaagcactggggatgcaggagtggacacaacagacagtcgctgccttcatggaacttaagttccagtgggagagagagaaattacatgaataaataaatatgtcaagatgaaaagtgctacggagaaaagagaagcaggagaaggctaagggggtgctatctcagacatactttaaatatgtgtctctcctttatgctctatgtcaatgccgaatgcagagggctctgggtacatatttgctgaattgcattgtctacccaaatagatactatttgattccctgctggtgagacactactcagtgtagaccttccttctgggaaggttgttataggaatgcagattttaatcctttgctgccaggagcacaccttggctgttcttcccgttatcagtagatgtacactctgggcatgataaaattgtaatactagctttagtaaggcataataagggaggaaaggtctgtttcctagcaccatatttattccgtagtcaaatggagccaatttggcatcatctttcctcctgcacttcttcgtccatcagaccagtggaaggttcactttttgcagtgttcctaactgtagtggtattgaattgtggttaccaagaagaccaatctcctctttttaattcttccagcctccaggaaagaataaaatccctcaacttgtcacttaaagaaatcactactaaggtaagtacctttatattcccattttccaaagaagcctatgaagttttcgtttgacttgattttacatctagatcttaggatacctggcttctgcaaaaaaagatgtagactttgtcaagccattttgcaggcccaatgatgagttaaaagagccaggagagagtgcttctgtcatagtggaggtcttgacttgtggacaccccagaaatggactggtttggcctttgctacaaaaggagctgtcaatttagggactgaaaaaggactgccactatgcatattgaaagcctttgcttaaagatgcattcggggcttggtgcggtggctcacgcctgtaatcccagcactttgggaggccgaggtgggtggatcacctgaggtcagaagtttgagaccagcctgaccaacattgtgaaaccccgtctctcctgaaaatacaaaaattagctgggtgtggtggagggtgcctgtaatcccagctactcaggaggctgaggtaggagaattgctttaacccaggtggttgaggttgcagtgagccgagattgcaccattgcattccagcctgggagacagagcgagactctatctcaaagaaaaaaaaaatgctttcaggatggtagtaatttgagaaattaattacttttcttcccaggagggcaatgtctggtttcctcacaaatagaacagttggtgactgtttttttgttctttaaagcttttcagttggcttgacaatcattttgcctactttatccatcgtttatactgccatagcaagaccttggtttgtgtacagacagaatacgtcttcactattccctgagagcacagtcaattaaatagtcaatgtcctcattagttaggataaccacagtttacaaaacaaaagcccttctcatatgtatttatacctggccaagttattgacagactgagaaacaggatcaattactctgtgaattatgactaaatgttgtggcagagaactgggtatgaatcattcattatttgcagttggtctgggaacgaggggtggttgtaccatggtcgaaatgtaaaaaggacagcttgctgagcagagagcaacgcagctgagagcctgttggcctggaaggactctcttccggtctctgtgcccagagaaagaaagtcttggaccctagatcaggaaacacgccaagggatcaccgcagctaagccagaatcagggatgtgatgttggcaaaaatgtctggagttactctgtgcattttctccatttctgtatctaatttatttctgaaaacaacacccagtgattttgctaaaggtcacagagccgcaggtttgatgggtaattataacttgtgtacaaagagagcttcctgttaggaacaagtggtgcccgtaagacagcatcggagccagggacccagaaatgcttgacttctgctctgctcacccaaaggttctttcacccaggctggagtgtaatggcatgatcatagctcactcagccttgatctcccgggctcaggtaatcctcctgcctcagcctcccaagtagctgggactacagacacatgctaccttgcccagctaaatttgtttgattttcagtagagaccaggtcttgctaggttgcccaggctggtcttgaacttctgagctcaagcgatcctcctgcctcagtgtgtcaaaattgggattgcaggcaagagccaccgcacctggcctctcttacattttctgctgtttatcaggtgcgtcctgatttctatgtagaattaaaagatgggaggactgtcttgggtctgagtttattgactatcttcagaacatactgtatgggtaatatgaatgcatctgtacaccaacgttgaggatacaggtgtgcctattatataatgcagatggtgcttatatgggtgtgtgtatgacactgtatattgtggatacacacatatactgatacgcacccaatattaggatttgctgaaaatttccaactactattaaagatcttagattttcccaaatatcaaaaatgggttgttttgtttgcatacagtcctactccatttgagttgctataacaaagtactgtagacgaggtggcttataaacaacagaaatttaattcccatcactttgaagcctggaagtctgggattagggttccagcatggctaagttctggtgagaggccctcttacaggctgcagacggttgacttcttgttgtattcctgcatggaagaaagagggcaaggcggggtctctggggcttctttataagggtactaatccccttcatgggggccccaccttcatgacctgatcacctcccaaaggccccacctcctaatgccatcaccttgggagttagactttcaacctatgaattctggggggaaaaaaacatctccaaccattgcacataccttctctaatacatttataaaactttataattacttcgcttttccataaaattaaggaactcacatctttgattttaaaatgtaaacataaaagccccatttgataatgagttccttggtgtccaattttatttgtaaataaaaaggatacacaggttttccggggatgtgtatgtgtgtgtgcagaggtggataggtgtgtgtgcacagacacgaatgtgtgtgtgtgttgtgggcaggggcctatattagtccacagagaattaaaacaaaactgtccagtcacacaaaacagctttctctgtactttaaactagattgaccagtgaccatgagctgagaccaaggtctcagcttgacatagctttctttctctagtgtgttagacacaccacacacacacacacacacacatacacacacacccctacctgatattctttagactcctgtctcagaaagaaatgaaaccttccttgcactcattacatttcttaaactcttatgggttacccaaaccaaaagtaattaagggataaatgagatggaagaaacagttggaaataaatgggatatctggagattggtagatattagattacatccagcagagcctgaaagaatgaacattgcaatttaataagaagattcagaaaggttgtttagtattaatattgacagcttgaaagatagatttgctcaacaaaggagaaactgactcaattatgattaacagatactgttcactaaaatcagaaatattggacatagactggatgagacataagaattatggctggtattacagagttaatggaaatgccctcagacctcagatgacattattaaatagataggatgggatgtgccagtcatctggtttgagccaaactaagacttggtgctgggggaagggatatcttccttttaactctgaaaagtctcaagactgttgaaagggtctcggaattaattactttggacatgcggatgcccaacatcaccagtgcatgctttggtttagaggctaccaaactgtcgtcttcatccagagaatgatttttataaaaaagatgttggaaaattacagccactgaatagaacatatggaagtccatgagagaaagagtggagtattttaggcaggatggatgaggtctgctttgactccaaaaataatctcaattcaaactgatataagaaaacatttaaagttgatggtgtcccacaaaccctagattcttctgggaaattaaatttttctaggtagctcattaatctgagtctagataacattggcatatgaaaagtcttgagactgttgaaagggttcaaaaaaggaaaaaaatgtgatgttttagcctccaacaaaataaaagataacctaaagacatttggaaaaagaaattaagatttaagatttttgctatttttgaaaaaccaaagaaaaaaactgtaggatgtgtttggaatgtcatgggaaaatacatgataaaactctcaaacctcactgagagttacttgtctatttttcaaatctgacttgccagcaagtatctatctgccttcaaagtttccctaaacagtgtctattaatactagtaattaaatttagcttgcagctttgaccttcatctcaatggccatatctttattcactgcgtactatgtgccaggcacagagcaaagtccctgctcacatagagctcgtatcccggcagagagacaatgtggaaacaaaggaatagaattacatggtgtatcatctgagaggaagctgtggaagaacatcaagcggagggagggccaagggaggttgctattttgtgtgggtaatcagtaaggcctttcctcccaggcagcgactgagcagtctggaagggtatgagtgagccaaaccacctgggactacaaaagtgatgcagacaggaggattcggcagaggcctggagaaggcaggaggcaggagtgatgcaattatgttaccttgtggttgctctctgttagctcctatcagttttgtaattggatgtggggtgatgatgggcatatgcttggaatatgccattgctcactttatttttgttcttcttcctacatttccctccctctttcccttctctttccttcccttcctttcccttcccttcccttccccttccctccttcccttcctcccttcctcccttcttcccttcctccctttctccctctcttctttgtctttctttttccattgcttgctttttgaacattgtcttccaattacttttcatcaccccttttaattacttacaaacccagaaatctctgacctggctgttccactgccttctgatttttagctgaataaatgatgattcctggtcatttctctccccctaggtgtgtatgagtgagaaattctgcagcaccctgaggaagaaagttaacgatattgaaacccaactaccagccttgcttgaagccaaaatgcatgccatatcaggtaactggcagtgtaggagacgttgaagctatccaactaaaataatgacagctaccagcacatcgtgttttgtcctcgatgaacattccactgttattatgtcattctcagacatctgaaagcttttctgggaagtttcactaatatgcacataatatagcacaaggtgtttaagtgagtaccgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttcccttcctccctttctccctctcttctttgtctttcttcttccattgcttgctttttgaacattgtcttccaattacttttcatcaccccttttaattacttacaaacccagaaatctctgacctggctgttccactgccttctgatttttagctgaataaatgatgattcctggtcatttctctccccctaggtgtgtatgagtgagaaattctgcagcaccctgaggaagaaagttaacgatattgaaacccaactaccagccttgcttgaagccaaaatgcatgccatatcaggtaactggcagtgtaggagacgttgaagctatccaactaaaataatgacagctaccagcgcatcgtgttttgtcctcgatgaacattccactgttattatgtcattctcagacatctgaaagcttttctgggaagtttcactaatatgcacataatatagcacaaggtgtttaagtgagtaccgtatttgggacttctagttcctgtttcttgaagagtttagagactaaatgtactctgtgtgccatatgattctagcagatgtgtatgtagcattgtgtatctgtaaatactgaatgaggattattgggtgtgatcagaccctttctatagagggaaggatggtaacatgagacaaattaatgtcctcagtttgaaaatctagtcatagaaacttggcgaatcctcaaaggattatgctccctcttactctggcagttattaaggaattgatttttccattaattagtagcttgaagtcaagagtctctgaaaacagtatcttatcctatcattagtgctttcaaacactcctctggatttgttattttattttcacaattgctatattaggtagatgggagagagaccgtgatccgaatggactgatggggaggttgaggctgcgggatgtgtcctttggttaaggtcactcaattagctaagcagtggcagatctggggctaaagtccaggccctctctcggtgtattatatatggatttttaacccagttatgtaatgacagcttcaaaaagttctctgagttttataggttgaatggacccagagctcatcagcttcaaaagaatcataaaaatttaacaaaaagttataataattacatgtatgtgttttaaatggtattttaagaaggaatacaataattggcagcttctgctcctcagatcattaaacaactaatgttggcagctaaagagcaatttggtccctggtgcagtcacgcgtattatttacaaccagtagaacatggcagcgcaaatgtggggcttggctcttaacagcttcacatgccatttacttgaaattatgggcccatttgctgagagaaaaaaaaagaagattgaacacagtcttgcttctgagttagggtttttgcctttcttaatcaatatatctttcccaggaataccggtggatgagtctgtattaagcccaagggaagaaatgtataattcaggcagcagagatagcctcactccaatgtgaacaatctctcttcagactccagggaaaatgcccaagatggtatattgcgtatggcgcaggtttcctgttttagctctttggtcagctgagaaaattggtgaggcctgatctgctgaaggatgacctgaattaaccctcctggtaactgaccttttgacctcactattttctggttgctctgtatgctctttggtggaccggcctttcagtcaatgggctgtccccatgggtgatactagtgttaaggtggtcaacatttgtttgcaactcctgcatataatgctatttctgtttcctcctgtttcaataccttcagaatgggcaaaccctcactccattaggtaagattcttaaaagccctattgaatggaaaggatcttggtttttttttttttttgagtcagagtctcgttcagtcgcccaggctagagtgcaatggcgcgatctcggctcactgcaagctctgcctcccgggttcataccattttcctgcctcagcctcccaagtagctgggactacaggcacccgccaccacgcccggctaattttttgtatttttagtagagacggggtttcactgtgttagccaggatggtctcaatctcctgaccttgtgatctgccctgaatggagaggatcttaagggaggtccttaagattcttagggggtcttttgtctctcttcaagtttctatgattcgcttagatttatagactgattgatatggtttggctctgtgtccctacccaaatctcatctcaaattgtaatccccacattcaagggagggacctggtgggaggtgtttggatcatgagggcggtttcccccatgctgttttcgtgatagtgagtgagttatcatgagatctgatggtttaacaagtgtttggtagttcttcctgcattcattcttcttgccaccttgtgaagaaggtgccttgctttccccttgccttccgccatgattgtaagtttcttgaggccttcctagccatggggaactgtgagtcaactaaatctgttttctttaaaaattacccagtctcaggtggtatctttatagtagtgtgagaaaggactaatacatccatcctgactttgatctatggcctgaggtcctttcttaatttgagaactatttgccatttgcagagagtaggaataacaaattagtttcattttcaaacctggccagatctagctcctttacatgtaacagtttattctttaattcatctctcttctcttgcatttcatcacaggcattgacaggaggtcagtgggcacttctgtattctgcctggaaatctccttggatgtctaactacaattattagggactcttttttatattgcctcagttggtaactgagtgacttttttgccactacaaggatctttttttttctagtttctgatatatttttcttacttttttctatccttcacggaggcccatgaggcttctgcctactaccaagtcccaaaaccaatgcctcgattttaggattttgttacaatagtatcccatatccagataccaaaatctattttcattatctactgctgcctaataaaaaataagtcactttaagacgtagtgacttaaaatattaccagttatttattttgcccatggaaatacaatttgggcagggcttggcagggacagctagggtggctcaactggggtgggagaatccacacccaagacggtgcatacatatggtctggctgttgagtgctctctatgtgggcctctctataggcagcttggcttccttacagcatggctgctgggttccaagagcaagtgtcccaagagaaaggaaatggaaatttcttattcttaaggtctgaattcagacactggtatgcatctctattaatgtgtaataagtggctcctcaaacttcatagcttgaaacaacaaacctttatctctcacagtctctgagagacaggagtccagagtgacttagctgggtggctctgactcagggtctcataaggtcgctgttaagacacactttggagctgcagtcgtctaaaggcttggctggggctgaaagatctgcttccaaactcatgcatgtgttgttaacagacggcttcagttccttgccacaagagctgtgccctaggacctcttgcaacatagcagctgatttcctcagagccagtgatctgagggagagagaccaaataagacagaagccacagatgccaggcgcggtggctcacacctataatcccagcactttgggaggccgaggtgggtggatcacgaggtcaggagatcaagaccatcctggctaacatggtgaaaccccgtctctactaaaaatacaaaaaattagctaggcgtcatggcgggcgcctgtagtcccatctactcgggaggcggaggcaggagaatggcatgaaccgggaggcggagcttgcggtgagccgatatcgcgccactacactccagcctgggtgacagagcaagactccgtctcaaaaaaaaaaaaaaaaaaaaaaaaaagccacagtgtcttgttaggacttagccttcaaagtcacacagcatcacttctgcttagtgactagaagcaagtcactaagttcagttcagcccacaggcaaggggaaggaaacaggttttaccccaaaggaggagtattaaagaatttggtgggcatatttttataaccactgcagtgttacttccattgtgttttattggtccagcattcctggtgtgctgattcaagggaagggccactataacaagtctcaatgagaggtgtgtcaaagagtttcagtgccatgctctaaaaagtgccacagtatttattgagacagaaggattttgagaactgaagacctggacagagagcttttcagtcagaggaaatggcctgttccatttatttactgaaaagaaaaatatcatggagcatctaggaagtgtcagatctggttctaggtactgaggatgcagtagagaacaggacaagatcccccttcctttttttttttttttgaggcaaggtgttgctctgttacccaggctggagtgcagaggtaagatcatagttgactgcagccttgaattcctaggctcaagccatccttagccttagcctctggagtcacgggattataggcatgagctcctggctcaatgtctcttcttttttgatagctgtgttctcccattggccacagtggaatggagctagatatgcctgggctgaatatggaggaaaagctcagctatttcttcaggaggaagagtagtctagattggcccaggtataggattagtattgtggtagctcttcagagttggttaggaccaggatacacagagctctgaattgtaggctaaggataagagcattttagggagccattaccatgttttagcggagtagtgacatgattaaaaccagactttaggaagcgtaatccggccatgttgtacacagagggatggatgtggcaacaccttgggagtcatggaattaactaggatgttagaaatgaaaaaaggaagaaaagtaggctagtataggaaatctactacagataggtaattattgatttttggaagaaccatgatgatattaatatatccagttgagtgtggtgtaatacacattaagaaaagtaatttagagagcccattgtttctctcccttttcactgtacacaccttaagtgtgttttagtcacctctttttttccattctctatttctgtttcaattttcctgttcagcagaggatagtttggtttaaagccgatagcaaaagtggattctgttgttgctgtccttcctagacatatcagtccgttctcacactgctgtaaagaaatacctgaggctgggtaatttataaagaaaggaggtttaattggcttatgattctgcaaattgtacaggaagcatggcagcatctgcttggcttctggagaggcctcaggaaacttacaatcatggcggaaggtgaaggggaaaccagcacttcacacggccagagcaggaggaggggggtgggggaggtgccacgcacttttaagtagccggaccttgtgataactcactatggcaacagcatcaccaagagggatggtgctaaatcattaatgagaaactgcccctatgatccaatcaccttccactggtgctaaatcattaatgagaaactgcccctatgatccaatcaccttccactggtgctaaatcattaatgagaaactgcccctatgatccaatcaccttccaccgggccccacctccagcactgaggattacattgcaacatgagacttggatggggacacagatccaaaccatatcactagtgaaggaaagtacagccctgagctctatgcatactgacgtagaggaagaaactcaccagggcagagagatttctcagtttttgagtgcaggggccatacagttagtagagagaaacttgggctttggaatctgagaagtgtgtgttcaagtgcagctttatcatgacttggctggatgatcttgggcaagttgtttaaccttttcaggtcttgtttcttcatctgtaaaatggagctaataataatattgcccatcacattaggttgttgtaagaattaagtgaggtagtaaattagaataatgtggtacatcagtatattaatacatgagataataaatatatgaacgtgacgtggctttccacagagtgaatacatgcttagctagtgattgttagccatgcatctgagttgggggagacccagccagtgggtgactctctgatcaggtgtcactcagtgctacaggttcccggccagtgtacctgtagtaaaagggcagcggtggcatccatacctcttaatccaaggcagctttggcctcagtgcctgtgcagtctcctgactggccaactaggctgggccacttgtcaatggggtggattcgtttttttgtttggttttcagctccgagttcaaaagcctgggagacctgctggcttctctcccagagctgggccacatattgttaacctgggccctggaggtctgatcagtgtcctggctggatccagtgcagtaagagaagccaaggagaagacagtcttccaaggcctgaagcaggtctgacctaactgcccaatgtaggaggtttgccctgggacaaactaaggtcctgcagggttcgagggtgaaaggcctcttctcccaggaggcagccccagacccaccttgctgaactggctgcctggaaaggaagtgagagcgaagatctcaaaaaagagcagctctttaacctctgtgctgctctcactgaacgctcccgccctctgcccaggacttgatggctttggccctggccctggggcagagcgaagggaaagcgtcagtgccctctagggccgagagtgtggcactacagcaagtgtgtggtgggtgcggctgacttgtgctctgtggctactacccatccccatcagaaacctgggcctgtttccttctctggaatggtgctgggactttccaaaccacggacctgtagtgatgagagttggtgtcttgagtccgcgtccaccgtctgcatgccatgcctgccttcccactgctgggggccctcaaccctcctccagttcccgtgtctaagacttagcaacaagcatccttcctgtgtgttggactgcgggtctgcaccattgtgagacacggtcctatattgggccctacctctatcggtgctcgttgacctgactggtatcacagtcctcatctggaacggggccagccaagctctggccactcccttgtcctgggacgaaggctcagcccctgaggcccggcgagtagtcaaggctggctctctgatgcctggctgctctgatgctggcatcctgcatgcacttccagctccagccttgtcctgctcaaattacccctcattattgatctggtccatctgttgagtcaccctccaatttttttcttccactttgtttaatgcctggcactcaaaagacagccagtagaagtatttgtttttcaaaaaatggaccctcattcattggttgctgatccctagaatctgttgttttcatacctccttcacttgttaagattttcatctcctgccctgacttcagtgggtacgtctggttttaagccccggtcctccttctcataggatccatcctctgtcaggtgattggagctggctgatgttccagcttctggatgctggaagccagcagcagcagctgcctgggtgacagcctcactgtgtgttggcaggcttctcactcaccttttttaatcaattggacctgaaaatcttgaagctaaacaaacacagccctgctattttggcacaagatgaaggccagttttaagtggtctataaaagctgtgaaaaaaacttttaaaagagaattatatccagggcacccaagctgcttccagatgccagaggcagccctgcatttaataatatgcttgctggaatccctttaaaatggtagatgttggccatctttttcttttttctttgcattcccaatggaaggacttccaatgtatggccctggtattattccctgtatgttttagagaagctctaaattcctgtagccgtcaaacttgggtttttcactcagactgcatgttaggatcatctggggaaatttaaaaatactggtacccaggcagcaccaaattccttcggtcagaatctctagggatttttcctgaatataggaaccttcataaacagtttccaggtggttttaatgtcctgtgagggctggaaccaccgtaccagtgagaggagagctggcctgccctgctcactgctggcagatggactcttgagtcacatctttgcacacccagaagctccaggcccaccgtgtaccatggctaagtagctgcaactgcaacctggccttggcctggaagcacatcttgtaggatcactgatgttactctcccctggccttccccttgtcctggaagatgtgcctaaggctgagagacttcattgtttaattcatctagctgtctgttctgagagcccccagctaaactgaggttccagtcccagaacagctagcaaaccgccctaaggggaaatgaaggggagatggacatggtatttactgcgtgcctttcataggatgctgcttttacctggtagatggcccaatgcctagttgtctgacctgtgaccaggggctcctcgcctgggaaacttgtttatatgtctttgtggctcttgcctttcctgtgttcagtttatgcccccctgcccattgctctggcgctgggagccaaaccttgtgctctcttgggcatcccaggtaaaacctggcctggggcatcccctggtcttcagatggaaggtgcaaaggcaatatacaccacagtaggaaacaaattcaaaaagtgtaatttacggatcctgggcagggagggcacagagagtcgggagggcagtcctttgtccctgggccactccagataggaatgaagcatcatgcagagagagagaaacaaggcacatggcaactggcagtgtgtatagggagtagggtctgggccactgtaagttttcaggcaaatgtgtgaatggcctgtttaaaggaagcaatggggaagcagggagcccagtctgctagtcaggggagatgtctctaagtttttatctctcgccactggcttgagccattgggtgtggtttccttctaatgcctgggcagctgtgtcattcccgttacagtcaccacatgattctaattgccttagaatttataggaaccagttggcagcccaacaagtgggctcctctggccagtgagggagcctggtgagggaatcttcccaggacaggcagagacatctgcctggttcttagattggccatctttggtctcacctcagtttggatatattttttttttatctcacctgcccccttgttatctgcttccaagaagcaaacagctcaaataattatttattttaaaataacataagaggatgtctctgatactccaaaagccttttttttttgaaaaaaaaaaaaaaaggatggttctatccaatttggcatttcatttatagagaataaaaactatctatacccaaaatgtattcattgcacacaattgtatttgaatggcagctggaaatcttctctcctaactgatgcttttggggaaaataagaacatttggacaataaactagattttctagataaacacaaaatgggtgaatttcacacatccaataatgaaagtagttttttccttaaattagaaacaaggatttaaatttccgtcttcttctgaatgaatatttggcacccaaccaagaaatatatatcattttaaattttcttgaggaaatatccttttcttgcataattaatttaaaggaaattaaattgaccatgtcaattgtcaaacaaggaaaagtaagaattttgcttatttgttattaattttatttacaatagtatttaaaggtaactttgtaaaataacccctaatgatataatctaaaataaaatagattgtatttaaatcacttttttattatataccacgaaaaactactgaatgattaaaacattcttaagtgggttcttaacattgtatggaactggaaagagcagttcagatcacagaggcatgggcactgtgttctaagtggtcactgcactgattcagaacagcaggggctggctctgtactgggtgggtgggtgctcaaggccagacctacacagtgctcctgtgtctgcagctgcagggaagcaggagaaacagtgacgatggtccaggagaggccacctgacatatggcagaaaaacaaaattcagggtacagacagtggctgggagcatcaactcaatcgctttctttctttactattttccctctttctaaaaaagtctgtgatttagatcagtggctgcaggagggagacaagagacccagtaaagatgttttcaaagatgatgcctatctggtgtgaaaagaaatgaagacctacccaaagagaataagcacaagctattatgcagagcttgctacagcaagggagtcagacaccatcatttgcaatttggcagagactcaaaggtgggcagacgagtgggagagctttatagtggaaaaaggcgaaggcttcaggtgtgccctgattggaggttatcaatgcggggaagctggaggcggctcactagaagcgaacatcctgtgtgcttggtcaggggaccatatttggctttctctggtgggtcctaagttggaatcggggacaaaaattagggaagccatcagttattaatccagtcctgaacattttgagtcaattgttacagaagttattatttagcttcctggatagttactagagagcaatttggcttccagcaggtctgatttagagcaggccagcttccggggttgctttttgtgggtaagggtattgttttctgggaaagttgctgcaccttgtggatcagagttccatcttttgctatggcctggctgttgtccgattgtatatttagtcagtcaccaggcaccacattttctcaagctgttggaaagttctgtgtgtccagtgttatcttccccttgtattctatgaaatatatggctgtctgaaatgtttgatgtgcaaagccagccatggggctctgctcacagcaaatgcttttggctatctcaggaagtcatggtgactggaagaaatgcacaaccctgacagaaaatggcaaattctagctgaagggacctccagggagaagggggttggggaggggagcagttggctggggcttcttggccgcctccattgccctttggttcagccagcccaggctcacagcagatatccttgacctcgccaagggaaggctctgaaagacaaaggtagatcttgatcttgcttaactgtgcacttgagcttgcagttccttgaaagatctggtgtcacgcaagacaaattatacagcagtctactatttctggagtttgatcattctcagcactggctttatttctttttttccactaaagaagtatagttcaaatgtggataggtgaaagtagataatcttaggaggatcgttacaaactgaaatgtccatgagttcaggaaagtgccatgtgtgtgaggggtaccccaggtgagaggcctgaggattgggcaggtgaaagggaccatgtgggcacaggattcatccccctcaccatgtgctttctcactttagtgatgatttctacccaggtgttgactaagtcacttattgacatgagatcagaagaaacaagttcaagttcagcaatctcgcatgggatcttagaactctgaaactctgtgaccttcacaaggttacctctgggtctagattttttaactggaaatcaaggacaatcattaagagactccccttcctggattgttgggaagattaaatgatacaatccaagtaatgagagcattgtagtctctaaaattggattctcaaataatgacctcaggtgaaggaagaactgttcaaaatgccccaggtgctatgaagtacagagggcaggtattttttttaagggatggggtcttgctctgttgctcaggctacagtgcagtggtatgatcatgactcactgccacctcaagctcctgggctcaagtgatcttctcacctcagcctcccaagtagctaggactaaaggtgcataccaccatgcctggctaattttttaatttttttgtagagatgggggtcttgctatgttgcccaggctggtctccaactcctcaagcaaccttcccatcttggcttgccaaagtgctgggcttacaggtatgagccaccacacctggctgatatttgaattcagagatgctgaggataagtaatgttggaacagagtgggtaaagtcagcttcagcataaattgtgtttatttaatttaaacacaatttaaattttgtgttttggctatctcaggaagtcatggtgactggaagaaatgcacaaccctgacagaaaatggcaaattctagctgaattttaaattgtgttatttgcggaataaaatatgtggacaagtgctttaaaaaacctatgagaatacccaggtttcattcccttgttgaagagcaggcgggcacaggcatattgggatgccataggtggcatattcttctccacacacatcctccttggcatttagaaagggcctgtgaaagttatgaagattcaggtcacagatctctgatgggactttcttcaggtatcagcattgactttccaaattttcatcactgagctcctgaccaatttcagcagtcagagaggtctgcatcaagcaaggtcttggtctaagcctcatgggattagatctgaggtcaaaatgcctataaagtattaatcaagggcattgtagcattttctcatggcttgggtcttgatatgaatggtctctttgggaattcacactcactctgctcttttaaaatgttcacttttatcactgtgcattttcccaagccttatccctcaggatcaaagaaagggcctaggctttaattaatgatctctcctgtgttttaccaagggcactggtctctcgagcttgcagtgggttgcaagggattagagggtgtatttgcagcaaaacttctgtaccggcactcgctctgtatatatagtctcttccaatttgcttttagagatcttttctttctgactgtttgcaggaggacatggcacgctgtggcatattctgcctgatgtctctggaggcatagttggtgcccatcccactttttattaactctcttggttgaaaacacagcccagaagacatgttgggacttcataagcacagcctaaggaggaacattggaaggtacaacattgtacatgtggccaccctgccccaacgcagtcacacctctgtgctggtcctcctgcgagctccccagagcatggggtcccttgaggttctttgtggcatgcggtagggggctcgatcctcagcttccttgacttggccattgttcaggatggaaattaccgatccgggaaaagttttatttgaggttactgtttacagcttgaagctcatggaagtgcagtctgctctcctgtggactttgtgggtttttcctaaatgggtccaacccatcagcttggcatttggggcactattgttttgaagcaacttccttgtgagtttagtctcacctcctaccccttgcccattgctctctaacctgggttcctgtttcttcttttgggactcttatattcttccctcctgaaatctgcctcagtctctccttctggaataatctctcttctcctctgacctctcctagtatttggtttttctttggaaggcaccttatcccctttattttatggtaacttcctggagagcaggagcagtacttgttctcttttgtgcttgtcatgttgcttaaaacacatgagtgttttaagcagtgagagacaaacacatgagtctcaatagggtctttatccaatcatggcattggaaactatggacttcagtgacagatgttatgtgctaggtttcagaatgcctttaaggtgggaaaacattttgtatcattttcaacatttgtatcagtttgaaatctgcctgctaagtaacaataaaaaagttagcaacataatttatgtttaaaaggaagtgttctggggtgatgttcgagttggaaacttgccctatgctttactgcattgtgatcttcagcaagatattttagttctccagatttccgctttcccagctgtaaaaggagacaacaatatgaatttcagtgaacataaaaagcacccattattttatacattgcaaagaaagaaaaattgctgtcaattaagcagtaacagtgctttctatggtttagaatttttatcttatacttaactgatatagctcttttagatgtatttaggcttttgaaaaatcacatatcactcattaaaaaggaaaataaattggttaaggttttccttggcatcttcttcttcattctgagtcttccgaaacacatttggactcaatgttgtcgaggtttgtgtttccccacacgtcatcatcctgtgaaccattgaagttgatgggaggcaactttttctcccccaagaataaagagttttctgtaggattgtctgccaaactgctaacacctttcttcaagttttgaatgctggtgctttcccagtcttacaaatccacatcaacacaagattttcaggcaacagccagtacgcagatggtcctaaaatagtttgtacattgaaacaccagggggttgcagatggtcagccaggccagggaaaataatccagttataaccactgcatcctgaccacttcctggctgatggtgattgtaggacacatccctgtttcagagatgttaaaatgtaaaataataataataataataataataataataataataatataagatataacctgtttcctaaagttgtgatgacatttaaaggtgagaaagtttgtagctattattgtgattatggttactataaattctgagaaaacacagtggggttttctaattaacactaactaatttatgggacactcattaatgttatatatttatttattgttcaatgttcatgcttaaaaatttcttaatttttcctctttttaattgaggtatggtttatattcagtggaatgcacaggtcttaagtgtttacagttcttgaattttgacacctgtgttacgaacagccctaccaagagatagaacagtctcatcactcaagaaacaacaccctatcttgtcccagtcatcatcgtccctcctctgttctgatatcttctaccatggattaattttggctgttctagaacttaatggaatcatgtggcactactcttttgcatcttttctaaagacatgtacatgttggctgggcgcggtggctcacgcctgtaatcccagcactttggaaggctgaggtgggtggatcacgaggtcaggagtttgagaacagtctggccaacatggtgaaaccccggctctactaaaaaatacaaaaattaactgggcgtggtggtgggcacttgtaatcctagctacttgggaggctgaggcaggagaatagtttcaaactggaaggtggaggttgcagtgagctgagatcgtaccactgcactccagcctgggcaacaagaacaaaactctgtctcaaaaaaaaaaaaaaagaaagaaagaaaaagacacatacatgttgctgcatgtatgacgagtttgtttctttttattgctgagtagtctttcattgcatagctatagtattatttttgcatcttcctgctgatggatatttaggttgcttccagtatggggctggctctcaggcataagacactgtgaccatttatttgagtgcaaatatttttgatgacatgttttcatttcttttgtgtaaatgcctggaagtagaattgttggattaaagggtaggtatacattgaactttatgagaaactggcagaacttttcttgaagggaccattttacatgcgtgagagttccagttgctccatacccttgtgaatgttgacatttttagttgagttaatttgaaacatttgagtgggcttgtagtggaatatttatggttttaatttttcttttcttaatgattaatgatgtcaaatgttttttcatatgcttattagccatttgtgcgtctactttgtaaaatgcctgttaagtcatttgaccatttttcaatggcaccatttgtgttttaattgtcaagttgtagtattcaattccttgtcagttaaacataatgcaatgattttctccaagtctgtgacttgtcgtctcattttttagttgtgtcttttgatgagaagtttttaattttgataaagcccatttatcctttttaaaatagtgttttctgtatcttatctgaagttcttgcctactccaaagtcaatcaaatattcattttttttttgtagaagctttatagttttaacttttacatgtaggcctgtgatccacctttaattaaatttttgtgtggtttgaggtatgaatcaaggttaatattttttccatgtagatagctagttgttccagcaccatttattgaaaatactttcttttcctcattgacttgctttggcactttggttggctgtatatgtgttaatccactcctggactgtttattctattccatcgatctgtttgtctatgtatattcaatgccatattaccttgatttatagtggctttagcattagtcttgaaaccaagactcactttttaaggattgctttggtcatcctcctcctcctcttccttcttcttctttcttcctattcttcttcattcttcttcgtcttctccttccttccctccctccctctttcacctcctcctcctccttcttcttctttctccctctccttctttgaggtggggacttgctatgttgcccagacaagagtgtagtgcctgttcaaaagtgcaatcatagtgcactacagcctcaaactcatgggctcattcttctagattttatttgtttagatatgaagtctcactctgttgctcaagctggagtgcagtggcaggatctcagctcgctgcaacctacacctcctgggtttaagtgattctcctgcctcagcctcttgagtagctgggattacaggtgcttaccactgtgccagattaatttttatatttttagtagagatagggtttcgccatgttggccaggctggtcttgaacacctgacctcaagggacccaccacctcggcctcccaaaatgctgggattacaggtgtgagccaccatgcccagctcactcttagacgttttagaataagcacataaatttctacaaaagaacctcataacattttgattggaattatattaaatcaatgaatcaatgtggggaaaattgaaatcttaccaatattgaacttccagtgtatgtatacagtgtatcttttaaattatttgtctttaatttgtctcagcagtttttgaaaaatagttttcactgtagagctcttgcacatatttaaagaaagtatccctcagtattatgagatttaaaatattttgtaaattgtattttttaaaaaatcatcttctagttttttgttatttagacataagattgatgtttgtacattgaccttgtatcctgcaatcttgctacatttaatttatcatatatttttctcagtgctttacagaatttcttgtttattcttgtaactacctatgagtcaggtgttattgcaattatattttataagaaatttgccccagatgtgctaattttcttgctccaggtcacacaatttgagtaacaggggaggaatttaatttaggtcaactctgattatatggcccagtccccttccacactgctataatatgtcatctctttgacatttgtatattattggaatggagtgacacattgtggtttctctggattccactgggacatttttgggtcatcatactttacgggagatggcttcaccaatggaactcctaaaatggacataacaagaataaggtgataaaaaagacggtgatttttccagtttaaggagagcaatatttttccaggttctttccccagaggactgctaaggaaattgtacataatctcaaagtgcagtttctttgcccatgctgtgaatgtacattagctgctgctagatcttccatgtgtgtggatgctgtaaagcttgttttcccttcttctctcccacaacgtgctgtaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaactgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatattttacaaagtatgcttatttaagaagaaataagaaaaaacggggctgataggaaccagatttgaaatagggcttttgtaaatactccgtaaattgaagtaaatgaagagtagtatttataagctagattgagaaatataaaatcagctagctgaagttaagtgcatcaatttgggatgaataaattttcttttaaaatgtctatcaatttgtgtagagagaggtttcttcatagagatattagaatcaaagagtatgttcagtagttattctgtcttctttgtaatgaatacccttaagttggcttaacagctcagtacttatctttttttcttttcattcttaaaggtcaagccttgtttttgccgtatatgtaactagagacagtacgtttgaggctaaataactgtagtactagggaatgacaacacgctcacccaagacaccgcagcctggtttactctgtcatgataggaatgaggattgtacatttgaaataggtttctgctattgattttttaaatgtataaacgatggaaactacggaatttctcatgttttcaccacatagttttttgtcataaaatgaagaatatattatatccaagaatgaagaggaagtgaacaaatttgagcaaatttagtccagcaatattttcatttgaatagttgagcccctgaaagccattaatatctctttttaaaaaaagaaccatgcagtatttttgaatctcatcatcgtcacttcactaagtattttcacaatgatgaataaaacataaacaaatggaatgagagattgttaccatggatgattctaaattgcagatggctcattactgttgtgaagcctctctttatgtttttacacttggattttgctggatcagccaccctttccctatacattgatttacacgtgcttaattttttttaaccaatttgaggtgagttggctttaggtgaaccaaattaataatctagggttgagagtgtgggaaacaaataaataatgaattcctgaatacattgaagcttttatttattaaaatgtgataaaactggggcaaagtccatattcagctttttttgtgttttgtgggttaaaaattcagagggagctctgtgttcaagtttaaatgtagagaaagtacaaaggagagtgtacttatgcacatacacatatgcatgcatgtaccatgactctttttagccttagagaatgaaaccatttaagaaatgagcaatatgtagtattcttaaaaaaagattttgatttccaacaatagttgtggaatgcagcgttcaggggaaaaaggcaactcatggatgatcaagccaccctgcttgtcaggaacccagactcttctatcttgttcttctctgccccacaacatgtgccattcagtccaacctggctgacccagccacatgcatgtccaagtccagtcagaaaaaaaacaaagaaggaagagagctcatctatcccctttaagtacgcttttagaaatctgcacacatctctgctacggccacatccctgtgaccttaaccttgttatatggtaacagctacttgcaagaggggctgggagctgtccttaccctgggcagcaatgtgccccactaaagtgatgaattctgtttccatagcaaaaggggagatttgcagtcttagggaacaattagcagtgtctctcgtacagagaccttttaatgatgtgaagtgtatctctaatgatgcacctgagatgaatttgctgcatgcatcacttaaaatatcattgtatcttgtgtctctggctagattgtgagtccaccgaggtcagaacattgttcttaggtttcactgtactgctttggtgtccagcatgatgtcttttaaaatagtaaatatactataccatcaatatttgttcatttactggggccagatgttaaaatgacacatgaatgagtcctctcttcctgcattttagattgcagatctggaccttgaatcttctgcttctttattcattttccaaattaatgagggtagtgataagtttgtctttcttggaaggtgcttgagttgtctgagttggatattcagtttggagtgtcagtaatagaacaatacggtgatagaaaaggaactgaaatatgccaaggtactcaagggcaaagggagacagacctcatcaccgaatccattggcttttgttgccaagacacaatctctataaagagatgataaagaagtgtgctttaactcctgtcagctgttcttgagacttcaggataacacatttgaattcggagcaatgttaagtgcagtgaaatagaaggaaaagctaaatctatcttccaagccttgaatatttatggaaattaactataaacatttaattattgtggattccaatgtgtgtgtttatttaaagaagggtggaatgaaaaaaatcagcaacttttacagtttgctacatctgcttttttttttttttttgagacagagttttgctcttgtcacccaggctggagtgtaatggtgcgatctctgctcactgcaacctccgtctcccaggttcaagcgattctcctgcctcagcctcccaggtagctgggattataggccagctaatttttatatttttttagtagtgacggggtttcaccatgttggccaggctggtctcaaactcctgacctcaggtgatccacctgcttaggcctcccaaagtgctggaattacaagcgtgagccaccgcgcccggcctacaactgcttttcaagttaaaaggacagccctcagatttacgcagcagtttttcaccatcccttgtgtataaattggtaatctgtattgtactttattaatattgttgatttcgcactgtaactcagctataaaggaaaccgacgtcaaggggagagatttaatcacagaataatcaggactagaattttaaataggacatcattagcatgttaatgaattttcccaccttatgccagctgcctgagtagaaaagatactgcagatgtagctcaaaaatctggctggttccctggcccagtgagctgtcaggaatctgtgtagggtgatccataagctaagtgaagggattctaagtgagaataccaagcagcaagattttgtttttctgagaacgatggctaactgtgcccagcctaaactcatttgtctttcggtgagtaagaggggaatgggaggcagagaaggggcagttgaagggcaatgaggttggagtagaggcacctttccaattatggtttgggattaggaccttttgctttagatagaaaagttgtaagttcgcaatgacaagatcctgccctaattcttggcacagtctcacaatttttgagcttgaaatagctaatgaaaggaagcatgagtgtcttagtccatctgcgttgctatagaggaatacctgaggctgggtcatttataaagaaaagggaattctttggctcacagttttgcaggctgtctaagaagcatagtgccaacatctgcttctggtgagggcctcaggctgcttccactcatggcagaagatgaaggggagctggcctaggcagatcactggtgagagaggaagcaaaaagagagagaagggacatgacacactctttttaacaaccagctctcccagaaactaatagagtgagaactcactcattgatgaccaagctattcttgagggatctgcccccagacccagacacctcccattaggctctaccttcaacattgggggtcaaatttcaacataaggtttggaggtcaaagaaaagaaactatagcagtgacagattatactgagatatcggtttaactctgaagttcccagatgcagctacttgcagaatttcacttcacacctattaagaaaagtcttttagtttagaaatcctgtgagttacaagttctgcatatataggcagtaattcttttttccatatatgtcagatatatgtagaagaaactgatgaaaaagtagaacaaaagaataaaatctatgggtctcttttattggcagggagagggaggaaatggagagccgggacaatacatacaacaaagataaaaacaataaaattagcaaacaacaataaaatttaaaaacaaagacagaagaaaatgccaatgtcaagtgttaattatttggttgagaatatgatgtgataatgaacttcctagaagtcacagcaaagaagacagttgaagcatcatccttcttcctcaaaagcaccttgaaaagcacagagctttttgggaattcagagtgatgctaaattcttcaagacacttctcttgaaagcatagtggaaagtcctcctgaacagatttataacacatgcagaaagctcttttacttgtattattattttttacaactttttattttaggttcaggaatacatgtgcaggttctttatataggtaaattgcatgtcatcggggtttggtgtccagaatattttatcacccaggtgataagcatgttatccgatggttgtgaccaactacctctaggaaaaaaacatgttggggatcccttcaaagcaggagggactgtgcacaggagagactgaaaccacatacacattttagatatgtaggtatggacagtttttcccacaaaaagatccagtttttcagcagatttttaaaggggtcattctaagagtcctcaaattttaagaaacattaagatattaaactgtcgaggtgaattagggcttgggctagtgaagtttaaatacggcatcttccaatttctgacattatttcaagatgtaacttagcacctaaaaagtggctggagaacatatcctgtacactcaccaaatgtcacttctttcctctgagctttggctacgacctatgtataagaaaacttagctctccgggccagaacggtgatagtgctcttgataacagagggccaagccgtctgctttggaaccagatgagtgttgcggtgctatgtggcaagaaatgtagatgtttatatgggaaatagatatgtgtctgcctttccaaattcgaaatctttggtcatttagatttaaaaaaatatgtcaaataggatcttttggaagaaataaaaaaaattcaaaatcttttccctcaggtttttctgataggctgaagttttaaatctctaatcatttatctttgatttgccttattgattacattatcactttatcaggaccctgactaaatctgtttgtgtttttaatttctctccattttttcctttccagttacatccttgcatcactattagtgtgattatttcccttcagccatttttgcctgtgaatttctaagcttgaaatttgcagctaactttctccctcctttattaagtcgctgtgataattcttttgggaggcatcgccatacagtggaaaaagcctggattaggatgtagggggtgtcagtttaatctcagtcctgcccttccctaatcatctgcatagcacctgatatatatagcatcagaatgtgaggctcaatgagtgaatagtcttcagcaactcactgaattttatctgagtctcagttgcttcatatgtaatactgtagaaccagatcttgaagttgcatttctatccatccatccatccatccatccatccatccatccatccacccatccatccatcctttccacaagcatttattgagtacttacgatatgctaggcgctgtggcaggccctcatggtccagagatgaattagatagtccctgtggctactgaggtcccttttaactctagccccttgtatgtgaatttccacaattcaatttatactttgttcatttattttcttgctctcagctacttttgatctccttttcccacttttatccatatatatttttaaaagtccctactattgttacatcttttttcacttgtctctctacttgtttctatactcccttaaaatacgtaagtcacttaccccctgggtggaaatacaatgatgttttcaattatatttcataccaaattgcaacaggcagttttttttaacatgctaattcatttagagcagaaacttgactctatgtaatagggtgggtacatgtgtctcttaaatatctgccagattttctgctttgtagattattcttactaatcagtgcgtattagagtctctttgtacatttcatatggactctgggctttgataatgttggtagacacatgtactcacacacgctcatataatgtcctgaagattaagctaagagtgatggtaagtggaacttcatgatcttaaagaagagcctgtttgccatgttttgggtgaggggattattttttgcatggggaccctatcatgtattgcagaacatttcacatccctggtcattgcctgcatccaactcttcttcccacccccatttttcaatgcccccaggtaggagtggtaccaccctcagttaactgcataacttcagcctaatgctttatgttttagtatcattcctatgatttgaaaatatgttgtcatgatcattagaacttgcctggaattaataaaaccaaattctattattcacattatctttcatatagatccttagaggtttaaatataagttctttgcagatttcttcctccattgctctttactgtgtatattcagtatgtatttcttgggcacagatttctgtatgcacagatgagctacagctattgtggatttaatgttttctttgaagaaaaggaatgatcccttgtacgaagtcaccctctttttagtaacaaagacttatctctttctttttgtttctcaagcacttgagaactaagcactgtgctaagacttgacatactttagtcatctcatcctctggaccactgtggtactggctccactggaatctctgttttaccgatgaagaagctgaggtttaggaaggatcctgtcacagagccttcagggggcaaggccaccatctgaatccctcttacctgccattttacctttgacgttgctttatgttctttatgaatttgattcctaacgtcagtctctctatccatcccgcaacctcatcaccctacctaaataccacactcatagattcataattacaaaacaaaagtctacaaaaagtcatctattgatgatgttgaacatcctgaaaagacgggtatttttttttcatttttgaagttttcaagcaccctccctatattttgtgcctgagatgatgatccactatctgccatgttgctatagcagatggataatttaactcagtagtaggaggttctataggttatcaccctatgaaactcatatcttttgtattaaaacctcaattctttattttcgaagggtgactaggagaaacttggcatactaccataaatcagagagaagttgaactatagcaatttaattggatacatattcattgacttcaaaccagttttttgtatattttcaaataactgttgctagttctgcttcctgttctaaaatgctgaaatggcaatcttttcctttgtattcctataagtaaatgcattggttattagattgatacattactcagttcctggtaaagaagtagttagaagccctgtttgcttttaagaatttactaatttgtcatccttttgattacaaggaattcaatttgcaacatgtgatgtcaatctttctaggcttcttttgagtgagttttgaactttagttaaataaaacaactttttttttttgagacagagtctcagtctattgccaaggctggagtgcagtggcacgatcttggctcactgcaacctccacctcccgggttcaggcaattctttgcctcagcctcccgaatagctgggattacaggcgcccgccaccatgcctggctaatttttgtatttttagtagagacggggtttcaccatcctggccaggctggtcttgaactcctgacctcatgatccacctgcctcggccccctaaagggctgggattacaggcatgagccactgcgcccagcataaataaaaaaaatttaaactattatataatttaggattttcaggaatgaaggttgattctttataaaccaaatttgattttgtgaggttttgcagaatttaattttacttggctaaatatgactcattatatggtcacagttttttcagtgattaatttggtaagaaatattttgttttccttcttggcattatcatgagttatggcttcctgtacacattcctgccattttagctgtgtactttttctttgaagctgccatatgttaacaacccaagagagatggtatttactggagagatcatcacttgttgctaatttgatttttcagattctctgagctcttataaaagagagagagcatgctgatgaatgttttcctgccctgactgctttgaggagctagtgtttgctgccctgggcccttagtcctgttatgttttggacttggggatggccactgtgtctaatccactttccattgaggcttttctgtaactggggagggctggatcactgtaggggtggacaaccctgagtgaatgcactgcaatttaatatttatggccggtacagaaaccatcaagaattgcttaaggatttactgacttggcatcatcaaaaatttatgaggcaggtatgctcatattccacaagcctgcatagtcatagaatgtcgttttatttttcttttgacattatgctttctggagtcttaataactcattaacaactgatgacacactttgctttttggtttaattataaccaaattttatttgccaaaatgatgtttaatttttggtgtattaacccattatgaatatctctcttttcctatgtttactatgactgctttacatttccagtctccccaaatctgatattttccttccccaagaaagaaccaaatacaattatattacgattgcatggtctgtctggtttggacagggtgactgaaatcttgggcttctttttaactctgaattggatccagcattctactttgcttcgtatgtaccaatcttgttgggtgagacatatacattggaatttggcaagtgtttgtatacccttcacccaactccactgttttcagagactgagtaacagtagtggctggatgccaacttcatgtctgccctgagaaggtcaccaaacacggacattcccccgtggtctggaatcctgcaaatctgtcagcctttggaagtgaagtgattctcccctaaagattatagagaaattctctgaagtcaaagctgatgaaatgtctggagttactctaggataaaattttaatttatttcaaaaaatacctttagcataaaataaaatttttgaaatgaatgaaaaatgtttatcatgcaacttctataacagagcccctggttgcatttttttgcattatcttctgtgcttgcagtacaggaaagctttttacacacttgtactgagaaagaggatgcaattttacatcctctgtctgtccttaaccttataggacaatagtgagagcatggcaccagttaatcctcgtaactgtagtttgagacaaatttatcattcccaatctaccaatgtgtgaaactgaggctcagtgaattaacagagtggctcaagtttctgtatatgggaagtaaagaactggaatgagactcatctgtctcacttcagagccatactcttcattatacacttctgtgtccctggttgcattataatattccaatttattattttttatgtacataacagtccaaggatcaatatactgtgacttacttaactacctccttattctgaggtgtttaatgattatttcatgaattttttctgaagataaagtgccaagattgggattaatgacccaaagaatgcagtcatttttatggcttcatacatactgcagattgatttgcaggttatagcaatttaattgatactaccaatccatcctttctaataataagcattattttttaaaagattattagtataataacagagtggtatttaattcatgccttgtttttgcatatctttgactaatacattcaacttgtttttttgtgcctttataagttttttttgagacagggtctcactctgtcacctaggctggagtgcagtggcattatctcggctcactgcaacctccacctcctgggctcaagcaatcctcccatctcagtcttccgagtagctggaagtacaggcatgtgccaccatggcctggcttggtagagacgggattatgccatgttgcctagagtggtctcgaactcctgggctcaagtgatccacctgccttggcttccaaaagtgttgggattacagagtgagccaccatgcccggcctactttttttcattgtgtgtttcactcacgtccgtgtgaagagacaccaaacaggctttgtgtgagcaacgaggctgtttatttcacctgggtgcaggcaggctgagtctgaaaagagagtcagcgaagggagataggggtggggctgttttataagatttgggtaggtaaaggaaaattacagtcaaaggggggttgttctctggcgggcaggagtgggggggtcacaaggtgctcagtgggggagcttttgagccaggatgagccaggagaaggaatttcaccagataatgtcatctgttaaggcaggaacaggccattttcacttcttttgtggtggaatgtcatcagttaaggcaggaactggccatctggatgtgtacgtgcaggtcacaggggatatgatagtttagcttgggctcagaggcctgacattcctgtcttcttatattaataagaaaaataaaatgaaatggtggtaaagtgttgggatggtgaaaagttttggaggtggtatggagagataatgggtgatgtttctcagggctgcttcgagcgggattagggcggcatgggaacctagagtgggagatattaagctgaaggaagattttgtggtaaagggtgatattgtgcggttgttagaagaaacatttgtcatttagaattattggtgatggcctggatatggttttgtatgaattgaaaaactaaatggaataagagaaggagaaaaacaggtattaaaggtctaagaattgggaggacctaggacatctaattagagagtgcctaaggagattcagcatagtcctgccagcaaagattatttatttacttcaaaagttaagagcggcagtttggggatagcaccaggagatatcagctgtgatggcttggaaaaacagtgtaaaccggcagcgtaaacaagagcagggcatgtatgagtagttgagaatggtgaataggagtataactagacagaagatagtagggatgacaagttttttggggcacagtccaagttggtctggtgtctggaatgagactggggcctaataaaaaggagcgtccatacaggagctcaaatgggctgtaccctgtagcattccgaggacaggcctgaattctgagaagggaaagtggtaaaagtattgtccagtcctttttaagttggtggctgagcttggtgaggtgtgtttttaaaagaccattagtctgttctacctttcctgaagacggaggaccgtaagggatataaaggtttcactgaatactaagagcctgaaaaactgcttggctgatttgactaataaaggctcgtctgttatcagactgtattgaggtgggaaggctaaactgaggaattatgtctgacagaagggaagaaatgactgcagtggccttctcggaccctgtaggaaaggcctctacccatccagtgaaatggctacccaggctaagaggtattttaattttctgacttggggcatgtgagtaaagtcaatttgccagtcctgggcaggggcaaatccccgggcttgatgtgtagggaagggaggaggcctgaacaatccccaaggggtagtagaatagcagatggaacactgagaagtgatttcctggaggatagatttccaggatggaaaggaaatgagagattctaagagacagggtagcagcttgtaacctatgtggaagaggttatgaaatgacaacagaatagaatgggactgtgaggctgcaaggagatattttccttggtctaagaaccatttgccttgtgtgggaagagactgataggtggaagtttcagcaggggagtaggtgggaatgactgatgtgaaggagaaaaactggccgtgagggacagaagttggagagctagctgcttgtctagccaccttatcagcataagcgttgcctagagcaatgggatctgacgccttttgatggcctttgcagtgaatgactccagcttcctttggaagtaaagccgccttgagcagagtttttattaagaggcattaatgatggaggacccttgcgtagtgaggaaacctctttcagcccatgtgaccacatggtggtgtatgatatggaaggcatatttagagtcagtataaatattgacgtgtcgtccttttgcaagagtgagggcttgagttaaggcaactagttcggctttctgagaggtagtgggggggggtgggcagagtggtagccttgatgatagatgtggaagctactatagcatagcctgcctttgctggtgagtggcgattaggcctggtggaactgccatcaataaaccaaatgtgatcagggtgaggaacaggaaagaaggaaatatggggaaatggggtgaatgttaggtggatcagagagatacagtcatgagggtcaggtgtggtatccagaataatgtgggaggctggattgaagtccatgccaggaacagtggtaattgtgggacactcaacaaagagtgagcacagctgaaggagccagggagcagaaagtatatgcctcaggtgtgaggaagaaaatagattttggaagttatgagaactgtagagagtgagttgagcatagtttgtgattttgagggcctctaaaagtattaaagcagcggcagccgctgcacgcagacatgagggctaggctaaaacagtaaggtcaagttgtttggacagaaaggctacagggtgcggtcctggctcttgtgtaagaattctgacctcactaaccatgcctaggaaggaaaggagttgttgttttgtaagggattgaggtttgggagattagtcagacatgatcagcagggagagcatgtgtgtttttatgagaattatgccgagataggtaacagatgaggatgaaatttggacttgactgaagtaatgggggctgtctgtgaagccctgtggcagtacagcccaggtaatttgctgagcctaatgggtgtcagggtcagtctaagtgaaagcgaagagaggctgggatgaagggtgcaaagggatagtaaagaaagcatgtttgagatccagaacagaataatgggctgtggagggaggtattgaggataggagagtatatgggtttggcaccacagggtggataggcaaaacaatttcattgataaggcgcagatcctgaactaacctgtaaggcttgtctggttctaggacaggtaaaatgggggaattataaggagagtttataggctttaaaaggccatgctgtaacaggtgagtgataacaggctttaatcattttaaagagtgctgtgggatgggatattggcattgagcggggtaagggtgattaggttttaatgagatggtaaggggtgcatgatcggtcaccaaggagggagtagaggtatcttatacttgtgggttaaggtggggggatacaagaggaggatgcaaaggaggctttggattgggaagaagggcggcaatgagattcagctgtagtccaggaatagtcagggaagcagataatttagttaaagtgtctcagcctaataagggaactggacaggtggggacaattaaaaaggagtgcttaaaagagtattgtcaaagttggcaccagagttggggagttttaagaggtttagaagcctggccgtcaatatctacaacagttatggaggcaagggaaacaggcccttgaaaagaaggtaatgtggagtgggtagcctccatattgattaagaaggggaaggacttaccctccactgtgagagttacccaaatctcggcatccatgatggtctagggggcttccaaggcgatttggcagtgtcagtcttcagctgctaagctgagaagatctgggaaggagtcagtcagagagccttgggccagagttccaggggctctgggagtggctgccaggtgagttgaacagtccgattttcagtggagtcccgcacagatgagacgcggcttaggaggaatcctgggctgcgggcattccttggcctggtggccagatttctggcacttgtagcaagctcctgggggaggcaggcctggaggaactcctggtcactgcggtttaggcatttggaagttcttgtgtgctggagatgtggctggggtttgtctcacagtggaggcaaggaattgcaactcagaaatatgttgctacttggctgcctctactctattattgtacaccttgaaggcaaggttaattaagtcctgttgtggggtttgagggctggaatttaatttttggagttttatttaatgtcgggagcagattgggtaataaaatgtatattgagaataagacggccttttgaccttttagggtccagggctgtaaagtgtctcagggttgctgccaaacgagccatgaactgggctgggtttttatagttgctgaaaaagagcctaaacactatctgatttgggataaagaaaaaggagcattaaccttgactatgcctttagctccagccacctttttaagaggaaattgctgggcaggtgggggagggctagtcatggaacgaaactgtaagccagaccgggtgtaaggaggagaggtgataaaaggattatagggtggaggagtggaggccgaggaagaatttggacctagcttggcctggtgaggaggggagaggtcagatgggtctgtagaaaaggaagattagaaagacttagcgacgcttggggttgggactgaggggacaggcaggagggaaagaaggaagatttgggatgagttgtactgggaacagagactagggagggaccgatgtgtaaaagaatgtctggacgtcaggcatctcagaccgtttgcccattttatgacaagaattatttagatcttgtaggatggaaaaattgaacgtgccgttttctggctatttggaaccactgtcgagtttgcattggggtcaagcggcatcgcagaagaaaataaggcatttaggttttaggtcaggtgtaagttgaataggttttaggtttttaagaacacaggctaagggagaagaagggggcaatggggggcagaagcttgcccatagtgaaggaggcaagcccagagaaaagagagagtagagacacggagagaagggatggggggttcttgccccctagaaaagctgtacttgccactaacggtgaaggaccaaggcaggcgtccctgcatggtcagacacctctgaaacgtgggtgaataatcatgcagacatccccgtgtgattaaacaccaagcgaagactgtcttcccgagtccgtgaacagcgccagagttttgggtccacagataaaacgcgtctccttcatctctaccagaaaaggaaaggaactgaaattaagagaagggagagattgaagtgtggcgccaagattgaaaggaaaaagaggttgagggatagtgagagaggttggagaagagagtaaaaagaggccgcttaccagatttaaaattggtgagatgttcctttctgaggaccagaggtcataggtggatctttctcacagaacaaagagcaggaggacaggggattgatctcccaaggggggtcccccgatctgagtcacggcaccaaatttcactcgcgtccgtgtgaagagaccgctaaacaggctttgtgtgagcaacaaggctgtttatttcacctgggtgcaagcgggctgagtccgaaaagagagtcagcgaagggagataggggtggcgctgttttataagatttgggtagataaaggaaaattacagtcaaaggggggttgttctttggcgggcaggagtgggggtcacaaggtgctcagtaggggagcttttgagccaggatgagccaggagaaggaatttcaccagataatgtcatcagttaaggcaggaacaggccattttcacttcttttgtggtggaatgtcatcagttaaggcaggaactggccatctggatgtgtacttgcaggtcacaggggatatgatggcttagcttgggctcagaggcctgacagtgtgttgtctatgtcctttgtctattggttttattttgaaggaggcacctagtggttttcttctctttatataatatggttatcaatcattttttcctatttgtatgtgtgtgtgtatttgtgaaattaacccctcatcatgattaatagtggaccaagaacaaagtataaaaaataatatcatgttgagataacggcgtagaatggattttaaacttcttaaggcattagggtgcaaatgatgtactaaacaacatagaccgatctttctgagtaaaaacattctatttccactctgtgtattaatatgcattggacctggcctttcaaacaaatgtgatattcagggaactgccgcaattgagaccttaataaaccagtttcacttttttcagtaaatctgtgaaagctattattttacattttctccactgttaaaatacagaaactgagagaagtactcagtatcctacccaagaccttatttttcttcaggatgcatctcatgttttgtacttcactgtctttggctgtttttttctttattatttcccattttcttaagttgatccattataaaaacaactcctgcttacaggactatttttttccttccagaggcgtgctgttgtttcataggtgaacggatagtgtcctgatggtgtctgtggcccttgaagctgcagtttaaggagggggttcaaagaaatggtagagaaaggtcgtccctgtcctggaaggatgccagataggatgacctttgaaactgtcatcaggggcatgaaaaatgggtttgcaatagttccctgcccttctctgcacaaacgatatacagcatttgatattaaggcaaatatccttttccattgatgatgtgtaatcataaatcataagaaatttctatgatttcggattcaggaaggcacctttctacctgttggagctgttgggagtcattctccctccagcccgaccatgtcttcccacggcttttggctgctcccattggctttcacattctcctctccacctttggactatcccctacccttatctatccacacattcacttcctacattccttccatgcctaatcaggacagctcctctgaccaccttaacttcccaggatgtccgcgtgctctggataaagtgcgctaagccccgccccgcccctccccgtgtgatctgagtcgggccccactgactttcctgtacacacatcctctgtcctccttggacccatatttgtagtcagtctctctgttcccactctgcatggcacttgacctgatgctgggaaggtaatcattatccttcccttaatgtttcaggattattcattctattttgccacatctaatgtaatatttaatagcatctatgaagaagactgaagactataaataaatgctctctttagtattgagaaggttttatacaatataaaatttagagtacatttttttctcaggaggtctgacattaatattaatcgtgagccccaaagtagaagcttttatattttagcataatgaagtttaccatatgtttcaaagtcacttgcaattgtgcttctcataatgacaattagaaaggtcatcctgtcttgccaggctccattaggtatataaaccagctcgtggctgtcaccgtgaaatgtgttaaggcacttgtatgcaaattcaaggggagacatgatattttttatcccaaagtgtagctgtttacaactaattaccaaacacggaacaagcctattgtttgcctttacatgatatatgggcatagaagtttctaaagcaaattctcctctgtcttttcattgattaaattatatgaagtcaccctcttccatgaagcattacatgatgaggtccccaaagcactgaataaagaaatttgtcattaagacactggtgtatttctgatctatatatttttttctgcttcactcgaaaaacttattatctgcatgaaagtatggaaactgttattgtatttaactctctacatgtgaaccttgaagaaatgatggggcgaaggtgaaatgaaagggaggaggtgaggaggtggcacaagtaatgttttcttatggaacttgtagagggataaacctacattagaatcaaagcaggtaattcctgggaaactgaagcatgccattgtggatgtgggtcatgggaactgatgctggaaaaaaatagttcctaatctggtttgggaatggcaaatttggttgccacaattgaaatattaatatacttctttgtatgaatgccctttcatttatgccttttttttctttaagaggcattttttctctaagacaggctaaacttctgtattcaagcctttagagtttgcaaacatttatcaatagataagaaagatagataaaaagtcctggattcattaatgcacagccatggtctctacagttttgaaatttctcacttgggagaatactggagaagaacctgtggcccgtgaagcatttgactgttaatatttcgtactattcaaatgctttaatttaaaaaattaatctatgaatttaacatatattcatgggatgcagacactgcagagagctgcctcttcctggactttgtgtttgaactgtgttccggttgcttaagcacccatctatctggaatggtttgtgttcaggttttccagaggaaaggatgactccatgttcctcaaggaactttccaggcaaatgaatttgttattttttaatattaaaaatgatcctctttattgagagtgatagactaagggaggaataaacagttgtaatagccctgtgacacataagcggagaaaaaaaccccctccatgcttatgtaaataggaaggagaacaactgtagcaagaatatagaaaaggactcctttcttctctcttccactctcgttttttgccctttggcctaaagctgttaacattgggtgaatgtccctgtcgtcatcttgcattatatctcacgttctgtttgttattgatagggatggatatctgagagtctatatcaagagttacatgtaagtttgtgtaaggcccttcttttgcttctacatttttgctcgttgtatggatgcattttgtaggactgtgagcttatatttaaaacacctgtgcggcagtggacccttgtcaccgcctggcctctcattcagaagccttagctgttcctcaactcctacaacacatgttgagcgcctctcaggtgccagctactgtaataggcactggggagtggaagggtgacaagatgtgattcctgacctcgagagctttgcagtcactggtggaggaggcacatgtacacagcaaatagggcacgatgtgttgaaggatgaaatgaagcaataaacaataggtatcaagacagcagagataaggacaaccaaggatgccttcgaggagccagggagagcctcacagaggaggcagggcatgcaccgtggcttggggatggaaggggcagaaatagtgttgttttagggaagaggagagcacagactcagaggtcggaggaacgtggcacatctaggagacagggatccaatcccagccctaccacttagcagctgtgtaactttgggaaagtttgctaatcactctgagtatgtttcctcccacgtaaagtagaaatactactactactaatattgacctcttaggaccatgagtagataaagtaataatacatgtaacaatcttggcttagtgccctagcgtatcataaggactcaataaatattagtttatgtgattattgatctggctggactgaagggtgtaagagtgagaatgataggagatgaggctggagaagtggacagagccaaaccatgagataccttttcaccaggctggggttttcaagatttctgaaaggtcgtggctagccattaaaataacttggtttctgtatcctccactgctcctgaacattcttgtattacagttgtgttagtctgtttgcattgctatcaaggaatacctgagacagggtaatttgtaaagaaaataagtttatttggcttatagttctgcaggctgtacatgaaatatagtgctgccatctgcttctggcaaggcctcaggaagcttacaatcatggtggaaagggcaggggagccagccagcgtgtcacatggcgagagagggagcaagaggcgaggtggaggtgccaggctctttttaaacaaccggatcttgtgtgaactcattaccacagaaagggcaccaagccatgcataagggactcgcccccatgacaccagcacctcccacaaggccccacctccaacattgaggaatcacatttcaacatgagatttggagggggcaaacatctaaactatatcaaaagtcgatgattaaacacagtctcatataaatgttctacctcaaaaaaacccaaacattgcacacctattatagctaagataaaaaatactgacaacaccaagtgctgccaagaaggtggagcaggccaattgctcatacatctctggtgggatgtgtcagtatcgcaggtggggttgtaagagtagagccatctggaagacagtgccagtggcttatggagttaaacattacacttgccatgtgacctggcaattccactcctgggtacttatttatcctctagaaataaaaatttatatcccacaaaactgtaatgaatatttatagcagctttattcataattgcctaaaactgaaaacaagtcaaatgtccttcactgagtggatagaataacaaactatggtaccttcacatagtggaacacgactcagtaataaggaacaaactatcaatatacacaacaacctggctgcatctcaaatgcattgtactgagtgaaagaaaccggtctcaaaaggctacagctgtagcatcctattcatacgatgctctggaaaagagacctctaagggcagggtttaggaattgggagaggggctggggaagggtctgattagaaattaacagcccaagggaattcttggttttgtttttatttgtttttttttttttgttgttgttgttttttgagacggagtctcgctctgtcacccaggctggagtgcagtggcgcgatctcagctcactgcaagctccgcctcagcccaagggaattctttaggggccttgggattgttctgtatcctgtttgtggtgatggttacaagttacagcccatagaactgtacaacaagtgaattttactgcgtgtaaatttttaaaaaattttaaaaacttgaagacatatagctcatttaccacgtgctttacctgtcttatctcattaatcctctctatgaggttgatgttattattacaggtcgaacattcctaatctgaaaatccaaaatctggaatgctccaaaatctgaaactaattttgaggcctgacatgatgctcaaaggaaaagctcatagaagcatttcggattttgcattttcaaattagagattctccacaggtaattatgcagatcttccaaaagctgaaaaaaatctgaaatccacaacacttttggtcctaagcatttcagataagggatactcaacctggatctctattagtgcattattatctactactattattattattgactaagcagaggctttgtgaggtttggcccaaacctacataccttccagggggcaaagcctggcacaagccaggtgtgcacactccccagaccctgaatttccacagcattgcgagtcacccctcaaggagtcacagagtgggtggtagatctttctcaggctcttgtacaggctgtacctcagtttatccagctcattggtcagtgtggttgctctgtgcatcatgctggtgcaacttttacaaatgtgcaaatgttctaaatgcttagtatcagagagggagttgcctactgaatattttctgacctcttaacttgtactgttggctaagttaaatttggcttcttttcaaggaactattaccttcctagagggtttgtgtggtgacacccataaaaatcttattcagtttttgttcaattcacagctttaacttagtctccttaaaaatcactcaggttgtaaccaaaggctgctctatggctgagtagaattgttaattattaataactgttaatcaactacatagtcaacctcagacaagagggcaagagataattccttagacacacacacaaaaagagcaaaatgttaaggttagaaaacagtaaaaacgatgaagatatttaattctttttgcatactttgtaattatttgtttaaatatctatttccctagcctctgtgccagtttttctcgttgttttttatttttatttttttaagagagggtcttgtgttgttgcccaggctggagtccagtggtgcaaccatgactcactgcatcctcacactactgggctttgatcctcccatgtcaggctcccaagcatctgggactacaggcatgcaccaccatgcctggctaatttttaaaacatttatttttgtagagataggatctctctctgttgcccaggctggccttgaacttctggtctcaagcaatcctctcaccagtcctctcacctcagtctcccaaagtgctgggattacgtgagccattgcgcccagccttttcgaggctattagttttctgcccccagttcctgtaatccttgcatagaataggggcttagtaaaggtttgctgagttagaactccatttcaatggatattgaacttgagaactgagtgagacttgtggagtatggtatttcaaagtattatttatccaacagtctgatatttcagaatcattcatttgccaactcctatgtaggtactttggagatattatttgagttattccttatgacatcccatgcagcaaacatattccttcctaaatgaggaagctgaggctaggagtgatgagctgatttgcttgttatgcacactggatggagtgtgagctgtgtcagacacgtgaattcagatcctcttgtgccacatcagagggacatgagatggggtggctgtttcacttctgtgagcctcactttccccctcattcatttatgtaaccaatggtgggtccaggttttgtgaggactggagcttacataatttgagtatgggtcttatttaaagaaaaaaatatataggattatgattcaaatttggatacagggtttgaaggagacttgtgacagcgggagaccctgaggcttatgtgccattagattcatggtaaatctgtccttgctttcaactaatttttatagtgagccactacgtgccgggctgtgtctgcagctggttacatgtgctgagcctaacagtaccatcctggtcctctagaatgctagagcccactgggagacaccaccagaaaacagacaacggcagtacagtcagataagtgtatgatgggggggtatgaaaagccaggaaagatttctggaagagatgacatctaagctgctactcaggatatgtaaaagttaaaatggagaaaagtatggaaagcccatttgaggcagaagaaagaacaagcatgagaggtgatagagaaaagcttccttatggggaccgcaagaagtttagtggggctgcgttgttcagtggggtggaggagtggggagagcttcagctccagaattaggcaggggccaggtgggcttgtgtaccacttaaggagcttggaaatggtcctaagagcaataggaggcacttggacagatttaagcagggagtgatctgataagatttgcattggggggatgaaaaaaaggccacactgggtccagctgcagaatggagagagaatccactccacactgggcacgagggccatccccctgcagggaggccagtggcaggagagaggaaggtgacaggagagcagctgtgagaacgaagaggaggggatacattacaaagttgttcagcagtgagaaccaacaggacttgagagtggatgcttagaggcaggaggtgcaggtggtcatgagggaggagataagatagaagcttagctttctggcctggaccaccggtggggggtattcattagaatcaaggccataagaacagcagatttggaagagattgtatgtctcctttgagccagttgagtttgcagtttctgagtgacatccaggtggagatgttcagtggagagctggttgcaaagctgaggaaggagagctgactgacggcagggctttggctgttctcagcatatggattataattagagccgtgcagatagatgagagtgcatgggaaaagccagtgcagagacaagatggtgcaaaggagtatcctaaagaacattaatctttaggggacaggcagaggacaaggagccacaaagaagcatgagagactgtggtcagggatgagggaggaccggcaggagtgtgtgaggagcacggattgtttttgtttgtggggttcccctgcctttagggacacactaactctttggatatcaactggttgtcccggaattccatttagctctgtttgacttgtgtgcagagcccatggttttcacagcccctcttcctttcagatttgataatttgctagagtggctcacagaactcaggaaaacactttacttatgtgtacaggtttattgtagaggatacaactcaggaacagccacatggaagagatgcataggacaaggtatgggggtggcgcagagcttccatgccccctccaggtgcgccacctcccagcactgccatggcctcaccagtccagaagctctctgaaccctgtggtttagggttttcatggagcttggttttatacattttagggagacatgagacatcaatcaaatacatttaagaaatacattggtttggtccagaaaggcaggacaacttgaagcaagttgggcgggcagggaggcttccaggttataggaaggtttaaaaattttctgattggcaattggtcaaaagagttattatcaatacccagcattttgggaggccgacgggggtggatcacgaggtcaggagatcaagaccatcctggctaacacgtgaaaccccgtctctactaaaaatacaaaaaaaattagccggacattgtggtgggcgcctgtagtcccagctactcgggaggctgaggcaggagaatggcatgaacctgggaggcggagcttgcagtgagctgaaactgtgccattgcactccagcctgggcgacagagcaagactctgactcaaaaaaaaaaaaaaaagaaaaaaaagaaaaagaagagttattatcaataagaaggaatgtctgggtttcgataaggggttgtgcagaccaaagttttctcatgcagctgaagcctccaggtggcaggcttcagagagactagattgtaaatatttattatcagatgtaaggtctgtgttgatgttaataccggaggttatattgaggcatgttcaaccctacttcccgtcatagcctgagccagtctttctggttaaattttagagttctctggcctggcaggaagtccatttacatggttgaggaacttagaattttgtttttggtttacaaagagaaagcagagaagggtgatgaatgactgagccacatcctggtgccagctctggaccgggtttggctgtggtctccacaaacatttttgaatgaatacatgagtgagcaagtgagtgagtgaatgggaggaaggccggcggggggaggtttgaggagagtggggaaaggtctgctgtggtgccttgaaggtggggagacctggcacggggaacacagaattgccaggtggatttggtgcccatttggaaggtggcccagtgacttctggggacagtgtccctgagatcatgcattttccccagctgtgctcagcagcctgcttcagggagagggaatggcaacagcgagcacgccaggctgggggtttccaggcaggtagaggagaaaggcaactgggttcgggagccgaacggagtggcaggaaggtgagtgaagtgatggatggctatgtctacactggaggctggtaaaggagggaaagtgataggttgaggggtgggtggctggatgtggtcgtggaacaggggcagaaataactagggtgtgggaaaagtagtggcaaggtggctgggagcttggtggctcagtttgggtgcagatgaagccaaggtgaagtgaggtgggatggtgagaccaaggacccagaagcccaggtgtcggcctggtgatgcaaggatggcggcagggctcggggtggggaggaggtggaggtccaggatcaaggcccccagagaagggggatgtcccagatgagagcaatgagaaggacagcttggggtgaagctgaatgccctgagccttcaagcagcaacagattatacctgaaggtagagccacgttagggacgtgggaggacactgactgcttgggtaggggtggggagtgagcatccacactcgagtggctgcagatgccatgagaccctccagggatgaccaggtcactgttagggcagagaggaggaggcagctttcagaaggagctgggcatgcagagcttgctaaccagtgatggaggatccaggcagtagggcaaagcccatggaggggcccacaggacgggacaactgcgaagacactgtctgccttggaatgcgggcagcatcttcatagccatccagggatttggaccctggccttcctaagtgagagctatactttttctataatttctgccactacataactgccaaagttaaaggtggaaaaagagtctctgtcctagcttttcagcgaccttttcaaaaggaacagaaaatcgtcgcattctcttgcttctacaatgccagtgattgtctgatgcatcctgggtttgacaaaggcaggtagacactcacggtgcagggacacgccagttccaaatcgcatctttactttttaaatgttgaaaaacaaaaaagacagtgcatcttagaatttaaggcaacatagtaactaaagtggcggaggcttttaactgaaaccagaagaaacagcatgagttttgttgttttatgtttcttagctgaaagaaactcaggcaggataacgtgataaggaaactcaggtatttgcctgtgattagttcaggaactgttgaaaaaagactctgggattgggcagaactagagtttagatcactagcttgaaggacttttaagtccagtttaagatttggagagagttataaaggctaagccagcatttataagaacatgtaccaattagagaagtacaggagaatttgctgttttctctgttattataaagatcattgttcttaaatttacattagtttgctaggcctactgccacagaaaaccacagactgagtggcttggacaacagatgtttattttctcccaactctgaaggctggaagttcgagatcaaggtgtcagcacaaatggtctctccctaagcctctctgcttggcttgcggatggctgtcttctccctgcgtcctccctcacatggccttccctttgtgtgtgtctgtgtcctcatctcctctcctcatagggatgccgatcagactggtttagggctcaacctcttgacctcgtttcaatgttatcacctctctaaagaccgtgtctccaaaaagtcacattctgaagtaccagggattagggattcaacatataagttttgggggaggacacagttcagtccatagcagcctattccatacctcattttataagaagagaatttaaaatcagatccttgcctagcactcttctggtcacacacagaaaataatccagaaagttaccttggctgctcagcctcatgtggctggaccctctgttgctgtaagacctcaccggacccttctccgtcctcgctccttcacatgctggaaccttccttacatgtctagatgcaccgagcttgttcacaccttcagggtttgttccctcatcctaaaatggtttctccttagttttatatggctctacccttgtgccgttttggcctcaagttaaatcctgttcctccaagaagcctccctgaccatccaatggaaagcagccacccagcaatgccagatctcattaccctgtctcagtgctcagtgtggtacttattgctggctgatagggcctcatttatcttgtcaccaatgtccccagcactgaagcaatccccagcagatagtgtcactcaaatatttgccaagtgaatgaataaaaccagaagagttaggaagaaatgaagagagctgctgggaagaatctggatgttcctgaagtccaagactttatttttttaggtgggattcatcaaaaggaggcagtttgcctgaggtcccttccctgggcaaagagagaaacagggctggtctgactccaggcctgtctgtgactttgattgttttaacaagcagatggtatttttgtacacagtgacttggagaacttggagacgcgtatcaatgccgcctttcttccctgtcccttgcataacaggtttggtgtcttggatcaagtttggggcagcatcaaactgcgccactagactgcatcccatgatgcagggattatactgtattcataccctgcagtgtttgcacatagaagccttactataaatgtttgctgagtgaaaaacagtgaataaatgagcgaatatttaaatgacaagaactgacagtcttttgaagttcctctagggtggtgcttctcaaacttcaacatccatctgaaccatctggaaagctagttaaaatgccaggtgtgattcaggaggtcctgggtagcctgagaatctgcatttctaatgagtttccaggtgatggtattgctgctgttctcacctctcctttgtgtagcaaggctctaggatgtgtccaggatggtctatctacttggtcaaagataatcttgtgagttgactagtcatcaaaagaccccgatcacttctcagtttgtccaaaaaataacacatgcaactttcagccagttacttaacctcagtgatcttcagtttttgtgcataggtgaattggagatgggtgttaatgccccctttcttccctgtcccttgcatattatgcctgatgtcttggatcaagttttgggcagtatcaaactatgccattagatcatatcccatgatgcagggattacattatattcatactctgcagtgtcttgcacatagaggccttactgtaaatgtttgcagtgaaacaacgaataaatgagtgaatatttaaaagacaagaactgacagtcttttgaagttcactttggaggaacctagtccaattatcaggagatattatttgttgaacactttgtacctgctgagcttcttgatatgtgttacgtttacttatcacaacaatcctgcagggtggaattattatcctcatttttttttttttttttgagacagaattttgctcttgttgcctaggctggagtgcaatggcctgatctcggctcactgcaacctctgcctcccaggttcaagtgattctcctgccttggactcccgagtagctgggatcatagggatgcgccaccacgctcggctaattgtgtatttttagtagagacggggtttctccctgttggtcaggctggtcttgaactccctacctcaggtgatccatccgcctcggcctcccaaagtgctgggattacaggcgtgagccaccgtgcctggcctatcctcattttacagaagaggaaactagtgctcagagaggttagacaacatgcccaaggtccccaagtcaataaccaggagccaatagcagggctctgatgatgatgatggtggtgtgtgtgtgtggtgtagtgtatgtttgtgttttcatgtgtatatgtgtgtgtatgtgtgcgtgtgtttccctcataccattttgcttatcaaatgatcctttaggttctttccaagtgtatgattttaggtcaaagacaaagcatgacacagttcactgtgaattgtgagttattatacaagctcgtgaaagagtcggataccttttctgatcctcaatataacctttgtcttctcaccaccataacacgttggtttctcttcaggaactgattttatattctcatgagcacatatgcggtttctcctatagactgtaagatttttaagagcaaggactgggtcttattttccattttgttccctagtgtcttcgatccttattgcattcagtggtttgatttgaacagaactttggaagcatgagacagactctgtacattaaaacgcttccatagcactcaccatggtgtccaaagtgtcactaaatctctgcttgcttgagatttctctatcttaattaatcttgatttgtgctgtttttttgtgaaagagtaaatgcctgtgggagggctgggccccacctacggagaactctggtagtgtgccaagagcaggactgcataattggtgcatgtgacaaggaacagaggagggtggaggggtccctggatgatgggggtgccttccccttggctgtctttattgtgtccccattggcattactgttactgatcactaaatcagggaacagacggaggcgtgaggtaggatcctacgacagacagcctttagtgagttaccaatgacgccagagttgaccatcaagtaaatctgttgccttttgaaagacatgtctgtctgtacaatgctagggcctgagttgcttaaccttctagtaaaccatgaatttctctcacatgtccttggggtgatgaaaatcttcccgagttgtgcggagcacaaagtagaacctgacagggaatgttctgaaataattgtgtggatggtgacaggtaaaaaaatacactgtagagatatcgatcctgtacgaatgcaacctaagttgttgctctgttaagaaatgtttttggagttctctatacactaaaaaaagaagaaaaagaaaaagaagaaaagtggaaaagaagagatttctcttgtcttgtatgaagcagcaaaataatattctatcagaattgttttaaatatggtaaagtggggcacttctatttaaagggtacgtctttggttcattttttatttttaattgccctgatatctcttgcttttgggaaagtccgacgctctggctctctgctatctgttcaaccagccttcagtagaagtgggaacacaaatggctcattgttttaattttggatttccttaggctgttgctgtcacctagtcatctcagacactcttacagggaaaccagcactggcagggtgtgaaggtcatagcaagggcagcagtgcttcccaggatcatgtgcctggagaggtcggtatgccctgacttctaaagggggcctgccttccacaggacgagcacttactgagcgcttctcctgcacttactgtacattctcatccatatgttagttgttgttaccataaatgtcctcacacatctgtggcatgtggatgacaagagcttctgagtatattttttaactgtgtttttcgaaggcaactttaagtgctaacaatccagtggttatatgggtggctattgactttcagattcacggcactgttctgagtgggtaattcgccgcctttctctaactcttatgtccttgaggaacctgaatgtacagatgattacctgtacctactgagcgtcctctcgcagagttggggtgataaatattctgcaaaacctgctataaaacagtcagccctgagcagcaggaaactgaatatagtcactcacatagctaaacccaggctcaggcctacattcacccctgtccgaagggggtggaaatgagatcatttcacacctcacgtggaagtgcagacctgaaagaagacttggggctcccccagcacaggtgtccccattttacaggtgccaaaggctgtggcggagacagagatggggagaggagttggccgtgatgcgtcgtcatggagcatctcacatgtaagggccatgagaagtgaggacagaagggcagccaggctggctggtcttcatgtgggccagttgagtgggaatgcggcactcatgggccggcggaagaatgagcatttgaggaggcagagttccccactcttctgaacctctgttttacaaaaggcttagaatataaaattgggaccttgtctttggaaaggagggagcaaagtgttaacctggacagctttggtgcacaaggtgagaggtttaccaagggctcacacactctccttcatgggagagggtgcttaggaggaggtctggctgctgtgaggtatgggacctgtccaggaccttctactgctacagcaggaacagcactgtgagggagggatgttgctcttcctatttttcagtcgtggaatggaggctttgaaaggtttggtaacttgctcgagatcacacagccagcgaggggtagcatgggattaaacaccagtcggctcgtctccaaaggcctgactgacaaaaacaaatttcaatcgattttacttttcctctgtaatagatgaggaatatctcatttcagaatatctgaaggtgacatttggagtcgctcattgattcaattattctgaatctttatttcagagcttatttatctcaggttttagatgtggaatgctccaaaactattcattggtttcacttccctttgcattgctaagtaaaggtgatataggagaactactcacaggggtgagcacagcaagggtacgaaggatgtaaaatcagacgcagcttttctatgcatctttcttaaacacattactcttaacccaagagacagtcaggatcattaactttcctaatattttgtaaagcattcatatagcaacatttggggcacatgcgcacctggtcttaagtcagggcaggagtggctaattaattctctgattcctcaggcttcacagtttcaaccagccataattattttgcaattgaggttccctctctgcctaaactggcattgttatcaagggctaaatgcatcagctttgtaataatgaagatgggtgccaattccatcttccatatgggatgaagttggggagagagatggtggagaagcactggtcagactgtaaatgatattgagtagaaagaagtcagggatttttgtttttaacatgaaaaagaaatagaattgtaactaagttgaagtttctttactgtttcatcttgtttctttacaaatttcatcttgtcatttacaagggtttatgccacatagctatggatttgggcccaatatttgaccttatagcagctctaaaagattagactgcagttaggaaatgccctctggatctgatttttaaacagaaccaaatgcattctactcttttctgcttttaagagtaacactgcttgaggatgcattgaagccctgctagacatctttgctgatatttgcctttagcattctttctggaggtatttagaccttaataaactaccattatcctttaaaaaaggactgaagagaataatatttgtagaaacaaaataatcaaatacagtcctacatcatttaatgttggggatacgttatgagaaatgcatcgttaggcaattttgccattgtgtgaacgtcatagagtgtacttacacaaacctagatggtgcaccctactactccacacccaggctacgtggtgcagcctattgctcctaggctacaaagctgtgcagatgtgactgtcctgaatactgtaggcagttgtcacactgtaagtatttgtgtatctgaacatatctaaacagaaaaggtacagtaaaaatgtggcattataatcttaggggaccaccatcacatacatggtctattgctgattaaaatgtggttaagtggtacatgactgtactagcattaaagttcttccgaactgagagggtggaatgggaacaggtactggcttcttgttttaagggctgactggtgaggaaggtactggcttcttgttttaagggctgactggtgaggaacttgccacacagagcagtaggctcaactaggctgaagacaggctacagataggctccagggttgacccagggccaagatacagcagctgccttgtcctggctcgctgcagacttggcatctccagtgcctgtatccctgaatttgtggttgaacttaagtttggggagtcccagtggccctaatgagactggaaataccaccctaaacaacctcctttagcagctaaactgacaataataatctgttgtttactgcacaggattgagatgagtgtagcaatctcctagacgaagggccaagctgctcacccacctgggtggggtggtcagtctagggcggcccaaggggattcttgggtcacgatgaccctggggctgataaccaactcacaaatacataaatcaacaacatgaggctagcttctgctggggctttgttgtctggtgggcctgagttttaatcccggctgacctcttactaagcgattgtgggtaagtcattctaatttttttctctctgagcctcaaattcctcatctataaagtgagcatgaaatcctattctagtcattctgagggacaactgaagtgatatatgtgataatatgaaatatgatagatgtgatatatagaactgtaaaacttttaaaaagtaaaatgcctgttaaattgttaaatatgtgtaatatgtgaaaaactcctggcaaatatacctactaatatccatttccatatagttcttttatataaaaggtagagcagtatatgtaaaccttctaataaaacacttagctataactatgaattctcatgtgctcttcctgctgtcagcctctcctcctgctgttaaatctttgcaaggcctcctctagttgttatgttctgaaaagattcaagtttgtatcctagacttcaaagttatgtctctcctatgtggtgtgtagtgtatcaccctgtacttggaggtatgtgatacaagaaactaaggaactaaaataattcttttttttttttttttgagatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaatgagctcaagttatttcatccacagtgatagaatgttccccatttgatgcaagcagttaaacttaatttccattaagacaaacacacaaataacaatcctccttcccaaacttgaaatcccacttctctttttgaactctcttcatgaagtagtcccttttcttgcatttacaacataaagcctaaaccacaaatattggagggcaggggttgaggatgagcaattgagatgttcctcatgcccttaaaccaagagtccttatgttctctccttcctaaggatggcttattttcctttccatgaaatgactttaagggtgattatatccaaagggaagtgacgtttccccttctttctcttcagttggtccattttcacagcccacaaaagcaagtctctattttgggacttgattcaaagtctgaaaaaaccctaggcacatctttcttccttgaatatgttcacgtgcatattccaaaaaaggttctcattgctagttaggccattaattttatgtgatatccaaatcaaacagctgctgtactgtttaagctcagatcctaaaatggcactttgaacatgaaagtcgtggctgccactctctgggtgactatctggcgatgacacttctacctttgtttttggcttgacgtgcatatgccgaaggcttcagcaaacataaactcatacaaatgtttgtcaagctgtgtgagcctaaacagctcattagttgcaagaatgatcagatgggagatgggttgcccaatttggatggtgacctttatgagctctcggttggattgcagatttatgtgtcacagtatattggaacataatgaatcctgtggcatgtggatggtaaaatgcagggcagaaactgtgcaatgaagaggcaggaagaaggtggcaagtccaggagcataagagcagttaatcatctcctttcccccttcccctattctgcttcccctctgttctcggggtgcccattaaaatgcagttggtaatgaaatgctgtttgaaatcaaagttgctgaaacgatattgtggatattgtggaaatctgtcatatttattttaaggatgagcttacttccaggtgctttcagtgactgcagccccgttagttcccatgcattgattctctctcatgtccctgctccagggtaattctcttgtgctcaggcacatgaccttctagttgaaaacctgcccctgccatttctttatgtggctgcggcccagggagcttgcctgccctgcgtgagcaggttgcaatgataatggttcccagtgctgctcagtggggaactgaagtcatggtattttccttcatatcctcttgaagcttcattttgtgaccttgtttcatcctgctgaacctatcattggaattaccccaaaggtggtggcaggggagtccccagaaaggagtgccccaaactttcccaagatggggcctactgagattccaaagaaagaagcagtaaaagccggagtgatcaggccaaagcattcattaggggaacttaggcagagtgggctgcagcaatcctgcggcggcagcatgaaaaaaggggtcttccacctagaaacatccacagcgaggtgctcaggggatggagtttacatgagggtttaaggaatttggctcagggccagggccagtttctttcagtgttttgggcaaaagcttagatacctttatcaatgtgtgggaatgttcaaggccctggtttgggttcaagcctgctgggaaaaacctgcagctgtctgggtcacagagcggtcaaggcactctgtgagttttggtcacaacagaaaggcaagggctctaggggaccctccagaactacaggctccaatgtcagccccactttcccaagtacaaatttatttcagaaattaaagtactactcttactttttcacacatttcgaagtcatgtgttgacatggatagcctgtctagcacaggaaaactctgatctatttaactgatttaaaatgtttataattgattatctggataagtgtcattgatggcactccaggtgtgtgaagacgccactggcctgggaatcacgacatgtggggtttgtcccagatccctgccatgccatttaaacaccatgggcctcagtttcctcacagcaaaaattagggttatactagatattctccatggaccttgtcaagtattttttgtgatgctgggattttataactaacacaggcaaacaataacctagaatgattagaatcttgaaaaaattgtttgtttgtttgttacagagaatcttgaagttagctgaagtctgtttgactttcttccggaatcagcacagtccaaatgcagccatgacttctcactgtcagaactagacgggccacactgagaaagaatgtggaccggctacccggaatctggccgcttagtgcattcaagaatgctgcttggtttctatggctgtgatttccaagcattttctaaaaggtttatagaggagaaacctaagtgcctgccaccaccccaccttgaagtcaaatttccctgaaggcactggagcatagggagaaaaacatcagctaactcttgccgctataggcctgggttaaattgcagctgggaaattcattccagtggcttgccgggctaaacacaattgtggatggagcctggagaagcatccaagcaaacaaccacttgtgtcagttcagttgtttcaccaaaaaagcaaaataaaacagattttactaactcaattaataattcagttgccccataaaatatagcctcactgaatttcttgtcttgtcttccaagacattaagtcagggcttatttatagccatggctctcttccctggctaagcatccgggccacctgccccagcaggtgagcccttggtccaaggtggtcctggactcagcatgtttttcagagttctccaggtaattccaatggttagtcaatttatcattcatttggggctgattatcagtcttccatgtggataaaaccagttaatttcctgtggatcttttttgaaagccttattaagaggagggagccctgttttgaacttgtgtcatgagctctgcctgtctctggaggtggcaagggtgctcgtcttcattctggtctgtgtcgcatgctgtcttcctctgtctccctactctttctcaaccttcttatttactattccacacactcgctgggttagacaaccttttctgttgttctgctgaaggttacaatttggagtcgattcctgtagtcttcctttttctattcactttcagaaaagatgttgcaaagtccaagtttcttcctcatgttccgtttctctggggagtgctgtagaagtttccataccttcctgcttctggccttcttagtattttaataactcctgccttgttcccaggtttctccaagtatctggggaaagtagaaacctcagagatggggtctggaaatgtaaaacgttgatgaatttcagggtcacccttgtgaaagctattgattggtcagaggtattctggaaaagtctgcaaaatccagaagctaatttctattttaaaatacaccctataactcttgagtgcccactcatcctcagctggctctggggaatggtgtctgagctcacggtctcatctgtgggagctgcatctcatcaacctattttggaaaccagcatacttctggttctgagaattcagcttaaaaacaatacctagtttcctgtataatccccccaccaaaaaaaagtttgcaatgtgccccatgtctatctgacacattttcacttgtttcttcattgatgatctaggtctgtccaccctgctctatttcttttctatttatctccattatcttagtctatttgggctgctgtaacaaagtaccatagactgagtggctcataaataacagaaatgtatctctcacagttctggaggctgggaagtccagaatcgaggcagtggtagattcggtgtctggtgagggcctgtttccaggttcatagatggtgccttttcaatatgtcctcccattctggaaggggcgagggagctctctggggcctcttttgtaaggggactaattccattcacggagattctaacctcatgacctaatcacctcccaaaacccctacatcttaataccatcactttgggggttaggattttaacaaatgaattttgggagggcacaaacatcagtctgtaacatccatttgatgcctacttcaaaattttttgttgctattacatcaaaatctcttctggctttttctgaaagtggatttctatgtaaccactttttcttttcttttgcattatgactgagtttttcttcttaagaaaacaagaagcacgggtagatgatggagagcatgagtgccagagagtaaggaagcctgggctcttctgccagattttgtgttagtcgaaaactgaggacttggagggttgatgagctgagcttttcgttggggctcctctttcccatccatgtattgttccagcagtacaaagtttgtcaatcagagagaatgtgggttcccatggcaaggtggcttccagttttcatactctgtaaaaggcttagtgatggaaggagattaaatgtaatgctttaatgtggatttaggtagagatcttgtaccacagaaaattggaaatcaagggtgaaaaactgagaaatggagtgatgtctttttcttccatacaatttcatatttgcaaagtaaattaactctaaatagtttagggttttattccagaaatctataaaactttaaagaatcttggcatctgattgatttttctagtttatgaaaaactgacaatattctaagccaaagacacattcaacataataatgcaggttgagtatcccttatctaaaatgcttgggacaagaactgttttagatctaggatttttttttgaatatttgcttatttacctgttgagcatctctaatcccaaaatccaaaatccaaaatccaaaatgctcctgtcagcatttcctttgagcatcatgttggtgctcagaaaatagtgaattttgaagtatttcaaatttcagatttttggattagaaacctacatatcaaaaaatattttgtgtaatgtcttacgatgtgtgtgtttggagccttctcagggttaagcagatatgaaaagcccacgttttcaggaaagaatttaagaaaataaagggccaacattttttccctcctggctccatgtcataatatttttgccggctgcagagtctattcttttctatcttcagacttatcactatcaagcattttccattccccacaattctcattttttgttatctttttgcacttgcaaaaactgaaatttggcttgaatgagacacatttccctaccctttatctctcactgattcattccttgaattgggacaaatctttctaatctaagccagtttcatcctcttgcaatacagtaacctgtgtcagcagagtcctgtgtgggatgagtttggcagaattgcagactgcatttttggacctagcagttgaagatgattctgtccctcatcaatttttttccgcaagggcacttttgccttcaaatggtattgtgtttttctatttcctttatctaaagaaagtcttcaacttagttttgttctgttcctgtgaatgtcggcacaggaaagtccttgaagaacatgagaaacaggagcttcatctgggctctgtgatggtgccgttgtatgaattgaaatccatcagggtgggactggttatctgtctaacaaagatgcaatgagacatgattgagagtgtgcttcgggtggagtgtttcttacattttgaggttaaaagccttttctgtcattgtttttattatttatttatttatttttattagagatggggtcttgctacattgaccaggctagtcttgaactcctagcctcaagcaatcctcccccaccttggcctcccaacgtgctgagattacaggagtgagccaccgcacccagactctgtcattgattttgacaagtttttttttttttttttttttttggttgttgtggttttggaagttttttctcagaaaggacatacttgactgaatttttctcagagcctaattattatttagttatttgtatttatttctttttgatttcactacagtagccactatatcttgagtaaatttagcttttaacttgctttatgttttggtagatcttagtgattatgcaatttgatgatgccattcaatatcaaggtcagaccacagcatgtacaagaggttgctgtcacgtgatagttttccattttcatctcttagtatgctctcttatttcttgctttgctcattcaatgaatgttttaagagtctgattgagatattacctcatagtagattactttcccattaatgtttgctcactcatctgtaggcctaggaagctttatatctatttacaacagcgactaggaccaatagtgtgctgttaaatgcttaggaaccagttctccaggaaaaaaaagtcctgattggcaacgtctggccatttccatagtgtaaatctcccactgtggctgatttccagctatttctggtttaacaagtggctcacaaaattcttgaaagtttatcaactggctttcaccaggaggatggctccagcacccaccacacctgacaacagttatattactttacggatgataaaaagctttatcatcgttttatttcatttctgatttacaaaacaaccctgtagagtaggtggtgttatacatgaggcatctgagactcagaggcctaagtggctggaagtagctccagcagctattattaggcagagcagagacggaatgctgcctctgagctgagcattcttggtgttctcatcactcatggcaactgtttcccattgtgaggattcccttagtggtgtcatatttggactccaaagaagtatactcaagaaatgactacttcgatggttttagcagataatttttagttatttgaggataagaataatagtctgcttatgaaagaacttggtaaatttttttcttctggttttcagacaccatttctgtcttaaaatgaagtatctggtgtatgattgctttgtaatattttgttacttaagggtggtatccagacaacccttagttaatgttatagaatcagaactagaaagacctcttcattcttcacttagagaggatttaagtgtctctggccatttattgggttaataatggtgacttcaggtgacccaggaaacatctggatatctttgctgcacttggaaagacatttagtttggtaatattttcaaatcatgtgatcatttcaaaatgacttgcaccatggagtgatgatgtgatgctggcagcagctgctgtttgctggagatttcgtgtgtcaggcacagttgggaatactttatgaatattagtttatttctcaccttgaaggtagacattgttctcagtttgttgaaatcgaggctcatgtaagtaaaaaatgcccacattcatagcaaataagtgacagagttagtctctgactctgcaaaggacttatatggcttttgtataataaagtcggtcaccccattttggtaataaaagggataataaaagaccaacatgtcttcattagcttgcagataagctccaagtttcagcatgtgcatagtttgtaatgccttcacagggtctgcaggctcattgccatgaaaatatagaactaacaagaatttagttttgattgacatagtttataaaatgttcttttttttttttttttttttttttttttgagacagggtctctgtcgcccgggatggagtgctgtggtgcgatcttggctcactgcggtctctgcctcccaggtttaagcaattttcccacctcagcctccacagttgctgggactgcaggtacccgccaccatgcctggctaatttttgtacttttagtagagaaggggtttcaccatgttggccaggctggtcttgaactcctggcctcaagcaatttccttgccttggcctcccaaagtgctgggattacatgcgtgagccaccgcgcctggcctaaaacattcttttaacaaaagcatagctttatgttgaattcaggtagattcgaaccattgcttttaataacacaatatgggttctttcagactcttggggtagattgaacttctcataaaactgtcatgggacagattgcaacttctttccaatatcagaatctctaggtgagttcatccatttctttgccctgggctttttaagaaagtagggcaatgagtccctggtttctcatctccgtaagaatgaaaggatgctggagccaaggtctagtctactgccagtttctccaggaacaatgtggaggaaaaggaccagtgtagatcagaagtccatgagcggaaactcagaatcaaagcggttattcaattcttcttttcttggaggaaatcactgtgtcgcctgaagagaaaaatgccctttgctcttgcactggggagttctgtttagtgcctttccacacaaaagggctgtactggctggtactatagactttttttatgaagatctttttcataaatccttttgcagagtatagccaggtagcagtatatgaacattggaagtgaaacagttttcgtcacacaaaattaacaataaaaacacatgcaactcatcatttataaaacgatacttgcaatttttcattattctcatttctgagggcaaattttcagatgaaaacagaaaggaattttagaagttttcatttttttttcctacatcaggcttccctatatgtcgtctgtataacaagcaccttgatctttcattcagttataagaggctcataagcgttgcctctgttttctatatattggtagtgtcattagaaaacctgagggggtgggccgggcgcagtggctcacgcctgtaatcccagcactttgggaggccgaggtgggcagatcacgaggtcaggagattgagaccatcctggctaacacagtgaaaccccgtctctattaaaaatacaaaaaattagctgggtgtggtggtgggcgcctgtaatcccagctacgcaggacgctgaggcaggagaatgacatgaacccgggaggcagagcttgcagtgagccaagatcgcaccactgcactccagcctgggtgacagggagactcgtctcaaaaacaaaataaaacaacaacaacaacaaaaaaatctgaggaggtggacaccattttttggtactgaacgacgtgatgaccgtttaaaaagaaaggtagatgttaagaaggcttccttatacaaaaattcttgtatattgttccttccaattttatttttgttttgatatataaaatcctatgttaaatctctcatcctgaatatcagattactccagaaggagaaagtagcagtctaattattttatttggttgcatggtagtcttagtacaattaaatctcctttgaaagtttctcagttatgtagttatgaatagcactccacaccacggctgtggtagacctggagcggtattgggcccaggtcacagaatgatcacggaaggactttagagatcacctattgagtccctgttttagagaggagcaagcaaaggcccagagaactcactccatttgccgaggtccgacaagtgtgtaggtgagctggagccagaaccctgtctttcggtcttcactctagagctctttccaaacaaacatgctgacctgggagtctgacaattgctgtatgctgatgtttcctatttgaagtccacatgtctttgcaggggaagagaactgtctagtatcattcgttaatgcccactcttcatgtttgccaaagaccaccaatacattgggcagtgattgtgttacactggtttgtttatatgtcggctttcagtgatgccagaaaatcaaaaggaggttaagaaatcccagaggttcacccaggatgggaggctaaacctttgttgtattatgagtcttaattcaagataacataatctttagcctaataaacattaggttgaattttgaaaatgtaaacactaactgatctgtagactgacgtctatttccttggcaatattggccacacccattaaataataacttctcattctcccttcccccagcctctggcaacctctgttatactttctgtctctgaatttgactactttaggtgcctcatataagtggaatcacatgacatttgtccttttgtgatacgatattttctttaaaaagaaaatgaacagaaacagtacatgagagaagtcaggtctgcagccagtgtgcctcttagttccatattcatacaaggccctcttggaagctcagctttggagttggatattatctcagaagatatggcagcttaggaatctggtactctaaaaacagatttacaagcattagacttttttgtatatgtgtgtggtcattttagtcttcctgaaagtggttaagaccaatatttctaggcagactatagttcacatcatccagttctgtaagtcttggattatcgatctcattgtcatggcaaaaaaggacagggattactcaactcattactcctgtgtccagacctctgagcctggtgtgtgtgtgtggctcagtgcctttcccatagtggcccacatccccccagggccctgcatgaagttcctgcaagtctaccccctgcacgtgcagagcaaaaagagcttcctatgggagctgttctccagaaaagacagaaacccgggccctagagaaccagaagatttaaattccagtttcagctctgccattgactaattaggcaactgtaggcagttcactttgctcctttggaccagagatttctcatctacaaaatgaaaaacttggatttaattatctctgaagtcacttcaagcagaaatgtaacaattctttgatttattaaaaaaaataacatcaatgataatgaccaacagctaacacttattacaaggctccaggcactttcgaagtccttaatatttaatgttcactactaccttaggatataagtactgtgatgcagagtcctggacacagagaagtcagcaacttgcctgaggacagcctgcaggacacagcactgtgatttgaacccagagagtctgacttcagcccccagcgctcaactactattaattgaaagggcattgaagagacatgatgtcacaataaaaagaaaaaaagaaaagaaagcatgtcttcgactttctagtcgtcgtgctttgtatggattcttctttcaaccttgacgaaagggtataattaatctgtaattaaagtcatgatagtttcttaatacgaggaaatgttgtcattgcggttctctgaacacaagagggcgctgtggcaaagcttaccgtctgctcatcctctgccgcaggagggtacaacttcgtgggacaaacttcaaaagaaagatgccatttctaagacctcatttatcacctcgggatagccagtcttcatgcctttaaaatacagaataaaaataacacataaatcaacacaattacattccttcttgatagcatcaccagtcttcttgaggcctggcgtcaaacctctgcttcagtgttacgttatggggtgcgcatgcctccttaatacccaccttgctggtattctccagatggctgtcttcttagcagtagatggaattaagcaccataatgagggatattttatttaaatctgctttaaaaaaatcttccatgacttattcacatgtctggttagctatcacactgccattccatgtgatcggaaatgagaaagatttaaagaaagtaattgtttagcatgcaacggatgtacctcttttgcttcagatgagaataggcagcatagaagaactggggctgattcgtggaaggtttcccgtagctagaccctggaggctgtaaaaagtggtttggaactgtgtttaaaaaataataataatagagggaatagtgaggtacccaggaggagcagagagcgcctgttccagccatgggagcatccccatcagatacatagatgctcttaattaattaggctgctagtaaaccctcctgagtgtgcaagacaggaggaattcattttcaagctttaaaaaaaaagatgagtcttgggcacacagccctgtggcccatttgttattgtcttgttacccataagtcagcagttttcctctcctgttgttgatagatcttcccatacagttagatttgtttagaaagaaaagttttaagtccttgcaaatgattacaaactgaagaactggaaaccctggttaggaaacaattggagcactatgtatggcttaatgaaaggacacagtctttttaatccaccaagcctgaatcatcagcttggttaagactatctgtagaaggtgagcagagcacttcaaacctggctattcgcaagggagagaaaaaagctgccactgtccccttagcattcctctgctaatcttccatttgtattgcaataagtgtgctttggcattgagtgtgttttaaagctcctgcttagctggctgggggacaagaaaaaacaaaacctcaaggacactcccactcagaggcataaaaaaataaacagttgtttctgcttttgagaagaagtcacatgcatgtggctggcattctcaggtgggcaaaggagagtgctcggtagcacctgccccaaaccctccgttctcccctttttaggtcggaagagattctgctttcctatcttgtctccagttttcactcttagtccgtattttccctccccttttccactctgtccttaactcctctttccctctttcatcgttttcctttatttttcatctctttctttattccttctcaagggtttgccggtggttttgctaggcaatactgagcttcaaggccattgtcatggaagtttccagtcctgggatgtgcttagaccagcctttaactatgcatcctcaaaacagctggcagcctaatcaaaccttattttttttctctttgtgagagaggtgaagaagatgataacatgaaatgaaatctagggcctttagaaagagtcagcaaaccaggcgcagtggctcacatccataatcccaacactttgggaggctgacgtggggatcacttgaggctaggagttcaagaccaggctgggcaacatagcaagaccccatctcttatatatatatatatatatatatatatatatatatatatatatttagctgggcatgatggtaagcaaccatagtcctggtcactcaggaggctaaggcaggcggattgctcaagctcaggagtttgaggcttcagtgtgctgtcattgtgccactgcactccagcttgtgtgacagagtaagaccctgtctctaaaaaggaaaaaaaaaaaagagttaccggttatacatttttgagaggagcaatggggaaatgcaatcatggggtaataataatcaggacaagagcaggggtatgtactgtcccccaccctgctgccctaaatgcgaggaagaagccacgttgctggacccataatgagaagcttcagaaggttgatagagagtgctgatcttgaagacatttagtctgggacacagactacatatcagcatgtcaaacatatcagcttgcttgaatgaatgagtgaatgaatgaatgagtgaatgaaaagtggtgaaggaagaagatggttgggtttgggagaagaatatgcctgaaagatatacaaccaccggggagtctgtcttgtctttacagatacttaactcgggaacagacttgctggttgtcttgagtgtgaagtgcaaaaagtaaaaatggccctcaacaaaaatataagtcaggcctgtgttagagatgtcaaggatgaagacctttatgatgatccatttccacttaatgaatagcgtcttagtccattttgtgttgctataatggaataattgtggctggggaatttataaagaaaagaagttcatttggttcatggttctgcaggctgtacaagaagcatgacactggcatctgcatctggtgagggcctctctctcttgcttcctctctggccatgtgatctctggccagagaggaagcaagaaagaggaggaggtgccaggctctctaggggaactaatagagtgagaattcattcacccccgagggagagtattaatctgttcaagggtgacctgcacctatgcctcaaacactgcccattgggctccaccttaaacattggggagcaaatcttaactttagctttggaggggccaagtatctaaaccatagcagagtctctttgtgatgatcttgagatgaaattgtttgggccttggttcctgagaggggtcttgccttattcagcagtcatatttttttctagataaaattcttactatcctttagacctggggagagcccgtgtatgaaaaacagaacacaaagctgaactttaaataggaaaaagctagcaaagggactacctctgggggcactacttgagcctgtaagcagtggttataggagatctgagagtacgggggtcctagagacaggtcagttcttagggtggggcaggatataagaaagggagagtgaggaaggctcagaagatgaggtttgaacacttggccaccattttgcctgggatcatcaggggaagctcctgatatgggaacatcactcccaggcaggacaccaagaggcaaaggccagtgtgctctatttagtaagaaggtaagataagggccagtgtgataagtgcatggagccccatgggcatccaattaataaaacagtgatggaccactacaatttaaagtcctttcttagatgagctaggcaaaaggttctaattagagatacctgtcttcccctcttttccctataatgcatccaaagatctcaggtgtaatagatttgcagcttgtgctaagtagttggccagagtgtgctggcttctgtgacctacgtctctgagcggcccgagctgtctgttggtgttatcctgagctcgttgtgggaaggcggctggagcagggtgtgctgcccatctgtggctccatcagtttccataaggcttcagcttgatcagtgcagcacgaactgtggcatgtttggggcttgggagattgacagccccccaaaaagccctcaaaacatggtcaagaggacaaacgagaatgatagacatatcttcactattgccagcctattaacctattacaaactctgtttttagagattagccattagtttttccttccaaaattattatgctgttgtcatttcctccacaaactgagatatgcctggtgaaatgacttaatttaaaaagtaatttagattatattttaaagaataaatattttcttcaaacttatctgattttcaaacgatcatgactttaattttgctctagtaatgcactttctgagaataaatgggaatctcagttttgtaatatgtacccagcatttttcttcttacagctattgggggtgcactgttggggatgtggtgggggctggacctgtgtggaatagggcagatactgtgtgcgggtctccacttctcaaaggagcttcaaagctgactgcactcattgatgcagcgagcccagggccttgtgatgttccctttcttgttggttggtgctggaaagtctagagtcacagactccttttggactaggctataaatgcatatatactttgcagagcattgcctattagtcgccattctctcctcagagtgtaggcaggttccgagggcagcacctaatgtgggaagagagaatagaaggttctggggaaggggacccactctgggcagagggagaaggataaggaggtggtttggggaagaatcacaattatccttactttaattaatacatttccttggatggcaccaacagcgaacacagccacacactcttctgcccatagtgctaagcgggttctctctttgactagaattgtgtcgttgatgtggaagtgcagttgaattcaaacgatctgtagctggtggcttttattcctgaagttcaaatatagacaaccctcttagcaggttctaccatagttagccaaccatgtgttaatctccgcctctttgtcttctgtcttaaaggaagtcaggccaccctaaatcgcggcctctcatgtgtgcctgactgtggagagtgtgattttccagcagtctctgggtctctataatgtttgaatttgcctttggggtgcatgcgtgtggtatgtgtggcatgtggggtcaggggtggtgagaccagctctgaattgtttccagggcagcttggtggcaccctggccagatcctgcatgtgacatttcccaacaactctttctggtctgtgtctcacctgtcataattcaaaggagagccatggactgtgtgcgctagattcaccttcagagactggagagtcccatctctgtaccaccgtggacacctggacttcctctggctttctcttgggaactctgccaggcagaggccctcagccgtgcagtgggacagttctgtgggcagtggcaggaagccttcagtcggtgaacagcgtgaagacagcctgatgcatgcaaggcacggggatgtgattgtgtgagcagatcaatacctatatctcaaaaatgagaactttcactttagtacttgatcacttaccctattgaattatgtaagtacttcagtctcttcaacattggctttctttcattctttgtttttttaatctcccatcttagtaatgaaaaaaaatgtatgtgtcatgtggttcttttgtaaggttatttctctccatttgcttgaaaactttcttattactcctaactccttttattgatttaatgaaaccaaatgctcctgaaagtttgaccctgatctagtgatacctgcactctctaggtccctaaaagaccccacagtctgatgctttggctgcagatggagtcacagagatgattcagctttaaagtgtctacatcatagattggaaaatgcctttctagggctgaagttgtagctgtttcctagacttctgtttattttccatttctttacccactcctgtttgaaattctgctgttgtttgcatactgtttgcctttgtgtccctctttccatctgttcttaaaaaaaaaaaatcaactgagttttattttaaaccaatccagatgacaggcacacagtcttcacaatgctttggaaaccagttgaagaaaattctcgttaaattactcatccacccaactcattttccatacatgatctattgttggggtgcctgcctgttttcaagataagtgcatatttcagaggcaggttccttttaccccagataagcaattatttaagaaattggctttgacatacattttcagttttaatttttccttttacattctgaaataatctctggttgcatgtagcttcccactactgcatataaagatgtattccaggcatccgtcaggagtttgtctattccatgaagaagacattgctgtggaagaagatggtgggaggcctgatgtcctttctgtgcagccctgcaagggccttcacctccagggcctaatctcacaagcaccgactctgcactcagatttccgacaagaacttccgctgtaaagtggccatgttaaggagaccttgggaagaacaaacccattatctgatattgagtcactatgaaagatttgggagtctttcccattagtgccccggtaagagaggcacaagaggatcatgcaaggctactaatctccatttcaaagccaagaagaggtcatcgatttatagtagggctgcagatcagaagcaaagcagacttcagcctgatagcagtcaaaagacttgtgtttcagcccctttctatgatgtcctttgactagcgccccttcctgtgtccctcccctgcattccatagcattgggtcttctacaagggaccaattagtgatttgaaaaccaaagtgaatagagtacttataaaatctggtggtgcactcacaggaggaaatgagttgggagggtttaggaattgtaaggacaagtttactaatgagaaggcaggttaggaatatccttaaggaaaatgcagatgacaaatttccagctgtcaaggaaaacgggttcaacctcataattagatcattcgcgcagagccaaggaactgcaaaacacatggatcttcactgccatgggagactgactctaagaagagaaagttgtcagaggggttctgtgtggaaaatgtaattggaatccccaaattatgacttctatcattggaagagggcatcttaaataatttttttttttttgagacagagtcttgctctattgcccaggctgaaggctgaagtgcagtggtgtgatcttggctcactgcaacctctgcctcccaggttcaagcaactctcctgcctcagcctccgagtagctgggactacaggcatgcaccaccacgcccagctattttttttatttttagtagagatggagtttcactatgttggccaggcttgtcttgaactcctaaccttaggtgatccacctgcctgtcggcctcccaaagtgctgggattacaggtgtgagctaccgtgtctggccttaaataatcttttattttttatttttgagaaaaagtctcactctgtcaccaggctggagtgcagtggcacgttcttggctcactgaaacctctgcctcctgggttcaagcgattctcctgcctcagtcccccgagtagctgggactacaggcgcacaccaccacgcccaactattttatttttattttttagtagagatggggtttcaccatgttggccagggtggtctcgatctcttgacctcctgatctgcccacctcggcctctcaaaatgctgagattataggtgtgagccaccgcgcccagccaatattcttaaatagtgatgttcaaacacatggcctggccaaagacttcctaactcactctcattgatttttgtcccttccattcaaaaacacttgttttcatagtcctgtgcttcaaaacgataaaacaatttaaccctgtattaaccatctgaattattaagaataccaggctgggcgtggtggctcacgcctgtaatcccagcactttgggaggccgaggtgggcggatcacgaggtcaggagatcgagaccatcctggttaacatggtgaaaccccgtatctaccaaaaatacaaaaaattagccaggcgtggtggcgggtgcctgtaatcccagctactcgggaggctgaggcaggagaatggcgtgaactggagaggcggagcttgcagtgagccgagatcgcgccactacactccagctctagcctgggtgacagagtgagactccgtctcaaaaaaaaaaaaaaaaaaaagaataccatagcattaagtgagataccaatgaagacatgaaaaaaatctccatcagaaactagggtggagacatcgtaagccctcaggatccaggcagagcatcatcaggatgtggccatctggttctctgccaaccttatgctgtcctctcacttgtccaacccatggatatcaacattgatagaaaaatcaatctctatctttgtaaaatctgccctgtctgtggcaagctgaatttttattaagctgtaatgtttggagtagatgatccaggatgctatggtcagtgatggggagaggagaagactctgcagctgaacctgtggggatgtgagccaccagcccccggccctggtgagtgaaggccacctgtcagctgagtaaggggacatgagccaccagcccccggccctggtgagtgaaggccacttgtcagccgagtgttagacagccaggggctcctcatcctgctgcctgggcgctctggcaatgtctgctgctgtaaggatggccagctgcctatcaaggtttgaaatcatgagcagtattgaccaccccttgggtacttgggcaattcacttccctggccttgacctcacttccctggccttgacctcactgttttctcatctgtaaatgagaaaaagagttgagatgatctataaatttccctctaacacatctaggtctatcattatttaaacatattagtttgaaggaactaaactgtactccctctgaattaccaagtacaaggctccatggtcattttcactctcctgtctggtgacagcaggtgtggcttggctttgctcttctccttccttccaactttctcctaaggtctataatggacaacttagatcattcacaattcccccacacagtttggcttgggaattggggccgcaaataaagaggacaaaagagggaaaaagcataaagcaaactgtaccagaaggtatgtgaatggcgaggacacgttggctaatggggccatggtgtagcccattaactcagcttcctaggaatgctcttgaactagtttctatttggaaatgactgataaatgtgggctgaaaaggcccgagagccccaaaatacagcaaggacactctgaaggaccccctctgatatacttgggatgtgtgtccctgcccaaatctcatgttgaaatgtaatcttcagtgttggaggtagggacctggggggaagtggttggatcatgagggtggatccttcatgaatagtttagcactatcccccgcattgtactgtcctcacgatagtgagttctcatgagatctggtcatttaacagtgtgtggcacctccccgcttgctctcttgctcctgcttttgtcatgtgatgtgcctggcctctttttgccttctgccatgaatgtaagcttcctgaggcctccccagaaaccaaggagatgccagcctcatgctgactgtaaagcctgcagaacaataaaccaattaaacctctctttttaatacattacccagcctcatgtatttctttatagcaatgcaaggatggcttaatacaccttcccatctcatatgtcttttaacatcttaagttcatagcaagatgtagcaacagtggctgcagcctacagagcaagcttgccttttgtagaaatggtgtaattgccactgacccgtgatagttgcaatctgggttttaaagctttgtgtctgaacactccacacgttttagcattcctgaatcctagaattcagtgctgcaaatgagtttcaagagggtttatggttttcaggggccatagcaggctgtctctgaagccacaacagaggtgggcaggctacagctggagtaatcatgactgattcttttctgctgctgcctcagtgacaggtgtgtggatttactttgtccctcccacctttctttgcttcccaccctcattgttaatggtaaagcaaaggcttagggtaatgggcagggtgtgtacagggtgcccactgctaaatggttccacctgggtggagacaggcctgatgggagccacagaagagtactgatatcatagccatccaaagggccactctggagggagagcggagagcagactggggttacatgatcagtgggtcaagtcagcagtcacaaggaaatctccccaacaagtaaagaactaaaaattagaaggggaagatttagtttaatataaggacccatttcttatcaagagctctgtgacacctaccattctcaggggtggctcacatgagcccaccttcttactgcagaggccaaccttgtacagccaggaaaatttactggatgttcacagacatctttgttgtatattcctgacataggttattgacaagcactgttacggttttgagcaccaagagaaaaaggtcatgttgtactagtgaatcaacataagtgtaatggctaaattcaatgtacaatgggactataacttacctcctttactgtttaaagaaaagtcaagatacacgcatccagaattttgtatttttatcttgttggcagagggaaaaaataagtattgatgtaatcccaccaagtaaaggttaaggtactcaagttaggctgcttgcattcaagtcctatttctggttcttactaaccagctttcaacgcaatacttgaataccatgaatttctggttcctcttcccattggtgttcagtggatgttaggtattaatgttattttaggtatactctatgagactgtatggtacagctgcccactatcagcctattggtggaacatatatgttcagatcagtttttttcctccatgtaactttgcatgattgcatttacatttaaaacaaaaaacacaactgaagaataggaatgcatgactgatgtgcatggaatcagcttatttcgactgaacagatgaaaataaaaaatgacttaatagctaaattcaaagatataaaatgagtgcatggtaaatggaaattgagtggtaagtatctcaattcatattcactgagggcaagatgaagacaaatgaactcaaattgcagcagaaaggaattaaacattaagaatcaaacttcttaacttcagaaaatagtcttttgaaatgtctgatgcaaagaaatgacactgataccttaaaacagttcattcttttattaatatttattaagcatattctatcaggcaggtgctgggctcggtgctgcagatacagtgatgaacaagacagataggcactctgactgcatggcccatagtctagttggagaggaaaacttaaaacaaagacacagacaggcaattataaattgtgacaagtgacatgaaggaaggtacaagagtgtgaaatggggcacctgaccaggctaggggcagggcacagagagaccgccctgaggaagtgacaagttcagatctgagggacagtagtaacagatggggagaaaagagcaccagaccctctgaacaagcaacctgtgcaaagactgcaaggccgcagggggttgctggcttcaagggatggagaaaagaccagtgaggtcagcagagatggggagctgagaggggtagccctgggttcaagacacaggcaggaaccagactaagcaggttcttgaagcaagtgaaggactttcatctttatataaagggcaatggaaagttgtcaatgtcattgtcattttttttaaatgccttttttactggagtgtaatatgcatgcaagaaagcacccataggggtgagctgggtgaatttcattgtgaacacatcaagcaaccagtaccaaatcaacaagcagaacattattaaccccccaaaagtcacccttagcccttccaagtcctcagcatgttccaaaggcaaccctatcctgactggtaacaacactaggttaattttgaccatttagaaactttatataaagggagtcataccatatttattctctgtgcctggcttctttcactcaacaacatgagactcatccagattgctacttatagccataaatcactgtgtgaatagaccatgatttaattatcagttttgctgttgtggacatttgggtagtgtctggctgtttggaacagtactacaggttgagtatcccttatctgaaatgcttgggatcaggagtgtttccgatttttttttttttcagattttgaaatatttatatgatacttacttgttcagcattcctaatctgaaaatctgaaacgtgaaatgctccaattagcatttcctttgagcgtcatgtcagtgttcaaaaagtttcaaattttggaacgtttcagattttgagattagggatgctcagactgtactatgagctacttgttgattctatttcacctgatcttcggtgtttttctaagagtggaatttctgggacttaaggtatacatatgttcagcactaatggatcctgccaagcagttttacaaagtggccatttcaatttgtactcccaccagcaatgcatgagagctcccttaaaaggtttgctatagccagtgatgtgatcagatctgtgcttttcaaagaccatatggcctcctgtgagcagaatgggctaaagaggcaggagtgcctggaaggacctgtgggggctgtgatggtaggtcaggcaagcagaagacagggaaaggccaggatggaaagaagtacatggacccaggagagatgggtggggaaatggctgatgggctcagggaatgttttgggtggggggcatggtgggcaggagaggggagaggtgacaagaatgaccctgttcaagacataggcaggaaacagatgggtggtctatgattggttagatggtagtgtttgaactctggagatggatcagagatggggaggtgtggatcataattctagtgcattaagagtacataatttgaggtgcattagctatgtccaagtgggaatcaaggaagcaattagatacagaggtctggactcagagtgaagtcccaatggacatgcaaactggagagtcattatagcaatatgggtgagtactatggtttgaatgtttgtgccttccaaaactcatgttgaaatttaatccccaatgtggcagtattgagagctggggcctataagaggtggttggatcatgagtgctttgcttttatgagtggattaatctattcatgaaataatgagctaatgggttatcctgtaagcgggactggtggttttataataggaagagagacctgtatgtagtatattagcatgctcagccctctcaccatgtgctaccttgagactctacagtgtccccaacagcaagaaggctctcaccagatgctgcccctcgaccttggacttttcaatctctgtaactgtaggaaataaattccttttctttataaattactcagtttcaggtattctgttatagcaataaaaaccagactaaggcaatgaggaaatgtcacctgggttgagagtagtgagaagaatgtctcattttgttatttcttagtttgagagcagttattcaaattaaagtttgaatatttaaaaaaattttgctcttgattttatttcaagttaaagcttcttaggcatgtgtttatttgtagggcagagatgataacactgttataggaccgacaggttcgtatgcccactgcacagtaatagacccattacatggagacagcaggatttgcagcagaaaaagagttaaaggtcagtgggcaccaagtagagaggggaggagaccctccaatccatcttcccaagttgttctgggttggagtttttaaggggatcatggagagcaaggcaaggtggggggggtgaaatcatcgggatgtggaaactgtattcttgggtgggtcagctcctaagggatccctcagaccagctgagtcagccattccctcagaatgcaggacctgaaggaatatctcgtaggaaaaacttaacgtttcatgatgttcaaggtgttatcaatagagcagttaaggggaactgtgatctagggtctatgtgattccaagacagtaggcagcaaacaactctgaggaaggggttggagcccaggctggcctcatgattagcgccgagtgtgctgcaagctgggtttattttcctttctcccctctctttcttccctgacgaattttatttaaaaaaagtttatagggatggtttcaacaccatgctgtgggcaagagaagagagataccttgttctctgctgcagggcaccacagtcaccaagagtggactttccctggcaacagggcctctgcattggtctgcttgagctgccataaccaaagaccacaaaccgggtggcttaaagaacagacacgcattgttgcactgtcgtggaagttagaagtctgagaccaaggcgatggcaagattgcagagctctagggaaggatctgttccaggcttctctccttggcttgtaggtggccgtcttctccctctgtctcttctcatggtcttccctctgtatctgtattagtgtccaaatttctcctttttattagaacccagtcatattggattagggcccactctaatgatcctgtttgaactctgattacctctgtaaagaccctatccccaaataagttcccattctgaggtcccaggggttaaggtctccaacagaccttttatggaggggggcacataattcaacccatccacactcccagccagggtcccgcttcaagacgagcacctcctcttccttcaccatgcactggggcaggtgactctaactagtgcccatttcgtgtctcattctggaaactatgccgatcagtcaaagtttccagagccagtgaaaatgttctcatcacacgaggcttctgaacacccagaaattttgaagcaagaacatgacaataatcatcactctcattcactgtgtgccatgtccttgcaagttcacagctagcccttacaacagcctgcacaggtctgattttccactctgcttcattgatgagcatctgagacgcgggagcataagggaacttgcttgaggtcacatgcttggtcggtagagactcagggtctgcgcccaggcttgccagcccatctccactcctccctgctgtgggcccagggcacagcggccacaggaggacttggctcttctttcaggctttgcgggcacagattagctagacagagtaaatatgggcatagcgattgttaacggctaacttttgggtgaatgcactattcttgccatctcaggctgatttatttgcagcactggtagtcagggtccctatagcaagggaagagataatctctaaatattccctggagccatgagaaacggccaggtaaagaagcatccttctttcagctggaacacggcgatgttttctgtcacctcaaatgaggtgatctccagaatcccctcaatcctgtctcattcattcaggcacaaaaaaggagaaacgtagttgacaggaattagatttggaaatctttcagagaaaatgtgtttgatttttctgtcccacacctcagcagtttatttcacactgcgcttattggtctctttgtctcacttctccttacataaatcctctgggtgtcgtttgaataatcaaaacgtattagatatgaaacataatgtgtatcatgttgcatcatgctactgtacctgcatgttgtaatttgtaccttatttgctgtctatgcaatgaaaaggctttcaagtttttaggtcagaaaggtttaatcactgtccctagtcaggtttgcagcacagagccaaatggatggtgtgcatttggacctgcccttggaagtcaggctgtgattagctagggcaaaagtttccttatctaggtgtgaacgtggaatggcctgaaatgtgtggacagtctattatgtgttcatcactgtgcataatgatgggcctgtagggatgtctatgacacgcaggatacagggctgggcacctggttgttggtatcagatatgtaggagaagaaggaatgggtgggggttggagagaacacaagcacaagcataagacggttctgctcccaagaggctcattcgtcactcagtgctgtagacacacgggagctgccttagcacagagcgacagatgccatgagacaggcgcccactgctgatgtgggcagaaagagatgtgcaagcgaagggcaacagatttggttgctgagattaataagaggaatcaagaaatgctcccaagagaaaaatgatacttaatctgggtcttgaataaccattcattcattcattcattcttctttctctctataatattaattagatttctgctaataagtacctagaaatgttctaggtgtaggaaattcagcaatgaacaaaaaaaacccaaccctccccccagcaaccccttgccgtcgggagctcacattcctataggtaagtggtagtggtgtggagaggggctggcctagtgaaaggaacagtgccagctgttgcacagggacttgtgatgaggttggtgtgagtgggtggccatgtggggcaggtcagagaggaggcatcgagttgccaggtgctgggtcccacatgaggagtctgtgtgccaagccaaagagctttctcctgaaggcctcaaggggccactattggtctcagcaaggtgggaggtcatattgtcagacttgtgctgggcaggtgggtgcaggttagaggcaggtgaggccacaggcagggagcctgaggcctggtgagagctggtgagagaaattcaaggtaaggatgaggatttcaggatgagtctcacttgctggcttctctaactacatggggatggtgcaattgactgagggtaggatagaggaaaaggatcaggtgcaggagaaacatgatgcgttcagggttagccaccttgcttgtgaattctagaattctgccagcctcacctgagagcccctcagaagtaagaggggcttcttactgtggaggaagtgtcagaatgccaaccaaagatggccagctaaataaatgacatgcctggtggtctgacatgacaaatcctgagggtcccttgcccagggtgggtggcaggggaatggcagttcacattcaagatctaagttttgagagatgagaatcatctcctttggggtggggcagctgcattccacactcgggacccggccactcagtgcggggtgatggtgcagttcccagggactgatgtacctgctctgcagtggcaacctccgagtgtgagagaacccagctcttttttggacaattttgcatctgactcattgttggtatttgataacatttgttatgctaatataacaaatacaataacaggaaaatcagaaaatccatgtgtactcaatgtttagctcccacttataagcgagaacgtgcagtatttggttttctgttactgcattaatttgcttaggataatggcttccagctccatccatgctgctacaaaggaaatgatttccttctttttttgtggctgtgtagtataccatggtgtatttgtaccacattttctttatccagtctgcccatggatgggcatttaggttgatttcatgtctttgttattgtgaatagtgctgcaatgaacatacgcgtgcatgtgactttatgatgaaacaatttatcttccttcgggtgtataagaacaatagacgctggggcctacttgagattggagggtgggaggagggtaaggattgaaaaaccacccattgggcactatacttgttacctgggtgatgaaataacctctacaccaaaccttcatgacatgaaatttacccatacaacaaatcatacatggacctccgaacctaaaataaaagatggaaaaaaaaaaaaagaaaaccagaatataatctgagttctgtctttgtgtgatccggttttacaggaggaattaacctgggatgggggaaagaatgcatttagtgctggaatatataaggagaggctttcctttgtcccctcctctcttctctctcccccaggattttttgtccttccgtgttccacctgatccatggccaactggctttagaagttgttattaatagttcaccatgctcattttcatgaaacagagggaaaggcagcctcttcatttgatgtctagttagcaaaccagaggtttgacaccagctggtcataacagacatttttaataaaacttacctccaagttaaaataaaaatgctgccttagagattttgtcctgaaacatacgaaaaaatgacaggtgggatctctcatgcaaaacttctgctagggctaaaggaaaatatctgataaggttgtttgcccatgggggaaggattaattggattttctgtcttgcccctagtgtctgaccctctgttattatgacaggaccacagaagttttgaacgctgaatcatagtttatagttttagcatttttgagctatggagataagagtgagggaaggagtgtgataggggagtgagttcccacaatactccggtgatagttattgtctgcctgaaaatgtgaatacatatattcaagcccgatgtagcctgttcgaagcaacccagccgggcaatgaaagcctcagctgaagatcataggattaaatccaggctcccctctttcaagtaccttctcatgctactgcatttatgtgggtagtctgggattatgtctgtggtttgtttcactattttctggatcacttctgaaccagtccgtgtgtcagtcctgtggatatgcatttcatgaatgagactctgaggaattttctaatagtgtctatggtggcagtgggaaaaggggaggaggcagagaaagaggtggtagcaagagaaagaactgtgtggagctcgagctaaaagcaggagctaagactgcaagatcaaatgattcccactcagttgtcctagtctctgtctttgttttctgtggccataacagaacaccatagatttggtaatttataaagagcagaaacatatttcctcatcattctggagactgggaagttcaagatcaagggctggctcaacagaaggcctcttgctgcatcatgccatggcagaaggtggaaaggcagagagggcaagagaaagcaagcaagggggggccaagttgtccttttctaatgaaccccctcccacagtaacggcgttaatccattctagagggtggtgcccccatgacccaaacacctcccattaggccccacctcctaacactgccacattggggatcagatttccaacacattaactttggggacacattgaaaccatagcactcccctatagcaatgagtaatatccgcatagtgattttacttattaaataatattgacatggcttcctctttatggtttgctagtggtaaatcttcaaaactcttgggtagtttctgtggatataaattccaggtgaggttagttgttaaggaaagaatttccatgaaagaaaaacgtgtctgagttttgaataaggaaagacatacattgtgggtaactgaaatgccattttttcactcctccttcccccaggctctaaataccattgctgaattgaatccgtccagtttgcacgtgtgtctacagacatgtgtcttatggaatacaaacaatatgtgcttcttcttaaggttttgttactttgtcccttggtggtaagttttacaaaatgatttgaaatactcagcgctcaactccaaaagccaataaaacaggaggaagacattgggtatgatttggaaataagcaaaacagaacagacctgactttctttctctttcttcctttcttccttcctttctttctttctttctttctttctttctttctttctttctttctttctttctttcttctttctttccttctttcttttctttctttcttttctttctttttttttttttgaaatggagtcttgctctatcacctaggctggagtgcagtggcgccatctcagctcactgtaagctctacctcccgagttcaagcgattctcctgcctcagcctcccgagtacctgggactataggtgtgcatcaccatgcacagctaatttttgtatttttagtagatgcagaatttcaccatgttggccaggatggtctcgatctcttgacctcgtgatccacccacctcagcctcccaaagtgctgggattacaggcgtgagccaccgtgcctggcccagacctgactacttgctagtataattttattttaagtgcacgttattattctgctttctccaatatcagacagctggttccttcttgaagcaactcttaaagacagatggaccagccatgtcttcaaagtgttggcttcttctgtggctcccattttcccgtttatcctagtgccttgacttcttcacttgccaacctccgttctccctggcaccaaggagttatgtagcgttgacttgttcttttccatttgaaggtggaaggatgaacataaggtgccagactgggctattttatcatagacagatggatttgctccattcatgtaaagagttccttttgtagaatatctgaatcctggtatatcctttagatggatgtataatccctatccccacacttttctcccaaacttgtgagttataccattaagtctacaggactgggcagttacgacctggacattagtccagttttctgtattctactacaaaaacttgtttctgttgtttaaaacatgggattatttgtaagttatcactccagaaatgaacgtaactgaatttgctgaggatttaaactaattacctgacatcaaattggttcaaggaagtggggaaaataaagcaaggattgacaactactatttgcttcattctaattttaggccctttaactttaaaggtgaattattccttgttttattcttggagtatttattttatgaatacgtgaattacaataacaaaacactataccgttgtgaaagtgagtgagctacagctacacacaccaacatggataaatctcctataaatctcatcatgtcagcgagcaaagcaagttccagaagaatgcccacagtatgagaccaattatttggtttgaaaatatgcaaagcagcattccatatgtcttaaggacacatacatatgaagggaaaggataaatccatgatgggagtgataatcccctaaaaatagttacttgtgggggaagcagtggagcagaatgcaatctgggaagggtactgagggagttcttatgcgatagtggacagggatggatttatgagtcaagaagagcaactgcacggcgtctggaaggcgtgctggccctgggctctcaggtggaggctgtttgcatgatcagcagataggaaggtaccatggatgcaggagtggtctgaataccagagcaggcaagccaagtgagcaaggggagggagacgagaggtgccaggaaaaccctgtctcatgagaagatgatgatcctagaaggcttagaagagtgtccaccccaggccaggtgcggtggctcacacctgtaatcccagcactttgggaggccgaggggggtggatcatgaggtcaggagctcctggctaacacggtgaaaccccatctctactaaaaatacaaaaacaaaattagccgggcatggtggcgggcacctgtagtcccagctactcggtggctgaggtgggagaatggcatgaagccgggaggtggagcttgcagtgagccaagatcgtgccactgcagtccagcctgggcgacagagtgaggctctgtctccaaaaaaaaaaaaaaaaaaaaaaagagtgtccaccccagtgcccccatccacagggctgctgctgctgagcacccatgcccttgggtgacccactctcctgctcaggggcccagaggatgcttctttcttcttcctgggcactttcccctgagttttggtttaaaagatagaattcccgatgaagccagcttgctgcagtcctgtagccccacatctccatatgcgatcctttgagggaggctgagcatccctgcatctctgaatgggagacatgtttccaccttggctcctgggggcactggggccattttcctggtgttctgagcactctttctgcagaagaagacactctcagatggtagattttgtggatttcagtaagtagagtccttcaggagtctctaggcagaaagcacctgagttgacagcaagaactgagagttctgggtctgcctctagatggctgtttgcctattccagcctcactgtccccatatccagatggaatgacatgagcatatgggcaggacaagccacctttgtccataaggcggggtacacgccaccaagactaagactgaagcctaggcaagacttagagtatttgtggcttcagagaaacatcaaattgagaggaagatcgagtgataggaaaactgaagccagagaagtaagtattttgtatgtagagtatcattttccaatcatcgctggtgtgataaaacagcaaacgtcactgcttattgaaagcaactagacagtatgtttggtgattggattacaagttttccttttagataaggagagatttaatctgtttctggactctttaggagcacccttcccagttttacagttgagggactggagaccctgagaggtgaaggggcctggctgcactcacagtggaagtgatcccactggatctcagatgttgagtttctgacactcaatctagagctcttcttaccacacatgcttcagtctacacagttctccccctctttttttttcatcttctcatctactgcccttattctctctctctctctctctgtaaaacatgtaggggctgtcatagacgacactgtgtgagcggaagttgatgacttcaattgtgacaaatatcaggagctcctctcaaaaattaccttcacaaaagccttttagaaaagccatgttgctgtcacatgtagctataatttgggttgtgctcaaaagacttaaattggttaataccgaagggaggtgtggtttattctgtatttgttgttctagtacttcttgggtttgggggctgctgttatgagaaatggcttctcctagactccagaatgtgcttagagagtgtttttctctttgaattgctaaaaatgttatttcctctctcctggatttttcaaggtgtgcaataagttgtgtagttgctgctctgctgcacagagctttaatataaactgcgtattttcactctgtatgtgtgagtaatctgtgccttctatggctctgatcgtgggtaagcaaaaaacacagtgactgctgaaatatagggatggaaatttctttgtcagtaaagatcctatgaaatcatatactgagcatacgtaaaatatggaattgtctctgcagtattgatcgagcacaaatccactttcgtaaagcaaaaataaaggtcaaacagaaaaggcacatcactggtttttaaaattttttgaataataagtacttgaaattccttaaaaatgacactatatatgatttaacttagatagctagaatagtcaaatacatagaaacagaaagtagaatgcttattgccaggggctccagccctggtgagggaggaatggggagttaagtgtaataggtgctgggttttagagatgttgacaaagttctgaagatagatggtggtgatggttgcacagtagtgtgtgggtatacttgattccaataaactgtacacttaaaatggttaaagtggtaaattttatgtaatgtatatttaattgcaataaaaaggataaataaatgataccatatcctcgtgatttcagatacatctcttacttactgatcattcctcctgagaatgtgttctgtctccatgctgattatgtttcctgttctcttcctttgggtgctgtgttcagcatttttaatttttttaatagttaatgctatgctcacattttcctcccgtgacaaagagtgggaataagcgtggcacatgtgtctctcaccatctgtttgatagctgcacagaagccttaggaaactgagggatagacacgctcccactgagttactcaacactgctgcttccttgtcctctggctgaaggctaaaccctgccttctactgtttacaacaggagtgtccaatctttcggcttccctgggccacacttgaaggaggagaattgtcttgggccacacataaaatacactaacactaacaatagctgatgagctaaaaaagaaaattgcaaaaaaaaaatctcataatattttaagaaagtttacgaatttgtattgggccacattcaaagccatcctgggctgcatacagcctctgggttggacaagcttggtctaacatatagtgttaataggatatttgaggtggagtaagaccaatagatcaggaggtaattgccactgaaaacatagttaattactcacagatcctgtgtcatgccacgtgaggaagcaccagggtgggtcaggagacagacggagcagggaaataaggtcaagagactttattgtggtttctgcaggaaggaatgctgagagagagcaagcccattgaggactgggtagtttgaataattccagtgggctctgggatgtaggggctgcccctagttgtttggtacctggtctggggtgattagggcaggggatagtggtcctgagtgtaagatcccaataagaggagttgttgggtggtgtgggcgtcacctgctgttccattggcctttagccagggcctgagagctgggtcaagataacataatttaaaaaacgatattatacccaccagactatttcttcctggtagaaagcaccacagatccatatggacttggatggatctgtggacagattccatgtttgagaagtagccataacctgcggccttcccctttctacaatgcagactccatcctcagttcaacagaagtttcacaggtatctttacaggtgtttcctgagtcagccgatcaggtgaattgtttgaccccattgccaagaatatttctggctggaggttccgaatacctcaaagagaaagtccctgcttgaaagagtctcctgcccccccaccaccttagaacagttgctggcattgattgctctaccaagagaaaaatgctgatacttgacaaactattgacacacctgggaatggccacataatgttggataatgttaatgccacaggtggaggacgtgggtgtcaggaagaagaagcagtatatgattccacaacagtaatttcattcttcaagaagattgattctattgggaatgatttttcccattaagcatgaaacacagagaattcttggtggatccattcatttagcaagcagttttgtggaagacagcatgtatgactgccaagggtgtggggtgtggtgtccaagtagtgccttcatggctccctcacttataaactgtgtccttgagtaaactgctgaaccctgtggtgccttggtgtcctcaccaataaaatagaggtaaagatacaagctcactggtttcctgtgaggactaaagaacacctgtgaaaagattattaactatgttagagaggagggtgatgatactaattggaaacaaataaggtactaaaacaagtgagacgtgatcttcactctgatggaatccagtgggggaaatgaatataaaaacaggcaattataaaaaaaaaaatggtaagtctgctgatatggagtacactttctaggggcatcaggatagacaaacatagaagaaaaataatatttgatttgagccttaatggataaataaataaataaataacggggagaaagatgattcctagagtagggagtatctcatgcaaatgactgagaagcttgattaagttaatgtttaagaatgtggcaggccaggtatagtggctcatacctgtaatccaagcactttgggaggccgactcaggtggatcacctgtggtcaggagttcaagactagcctggccaaaatggcgaaaccctatctctactaaaaaatacaaaaattagccaggcatggtggctggtgcctgtagttccagctactcaggaggttgaggtaggagaattgcttaggctcaggtggttgaagctgcagttagctgtgttcatgtcactgcactcctgcctgggtgacacagcaagaccaccatctcaaaaacaaaaacaaaaaacaatgtggcatattaaaaattaaaatcacaataaaatcagagggtacattgtgagaagttaatagcaggagataaggttgaaaaaaaaacttgaacccaggtttaaaagaccttggatcatgtgtatatgtgcggttaataaaattcgatagtctagaaagctttaaatgcaatataaagaggactatcttagttgagcaggcacttattaaaattctcagcataaaataacagagtataggacagaaaattatcttggaaatttaataaaaggttatatattagtcagctcctgctttgataatgtagtataacaaacagcccccaaatctcagttgtttatatgaaagcatgtatttcttgctcatggacttgtgcgtcatcttgtggctttgccatgtgtttgtgggttgggtcagatctactttgagtaattctgggactgggctacctgcggggcatgctattctcatggtagactggaggaaggaagatagataggaagacaatcatacaagggcatataaagcctctgggtgggcgtggcatacgttaggaccactggtgttccattggcaaatgcaagtcacctggtcacatccagaggcatggggagatgacgcttactctgcctgtactgaagagaaaggagagaaggaggacttatgaacaatgaatacaatctaccactgatggtcattaatggcctcaaaaatatcacaaagacatgaaagccctgcagtggcttccaaggatcttcttattagaaatgatatgagggatagagcagtttaccacataccacaaacgtgtataccagcatgtgtatactagtttgggaattcgtagttttgagtatggaagtatgggaagtgaaaagaagggagaagtagaagtgttgggtgtggtattgcatacactggctggagacaggaaggaacaacgatcttctaatataaactttaaaatggtcccagagtaaagatataatagtgatcagagatttcactccatgaacatatgaatgtctaatttgtctcttgatatttaacttttaacatgaaatatttcagaaatatagaaaggtacagaaaaaaacatagtggacacccatgtatagtagatgctaacattttaccacatttgattcaagtgaacctatgagtttatttttagtgttgttctttttaattaagaaaatattacagatacacaaatgttgtatattctactattctactctggattgtctttttttccctcagtgtttttgtcatacaaaaaattttaaaacttttaaataagatgactttatcttttccttcttttttttctatttcttgtttaataagttctttcctactcccaggatcatgtgaatgttttctgtattttcttctaatttaaaaagttttgttctgtagctttactttttaaaaacattttttaaagtttccatctggaatttttgatgtgtttggtgtcagagatataattttgtctttttacatatcaatcagtatctaatagcatcatgacctctacagatttgtgtgtcatctgttgtgtgtgtgtgtgtgtgtgtgtgtgtgtgtgtgcatctttttataagtccccatactcttccattgatctgtttgtttctttctgaattaataccacactataattgctatagcattagaggacattctgatatgtggtatgacagctctccctctccccatcttatcacatgcacacacacacacccacacacacacacacggactgagcatcctttgtcttcaaagttgtcatgactactaatgggaatatttaatcaatttatatttaatataatgatgaataggtttgactttaaatctactatcttgctagtggttttctatttgtcccatctgttttttttttcttttttgctcttttctgccttcctttagaactgagtattttttagtattctattttatctcttttttgaattattgttatcccactttgttttattttcctcagtggttgctttagggttcattctaggcatctttaacttgtcatagtttcctttcaaacaatattattccactttatgtgtaagtatatctaatgaataatatatttaaaatttttataatataaagcctcataaatattttatatgtatactgtcactcacacactatatatcactacatatttgtatatttcccccatatatgtatctccctcatatatatgtgtgtgtgtatatatatatatatgagagagataaataattttacaacagcatacttacatttttccctcctgtcatttgtgttacagttgtcatacttttacttccacatatgttgtaaattcagatcaataaggttttaaaaattaaattattgttttctttcctgggataaactctattattctttaccactgtgctagatttttttttttactaattcttaaagcatttttgcatccatattaataaatggaattaactgtaattttgtttcttcatactatctttccccgttttggaatcaaggctgtaccagtctcataaaataactgggaagttttccatcttcttattctccctgggcatcatcctcacctacctgaactactgcagttgcctcagaaccggttttcgccctctcatccttgtcttacagtacacctttgccccaaattcatttcctacaatgcagtgattcttctaaaatacgcatcccttcatgctgctccctggtctagaacacgtcacagttcatggcttattgtcgtagctcagtaattccttgttttctggggtttctctagcatcatacaggctgaaatggtgtcatgtgattccagaggccaaaaggctggtgtggagtcatggcaactttcctaccactacattcccccttcctatgagtttcatcgtaccaatgatggctgttcatagccgactgcatcattttccatgaaattactggtgtggtgtgatctggggtcgcattcaatgggaaagatttagggaatggtcatgagagtggcctcctggatgcagtaacctgacataccctacattttccctgaacttggggtccggggcaggcttttgcaacaggggtatggtatttaaataatcagcataaaacagctgcccattttaaagctgtctcttcatagaggtcaggacagaactctaggtatggcttctactgacagctgctccttcaggagatacaaattatatgccgattctgacacttttgaaaaagaaacatatcaaatgcaacttttttttcccatttcagtttatgcttttcactgttctcccttcttctaaaaattgtggtgtttcatctttctgatgctcttctagaaagtgggctaaagcactaaaatataatcattccagtttcatagagccagacttgaggcttatagatgttgtataagtggctcagggacccaaaatatcttctgtggtgacccttgctttaaatctcagggctatgttttcttagactgtctgagcaccagtttcctcatagaatgtggcagattgaggaagattgtatctaaagcaccaacatagtgtctggcaccatgtcgttcagtaaatattatacctgtgaaatacatcaaatagaggcgccactgctgggaagtgaagtcctgcctataattgagtttaacaattccatagaagatttttttgaatactgatgtgcaaggtgactggcctcatgtcagattctgtgagtaaaacaaaggtaattgagcaatggttcccacccttctggcatcactgactgttacgggatctagaaacatacatgatcagacacgtgaacccacggggccaacaccacagcaggagtgaagaaggagctggaaggggaaggtggggattcagtttgcctggcagggcatggtaagacttcagaaaggaagtgacattggaggtacatcttgaaggatgagtgggatttcaacagacagaggctgtagggctgagcacttgaaacagagggaggacatattgcagccaaacctcggtgaactgacttgggtacgcttctgccagaataagaagaggtcttgaattaatagtcaaacctgatatagcttctttgtcactgtgtcttttccttgaaatgaatggagctttttgattttttatccttacttttctcctctctgggttacagtggcaggttgttttatcttcccctgatgaattgaccggtccagagagcatttcagttatcatttatggaacaaggccaaaatatttctttcacacatacagcgcagactaaatcgtctttttctttatcttttttttttcctttaacaacctccagcctatttgtggcatctgaaaaactttgcggcagcattttacagccatttattgtagagtctgttgctttgggctgctgtcagtgctctgacacaaagtttcccatctgattttgagctggtcaccgtgtgctgttgtagtaacagggcctcctggtgcattgaaacacctggtttacttcacacttgatcactggcatgttcaagaacagatagagctttgtctgtcatttgctctttttgggttagcttaagctagggatgttttattttaggtttttttcttaaaatcagagaaaatctagcttcaaaactcaagtgctaaaacaccaaaatagtgttatagaggcacattcctggggcaggggagaggtggccctcgattaaatatatacgagcaagtatttattgaatctcattttaaggacatttgcatttcatgagaagtgagaggtgtggttgctgccctcaagagacttataacagaactagggagaaagatacagccacattagacaaaacagcaagatgtaatcaagtgaaccaaagcagtatcacatgtacacaggagtgtgagcagagagttaaatctatgtatattcactttaggtcatttataaccttgacctccagcaaatgtttaacaatggttataataatatttcttacaattacacataataacccatccgtgcaaatgtctgtgtacttgggccctaaaaatataacatactgattctaggaagaatgcatattcttgtcactgttttcatgttcagaaggaactcaggggtgggccagttctggagtccatgcagctggacagactctggaaggtgaaggacccttgcccaggaagggctgaaatctgtgctgggcagagtgagtgaagggaaggatgttttgattgaccgaagattttctttaattgaacttgaatgggatgacaagaggagaaaaacctggacatttacttcttgaccatggaaagttttgaagtaaacagaacaccataaaacaaaatataatttgggaattgaggttgaaaatcaacaagtaaggttggaaagagttgttgaatgttctacattcacaaataactaggccgggtgtggtggctcatgcctgtaatcccagcactttgggaggctgaggcaggtggaacacttgaggccaggagctagagaccagcctggccaacatggtaaagtcccatctctactaaaaatacaaaaaattacctgggcgtggtggcgcatggctgtaatcccagctactcaggaggctgaggtatgagaatcgcttgaacccagcaggcagaggttgcagtgagccgagatgatgcaagtgcactccagcctgggtgacagagcaagactgtctaaagacaaaacaaaacaaaaaatgaaacaaaacaaaaaaaaccccacaaaaaacaaaaaaaaaagaaaccaaaccaaaagaaaaccaaatagttagatgagatggaaagagtggaggacagatcttaccaggaaatcctcagaacactgactactcagtgtggatttcccaaccagctagctacagtctgcttgtctctcctgagggttttcagactagtttccaaaaagtcaggaaaagggtagaattccaccttccgttccctatttggagctctgggacagtagctgtcacatgatagtatgcgtcagagtcacctggtgggcttgttggaaacacaggctgctgggtccctgagcttctgattcagtagtctcaggtaaggcctgagaatgtgcatttctaagacattcccaggagacacagatgctgctggtctggggaccacattctgagaaccactgcctttgggtgggtgtgggccatgacctccttccaggttctatacattggccccttgactcatcaaaagggtcttggtctatgctttgatctatgcctttccttcaatgtggctgtaagttttacctaattaaaatgctgcatctggtttggatgatctgattaatatggaggatgaaatttatagcaataagtactcagagctttgctcccttcccgatcaaagcctgaagtttgatttctttatacatatattttaataataatcatcattagtgctgaaattagagataaaatgtcccaatcatcccagtgtatttttagtttctaagcatgagcatttgattattgttttctggcgagtctgtcgtgtaatccagtaattgcaataaaagagaaaagtactttttgctaatatggtacaaatagttttgtccacagtgatcaaatacagagattttccattctatgttattttatacccctctctactcccctgcttcccaaaatagacacataatatatacaactagatttattggagcttctgatttatatgagactatataagtgatttcagtgtatctaggatagagattttgttcccagagtaaaagcttctgaagctgtgcaatgcaaataaaattattttatttattatagcattaacttaagatgcagtcttctgaatagtctagcctgtgtttgggatgtaaatttctcttgcaccctgctgcctttcacgtttgctttcagcagggactatagtttaatctttttcttcctccttgccccgcaacaggagatcgctattatcagctgacactgaagctcctaaaaaaatcttagctcagattctctttgtccatctgcaagctagcgcacattccccgttcatggaaaaataccactgcggtggagctttaagtcactgctgttctgcaagaaataaattttatcacaagaagcagtgggtgcagttagaaaaagtcatctagatctaagggaaggcttcaaataattctcctaattggcctacgtggttcactagtagaaaaacctttcgtttttgtccttcaaaaacaaaactgagagagttccctggagacattagtttgctaaatgacttgcccaaggtcacctggtaatatgaccaagtgaagaattatgggtttgtgaaccgttatattcggtataaggccatattcttttgttactttcttaggaagagaatcaatggcttgtttcagaaagctttgcaaggaatcacttactcttctgccatgggaaaaattgtgtatgccagatgcattttgttcatttttaaagagctcctcaatgctattgctgatctcctagggtaagagaaggacagggaggttagacaaggcaactggtagtcttctaatgcctacagtaattaatgataatattcagactagtttcattcatcaaagcgtatacattacagggtttgaaaaataggcgtattttcttagatgcaacaaaatctactctagctgctgcctcagggtgctcattaccacctttctagtctgccatgggtttggttgtggggcagaagtcagccacatacagaacctcaatggcaaggcaatatgggaagtgcagtcctttgctttaagtctctagtgtagagaaaacatgttttgggggtggaatggtagactggagtgggtttgaataaaccaattggcagtaactgctgcagatagttctcaaatgttattgcttccaatggggtgaactaagtcatgcagtgagccaattctcttgcaaatggctggcctgtcttcaaacggctatcagagaaacgtcaatttcagaatatggttagatacagtgtatggggataattagtagatgtcataatgctatgcaatggtattattcttatttagaaacgaaaattgagtaaatttaattttagaacattctaatttcaccaattttgcttgtccataatttccttaaaatttgctcttagatgacagcatggtgcatggcaaatgcaggctttgcaaacaattagaaccaagttcatatctcagggttgcttcttcttagctacctaattggggtatgtcactaaatctcattaattctcactggagaggatgctgatattgaagcgtactgggagcattcggcccatgaagctctgtgcacctttaatgaaatcaggcttgtatggcacactgcagacactgacaaattgtgtggtagttattctgcttctgacccaaatgcaatgatgccatcatcttctgatcccattttttcttgttcactggcacatttactttccaaactgtactttattattatatatttaatcatgcagtgtattgctttaatattgttcataggttatctcctgtttattttgtttctcagagtgactagaatctctctctgtcagaagagagggtgtgacttcttgctgcctttgccttgtatcttatcctgaattctgattctaaccttagtgcttgcatcagttgttatggacctggatcagggccactgtgtatggttgttcaggttgaacagtgaacaagagccccacgtttcatgggataccagtcactttgaatatttattatatttatcatatacataattattaaacatattatatttattatacatattaggtcttgtcctcataaaatcagtacattatggcaactttttaacaaaaagaagtgaagtgtcttaaagaggggcactgcctcttgactggcacagatgcaacgtatgggcaccacagaggctagcagtggccctggataagttgatgatcatagtgggtgatagcataggtttttaaagttgttcacttattcatatgacaattatttgtttttgtgcatattatgtaacaggcagtattctaggtagttggatatacaattattattataaaaataataatcactatatgggaggccgaggtgggcagatcatctgatgtcaggagttcaagatcagtctggccaacatgatgaaaccccatctctactaaaaatacaaaaattagccaggtgtggtggtgcatgcttgtagttccagctactcgggaggctgaggcaggagaatcacttgaacccagcagaatgaggttgcagtgagccaaattcacgccactgcactccagcttgggtgacagagtgagattctgtctcaaaaaaaaaacaaaactcattatcttagtgtcctggggctgccatgataaattactacaaagagaaatgtattttctcacagttttagagggcagaagtctgaaatcgaggtgttgttagagcggtcctagctccaggttgtaggctttgatttgtcagtccttgatatgtacacgttgagtatccctgtctaaatctctgcgatctgaaatgctccaaagtctgaaactttttgaacaccaacatgatgctcaaataaagtgctcattggagcattttaaatctgaaacactttggttgcaagcattttgaatgaaggatgctgagcctgtatacatatcatagcaatctctgtctccattgtgtgttccctccctgtgtatcactgtgtctttgtatctcttcttcttctccttctcctctctcttcctcctcctcctcttcctcctccaccttttctctctctcattttttttttttttgacagagtcatactctcttgcctaggctggagtgcagtggtacaatcatagctcactgtagcctcaaactcttgggctcaagtgatcctcccacctcagcctcctaaagtgctggggttacagacatgagccatgatgcctggcccatttttcttcttaggtggataccagtcatcagatttagagcctcccctaatccagtatgacctcctcttaatgaatgttatgtgtgaagacctcccttatttccagataaggtcaccctcacacgtactaggagttaggacttcaacaatttaacccattataatcaaagagcctataagactgtagatttacatggagtaaggcaggcaaataaatgagcaataaatatataatatgtgaaaaaatataccatgtgtgagtgattacaagtgctaggaagaaacatcaacctcaagccataggattgcctgtgtggggaggctctattctaggctgtgtggtcagagaaggcctttctgagaaggtgccattggagcagaggcctccgcaaaagcagcagacgaacagtgtggatttatggggagggatgttccaggcagagggagcctcaaggcctttaggccacagtgtgttgggcatctgtgaggagctgctaggaggctcaagtgaaacttggagagaggagggctgggaaagtgagaacagcaaagaaaagggcaacagatcatgtggggttgagtataataggaggttagaaacttggtgattaagatgggaaaccatttcagagtttttaacagaagagtcacgtgatctgactcgtgtttagaagattgttctgttgctgcagtcaagagactatagagagtcaggctgggcacagaagaaactgcaaaagcagttactgctttggagcaggaaaggggtggtgtggttcaggcagcatgggagccaggacactggccctgcagggagtgaatttcaaggttaagtagcctggaagctcagtcctctctcttcaatgatccatgcttctgtcctggttcttcatctatcttcatctatggcacctttgaggtaggtattgagttggaggctttgctcatcctgtgggtgcaggtttggcagcccagaaattatttttaggattaacagctacatgttgttccaggccagacttcctctaacattacatttccctcaaaaattcattggagctcttctctctcttccttttttctgtcccctcccttctcttccttttctttcttgaacaatttagcaatttagtcctaaatatattaggtcaggtagagcaaagtaagcactgctggagaggggagctgcaatgtcacttctgtggggtcccttctgaaagtttggtgtctcactagtgaagaagagaggtacaaataaggaaagggacaaaactagaaggaaccctgtgttatgagagtaaaactggagtattgctgtgaacctaaatacacagatagatacaggaatatcaaggcagtgtgtatatgtacacatgcatttatatgtctactcccagctttgcccactgagagagtctgggagcaatgacatcccaagaacaatgaacacccctagaatccaattcttggcttctaaatactcatttccactaagaggaaccagagttctttggagcaattgctgaatacaagcagggaaattgcagactgagctagagccctgttgatgctggaaaacaaggaaaagatcaaaaaatgggggacatgcaaaaggatcccaaagtcagccagattgggttcccactgccaaacagggcataaatcgagcataaaaataaataataataatattagtggatgataacccagtgaataagatagaaaaatcttgagtccacacatatgcaaataaacacactgaaggtttgatgaggaatggaatttttacatagttccaattacatcccctcagaatacttattaaatacaaagatgaaaagaataactttacagtggagaagcctgacagagagcaccttaatcaaattatcaacgttatcatcagcaatgggacaagtcgaagtccttagccaccacagtaagctacaagagcaccatgacatcagatctgggatttcccaacaaaaatgcaaacctgagtttgatcatgagtaaataccagggaaactcagatggaggtgcattccacaaaataactggcctatggtcttcagaagtgccaaggtcaagacagtcaaggaatggccaggctgtacgcagtggctcatgcctattatcctagcactttgggaggccatggtgggaggattgcttgagcctgagagttcgaaaccagcctgggcaagatagtgagacccccgtctccacaaatttttttttttaattagcctggcgtggtgatgcacacctgtagttcctgctgcttgggaggctgaggtgggaggattgcttgagcctgggatgatgaagttgcagtgagccatgattgtgtcactgcattccagcctgagcaacagagccagatcctgtcttaatttaaaaaataataaaggaatgactaaagaactgttcccaactcaaagcgactaagagacatgggaactgagtgcaatgtgtgattctgaggggcatgggggacccttttgttgttataaaaggcattatcaggacatttggcaacatttcaatgaagcctgaggattcgatggtagtagtctatcattattgatttcctgattttgatggttatattgtggttatttaggaaaataccctcgtttttaggaaatatccactaagatattcaagggtggaggaacagcgggtcaacaactctcaaatggtccaggaaatagaaagttctttgtactatatttgtaacttctctgttgctctgtgattgtttaaaatgaattcgctgaggtcatggctttttttttttttttttttttgagatggagtctcactctgttgcccaggctggagtgtaatggcacgatctcagctcaccgcaacctctgcctcccaggttcaagtgattctcctgcctcagcctcccaagcagctgggaccacagacatgcgttaccacgccgggctaattttgtatttttagtagagatggggtctctccatgttggtcaggctagtcttgaactcctgacctcaggtgatctgcctgccttgacctcccaaagtgctgggattacaggcatgagtcaccatgcccggtcaagggcatggattttgatccatgaatcagtgagagagacgtaagtacaatgcctgatatttttgcctgttcttgaggatagcatccctactattactgaattcactcacatgtgtgagtttggggatcttaaaatatcccagggggtgctttatgcacgagggatatggattaagtccagggtgaatataggtgtttcccagtgataaggcagctgtgtgtgaaagcaaggacaaaaacaaaactaaactaaactaaaaagaaaagtcaggccagtgtgctagatatttacagctgggtgattgtgatggcactgtccttcctaaagctttgtaacagattaagtagattctctaaagccgttcaggttagagggtgccttgcccttattgctccaccgtgctttttggcagacattgtgaccatgtttagtaattatatttggctccctgaaggtaaaacaggagctgcgtacgtattaggggagaaaaaaggaagcacaagaagaaaggaaaaaaaaaattaaggggcttatgttttatatcctcccagtcaatcccatgagtgaataactacattacaaattttgtctcgatgtggtttttaagcctaaagaatctttctttttctttctttgctttctttctttctctttcttttctttcttttctttctttctttctctctctctttctttttcttctctctctctctttctttccctccctcctccctcccttccttccttccctccctcccttccttccttccctccctcccttccttctcttccttccttccttccttccttcctctttctttctttctttctttctttctttctttctttctctttcttttattatactttaagttctagggtacatgtgcacaacgtgcaggtttgttacatatgtatacatgtgccatgttggtgtgctgcacccattaactcatcatttacattagatatatctcctaatgctatccctccccactccccccaccccacaacaggccccagtgtgtgatgttccccatcctgtgtccaagtgttctcattgttcaattcccacctacgagtgagaacatgcagtgtttggttttctgtccttgtgatagtttgctgagaatgatggtttccagcttcatccatttccctacaaaggacatgtgggctcctgaacttatccttttttatggctgcatagtattccatagtgtatatgtgccacatttgcttaatccagtctatcattgatggatatttgggttggttccaagtctgctattgtgaatagtgccacaataaacatacgtgtgcatgtgtctttatagtagcatgatttataatcctttgggtatatacccagtaatgggatggctgggtcaaatggtatttctagttctagatccttgaggaatcgctacactgtcttccacaatgcttgaactagtttacagtcccaccaacagtgtaaaagtgttcctatttctccacatcctctccagtacctgttgtttcctgactttttaatgatcgccattctaactggtatgagatggtatctcattgcggttttgatttgcatttctctgatggtcagtgatgatgaacattttttcatgtgtctgttggctgcataaatgtcttcttttgagaagtgtctgttcatatcctttgctcactttttgatggggttgtttgactttttcttgtaaatttgtttaagttctttgtagattctggatattagccttttgtcagatgggtagatttttaaacttttctcccattctgtacgttgcctgttcactctgatggtagtttcttttgctgtgtagaagctctttagtttaattagatcccatttgtcaactttggcttttgttgccgttgcttttggtgttttagtcatgaagtccttgcccatgcctgtgtcctgaatggtattgcctaggttttcttctagggtttttatggttttaggtctaacatttaagtctttaattcatcttgaattaatttttgtataaggtgtaaggaaaggatccagtttcagctttctacatatggctagccagtttttccagcaccatttattaaatagggaatcgtttccccatttcttgtttttgtcaggtttgtcaaagatcagatggttgtagatgtgtggtattatttctgagggctctgttctgttccattggtctatatctctgttttgatatcagtaccatgctgttactgtagccttgtagtatcatttgaagtcaagtagtgtgttgcctccagctttgttcttttggcttaggattgtcttggcaatgtgggctcctttttggttccatatgcactttaaagtagttttttccagttctgtgaagaaagtcattggtagcttgatgcggatggcattgaatctataaattaccttgggcagtatggccattttcgcgatattgattcttcctatccatgagcatggaatgttcttccatttgtttgtgtcctcttttattttgttgagcagtgatttgtagttctccttgaagaggtccttcacatcccttgtaagttgtattcctaggtattttattctctttgtagcaattgtgaatgggagttcactcatgatctggctctctgtttgtctgttattggtgtatgggaatgcttgtgatttttgcacattcattttgtatcctaagactttggttaagttgcttatcagcttaagcagattttgggctgagatgatggggttttctaaatataaaatcatgtgatctgtaaaaagggacaatttgacttcctcttttcctagttgaataccctatatttctttctcctgcctgattgccctggccagaaattccaacactatgctgaataggagtggtgagagagggcatccctgccttgtgccagttttcaaagggaatgcttccagtttttgcccattcagtatgatattggctgtgggtttgtcataaatagctctcattattttgagatacatcccatcaatatcaagtttattgagagtttttagcatgaagggctgttgaattttgtcgaaggccttttctgcatctattgagataatcacgtggtttttctctttggttctgtttatatgctggattatgtttattgatttgcacatgttgaaccagctttgcatcccagggatgaagcccacttgatcctagtggacaagctttttgatgtgctgctggattctgtttgccagtattttattgaggatatttttgtcgatgttcatcagggatattagtctaaaattctcttttttttgtcgtgtctctgccaggctttggtatcaggatgatgctggcctcataaaatgagttagggaggattccttctttttctattgattggaatagtttcagaaggaatggtaggtaccagctcctctttgtacgtctcgtagaatttggctgtgaatccgtctggtcctggactttttttgattggtaggctattaattattgcctcaatttcagagcctgttattggtctattcagggattcaacttcttcctggtttagtcttgggaggatgtatgtgtccaggaatgtatccatttcttctagattttctagtttatttgcatagaggtgtttatagtattctctgatggtagtctgtatttctgtgggatcggtggtgatatcccctttatcattttttattgcacctatttgattcttctctcttttcttctttattagtcttgctagcggtctatcaattttgttgatcttttcaaaaaaccagctcttggattcattgattttttgaagggttttttgtctctatctccttcagttcttctctgatcttagttatctcttgccttctgctagcttttgaatgtgtttgctcttgcttctctagttcttttaattgtgatgttacggtgtcaattttagagctttcctgctttctcttgtgggcatgtagtgctataaatttccctctacacactgctttaaatgtgtcccagagattctggtatgttgtgtctttgttgtcattggtttcaaagaacatctttatttctgccttcatttcgttatgtactcagtagtcattcaggggcaggttgttcagtttctatgtagttgagcggttttgagtgagtttcttaatcctgagctctagtttgattgcactgtggtctgagagacagtttgttatgatttctgttcttttacattttctgaggagtgctttacttccaactatgtggtcaattttggaataagtgcgatgtggtgctgagaagaatgtatattctgttgatttggggtggagagttctgtagatgtgtattaggtctgcttggtgtggagctgagtttaagtcctggatatccttgttaactttctgtctggttgatctgtctaatattgacagtggggtgttaaagtctcccattattattgtgtgggaatctaagtctttttgtaggtctctaaggacttgctttatgaatctgggtgctcttgtattgtgtgcatatatatttaggatagttagctcttcttgttgaattgatccctttaccattaagtaatggccttctttgtctcttttgatctttgttggtttaaagtctgttttatcagagactaggattgcaacccctgctttcttttgttttccatttgcttggtagattttcctccatccctttattttgagcctatgtgtgtctctgcatgtgagatgggtctcctgaatatagcacactgatgggtcttgattctttatccaatttgccagtctgtgtcttttaattggagcatttagcccatttacatttaaggttaatattgttatatgtcaatttgatcctgtcattacgatgtttgctggttattttgctcgttggttgatgcagtttcttcctagcctcgatggtctttacaatttggcatgtttttgcagtggctggtactggttgttcctttccatgtttagtgcttccttcaggagctcttttagggcaggcctggtggtgacaaaatctctcagcatttgcttgtctataaagaattttatttctcctttgcttatgtagcttagtttggctggatatgaaattctgggttgaaaattcttttctttaaggatgttgaatattggcccccactcttctggcttgtagagtttctgtcgaacgatccactgttagtctgagaggcttccctttgtgggtaacctgacctttctctctggctgctcttaacatattttccttcatttcagctttggtgaatctgacaattatgtgtcttggagttgctcttcttgaggattatctttgtggcgttctctgtatttcctgcatttgaatgttggcctgccttgctaggttggggatgttctcctggataatatcctgcagagtgttttccaacttggttcctttctccccattactttcaggtacaccaatcagacgtagacttggtcttttcacatagtgccatatttcttggaggtttgtttgtttctttttactccttttcctctaaacttctcttatcgcttcatttcattcattgatcttcaatcactgataccctttcttccacttgatcgaatcagctactgacacttgtgcatgtgtcacatagttctcgtaccatgtttttcatctccataaagtcatttaaggtcttttctatgctgtttattctagttagccattcgtctaatgttttttcaaggtttttagcttctttgcaatgggttcgaacatcctcctttagctcggagaagtttattattaccgatcgtttgaagccttcttctctcaacttgtcaaagtcattctccgtccagctttgttccattgctggcaaggagctgtgttcctttggaggagaagagacactctgatttttagaattttcagcttttctgctctggtttctccccatctttgtggttttatctacttttggtctttgatgatggtgatgtacagatggggttttggtgtggatgtcctttctgtttgtttgttttccttctaacagtcaggaccctcagctgcaggtctgttggagtttgctggaggtccactccagaccctgtttacctgggtatcaccagcagaggctgcagaacagcaaatattgcagaacagcaaatattgctgcctggttcttcctctggaagcttcgtctcagaggggcacctggccatatggggtgtcagtctgcccctactgggaggtgcctcccagttaggctacttggcagtcagggacccacttgaggaggcagtctgtctgttctcagatcttaaactgcatgctgggagaaccaccactctcttcaaagctgtcagacagggacatttaagtctgcagcttgctcttctttctttctttctttctttctttctttctttctttctttctttctttctttctttctttctttttctttccttgcttccttcctttcttcttctttttcttcttctcctcctcctccttctttccttccttccttccttccacccccgtttctgtctttcttcctttctttctgttcttcttttgataggatcttgctgtcacccaagcttgagtgcagtggttccatcttggcttactgcagcctccacctcccaggctcaagtgatcctccctcctcagccacccaagtagctgggaccacaggcacacaccactatgcccagctaattttttacagtattttttatagagatggggtttcactgtgttgcccaggctagtctcaaactcctgagctcaagagatccaccagcctcagcttcccaaaaaagcatcttgtttttactcgcatgctttgtccctctgccaggacagtagctgtaatcccatctttgccatctagcttgcccccagtggctggtggggcacaagttttatttcttgataaggctgtcatattatggctaatgcttataaatgcttcatgttggggtagagtggaaattgacactttcagccatgaagacctcaaattttgggactagctagcctgtattgcaggctttggtgaagccaagggcgtctcctggaagggctgtattcctttccttctgtacatttccttctttccctgattgtagcaggataagggtgaggcagccgaggtgcctgggctgcaccatttaagcaggcgtcactctcagggttgtggaaatgcgggacaggcacctgagggtgatagcctctttacaagtgtcttggggacctctcgtgccttgccctggttctgggcctgcagcctggccagcagtcatctgagtttacttctcattttcatgtcaagaaggaactgcagatgccaatgctctgactctttcctctgatttccccagtatcacagcttcctttgacaagtagtatttccgggttgcagtaggtgaccgtttcctcacatttttgccaacatgcaagaaaccagatttccagccagcaacattattgtccacatgccgagtgtccatctcctctcctcagccatttttccatcttggttctgttacttgtgacattctgtttccgtgtgagagatcctgcatcagttaggaatttcatacagctctaagtgacagaagcccccacccagtggcttcaacaatttgaggatttatttttctcttgcaacaaggaaggagttctggagggagacagcccagggctggcatggcgagtccctgagaccctgggtcctttgatctttccactccgcccatccctagcacagtttgccgccttctgtttacaatacggctgccccacctgtgacattacatctgtgttccaggcagagtgaattcacgaggaaaaggtgcataggagatgaatgtatttctctagtaagtagctttctcagaagctcaaccagtagctcacacttacatcccattggatactgttgtgtcccctggaaaccctgtctgcaagcggagctgaaatctagttgtttttgttttatttttatttatttaattttatctaagtacacggggtaggataaaagcttggctatgatggagagaatatctattgggtggttaactggtcatccttgtcacagctctgctcggcttcttttgcaaaccggtcacaccatgtgggaaggaaaatagccattgaggtagcttttggtggcctccaacttttatcctttgccttattgtccccaccacaggaagaaatatttttcttttagttcctgtctgtcagtctcaggggagactctgactggctcagcttgggtggcacatccgtccccgtgattatacagggacacgagcaaatgcttgtcatctccaacttatcatgtggagggaaagggatggcttcccccagggtgggacagtaatggagaaaaacagcttgcactgtaagtccacgacatttctgtcctacattttgcaagatgtgatcaatatgtattggcaaagacaaaatgagaggctacttttggtggagagcaaatgatagtcaagacaggaatgtgagaattgtgtatactgtcctgtaccagtcaggagcctagcttggctgcagaagagggctaataaagaatgaaataggtgaggcaacaaggagttggtagttgaaaagcatttatgttctttctagtgaggttgttttgtttagattcttctgcctaaagaggaaatgtgttacgctgaccaactatgcgcctccagccatctcttctacttgtttttgacgttatagttgttagcattgggttacttttgacagaaaaccccaaataatatttgtttaaaatatacctgagtttttttttctctcatatgaaagcacagataggcagtccaggattggcttggtgcctcatggtttcaggggattgtgcagcttctatctttctacttcctgtgtggcttcaacttcatggcttatggaaacatcacactctaggtggcaggatgaaagcagggacaaagcataagggacatctgaatgttgtcccttaaggaaggtccccagaagctgcccaatgacactcccactcatgggtctttggccagggccacggctagctgcagaggaggccaacagatgtattctgggaagctcggctcaaaacactatcttgtgggccaggcgcagtggctcacgcctataatcccagcactttgggaggctgaggtgggcggatcacctgaggtttgagaccagcctggccaacatggtgaaaccccgtctctactaaaagtacaaaaaaatagccaggcgtggtggcaggcacctgtaatcgcagctacttgggaggctgaggcaggagaatcgcttgaacctgggaggtggatgttgcagtgagctgagatcacactgttgcactccagcctggacaacaagagtgaaactccatcttagaaaacaaaaacaaaaataaaaacaaaaccccactattatgtggatgcagaagagaagggatattggagggtgtcagcaggctctggccaggctcagtcctctgctcagccttcacagccagagatcatggggataacaaggtcgtggatctcagtggacctgactgacatgaatctgtatttacaggagcccaagggtatttcttgcagggggtggattatacagctgaaagcagctgcttttacaggattacgaagagtagctcttttccacgaaacaatttagaatatacacagtgaaggaagtctcactaacttcctttaagaaagttgaggtgagaaagagtagacagtttgtaaatggaagttacctaactgacttctgcaacttggggggctttgtagcatcaacgggtcagaatttcttagaggcattcttactttttaggtctcaaatctctgtcatttttcccttacggtatttgcacagtgcagcctgccttctgtgacctacagaagcacattgcatttaacctgaggcttatttgatattacactttttttctttccttcaaatatccacaatctaaattgtgttcagaaagttccgaagagctgtaatcccagcactttgggaggccgaggcgggcggatcacgaggtcaggagatcgagaccatcccggctaaagcggtgaaaccccgtctctactaaaaatacaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagttccgaagagttgccagggctctatttaatccattgctcttcttagcaatgcaaattctgtgcacaatgagtttattctccttgagaagataaattcagtttggctccagtggctaaactttgttggacaagtttattcctgtgtgacacctacctggccaagcactgtcatttggatgggtctttgggcaggtaagtttctgtgcacctagaaaccttccctgctgggatcttgtcccttgagctcctcctctccagttataaactctgttggcatctttataggatttactttttatgtggattccattgtctccaaaatgccctttcttagtaactagttgggccatctacaccctctttcggggtacgacatagaaatggaaatggaaaatttgtaaggaattatcataatgttaaaatacagataccttgtcattaaaccattaaaaacaaaattttaaaaaccttaagtgttggaaatattaggattccaatgctccttccacttcctgaaggactcatttctctaacatacttgctgaacaatcctcctaccttttccctgcggcattactaaataattcagattgtttgaaaggcattctcttctatcgagatgcaatcaaatttgaggagtgtatttcattctcgccgaatgcattatatcttactttccataaagagaatccaggtatgtgctattgccttatgccttgaataatatgaagcgaagcgatcactcttatatttggggagtgttttagagtcttcagatgctttatgtagtatcaatggctccaaatataataatgtacaattaagaatcacataggcaggcatttttataatgaggaaaagtgaagttaggagagctatgttcactttccaaggctacatagaacgagtgagcgccaggactgacagttccttcctgctctggatcttgtgggctgtctcctccagcacactgcatgctagaggaagccagcgatggggcaggagtggggcgagcatggcagctgaccccaagatgggcagagagcctgcccctcactgttcttccccgccttaaaggacataatctaacctctggacatggactataatctagcctcttctttattacttagggtaaatagtacgtctactgattattaattaaataacattcttcacctgtacatgttatcacactttagttcttagactgctttcatattcaacgtggagatctggaaaggcaacttgactatcttcattttatgattgaagaagctgaggttgagggaggctaaatggcttgtagttacactacaaacactaaaacagcaaaaattagcattggaactagaacatctgatgcatgttcatgactttgtcctcacagtcatatcctcagggtctgtggagtggtgtgtggctgtggccccttagttagaaggccgcagggactgtggtgttttaggttgtgccggctcttcgtcattttcccttttctctcctgtcccttccttccaggctatgagctatatttgtgccagcaagcagtgtttctctctgtttcagctttttcctactttaatttgtttgttttcatctgttaggatcttagagatgagagaaccaagatgatttggaatttcatgtgagattacagaggatagactcagagctgaatggtagcctatcaataacgttcatacatacactctctgacctctttgttggtctccaagaagcctttcagatttagttcctggttgtgggttgtgtttgaggtaggaggaccttgttgatggttgcattccaattaaatgagatggcagccctcacggtgcctgtgtgcatacaacatgtctgtgttagatgtgcatttgcaagtaactggttatagaacattattttggaatacaacacttgtgaaatctgaagatggttttaaactttgtatttcacctgcaattatcttgtagtactctcagttaggagaaaaatatctcttttgctctgaggattcctcagtatttttagtgactctttgcatgcttgcaagggctgtgagaacaagcccagcaggaaggaagagacatggggggaaggaaggaacgtgagggaagtgagaagaaaacaaaggcaaagtttcatacctggaaggcttcgtgcaccagcgcccacctccggaaaccacagttgcaaatattcttttgtgacctaattttggttctaggtttcctttcctctgtatgtgtttgctacattccattccctatgcaatagagtttttctgtaaagaagtttccaagtataaccttccatgaagctcctcaattttaagaatttataattttccagtcctagtgcttaactcatccatcatttgttttccctcatattttacctgtttggttgcactcaaagtcttcgttgatggatgaaacctgatggtttttaagaagcagaaaataccagttttgtcctcactgattgatttttcttgacagatcacgagtataatttataccagctcagtggcactaatcttgttttgttgttgttcttaaaacagctttgacaataagctgctactctgactttgattcttaagtcagcattaatgaaacaccattcatttgtgttatcagctgtaatagtcaaaaacaggtttaagactttaccatgcttgctttcaagttttgggtggatttctttttcctccaatgcttaaaaggtttagtaagtgaatgtcaggtcaaatgggcgtagctgagtttctcccaggcacgctggctttcctgtggatgtttttgtcacagcagtctaagtgtatgtctttctggcccggtcagggaactttgctgtggggatttggtttaaattcatgtttaatctcctaattttatttttgtggctatagtgcctcaccgagtatactgaggctgagactggacagaaagaccttttttctgataagctcttaatctgtatcaggctcagccaaaatgagttctgttagggctgctatttttagctatgtgtaatagctattgtggtctcacaatacacttgtttatacacagaatatggttttatgcacagaattttgtgtattaaaataataggcaaaatgattacaaataatttcaggtgtgccttgatacaaatcagatctgtatacttgtgttttcctgttgacatctgtcatttgcagtcagtggcttaaattaaaattttttggtcttagggaaaatcatgtgagggtttccctgttgcctctctcgggcagagcttctcagccttgacactattgacgttttagaccagacacctctttgctgtagggggtgtcccgcgcatcgtaagaggtttagcagcacccagggctctacgtactagatgctagtgcctcccctcccccactctcagttgtgacaatcaaaaatgtctccagaccttgccagatgtcccttggggatatagggctgccagagttaacaaatgaaaacacagcgtgcctagttaaatttgaatttcagataaaccatacaaattgtttttattgtggtaaaatgcacagaatataagacttaccattttagccatttttaagtggctaaaatttgtaagtggtcagtgtcattaaggacattcacattgttgtgcaaacatcatcaccattcatctccagaactttcttatctttgctagctgaaactctgtccccattaaacactaagtccccatcctcccctctcccagcccctggcaacctccgttctcctttctggctctatgcatttgactcctctgggtatctcatgtaagtagaatcatacagtatttgcccttttgtgtctgtcttatttcacttagtgtaacgtccttaaggtttgtctgtgttgcagcgcatgtcagaacttccttccttcttaaggctgaataacattccactgtgtgaatgaaccacatctccttcatccgttcatccatagatggacatttgggttgcttcccgcatttggctattgtgaacgatgctgctatgaccactggtgcataggaataattttttagtgtaaatatgtcccatgtaattttagtacatacttttatactaaaaaattattcattgtttatctgatgttcaagttaactgggcaagttgtgttttattttattgggtaatgctacctggttgagaaccactgccctaggactgaactgctattttttttttttttttttgagatggagtcttactctgtcacccaggctggagtgcagtggcgtgatctcggctcactgcagcctccacctcctgggttcaagcgattcccctgcctcagcctcccaagtagctgggactacaggcatgcgccaccaagcctggctaatttttttttttttttgtattttagtagagacggggtttcaccatgtgggccagggtagtctcaatctcctgacctcgtgatctgcccgcctcggcctcccaaagtgctgggattataggcgtgagccactgcacccagccagctggactgctttctttgcttgggcactggctcagggctccaaggaccgtggtcataccttcccatgcaacttacatatgacttccaagacttccagcacagtgaagagcacatggaaaaatgtgggcaccataacatctacataccctaaatgtgtcagtcagcttcaatttgttctcagtttgggaagggtgatagagatactgacccttccttttgacctgcctcttttccattttattctggtaaattcacgcttattacagcacttacagagcaaatcatattatgattataattttatgatatcatacttttatattatgaatatatttataatatgtgaaattatgattggattcttcaaaaagtcaacttaaagaaacaagttgggatcctcactggctacttgtgtcctatttcaaattatttctatttgccctttctgctcctctccccagctttattgaggtatgctggacaaataaaaattttaagtatttacagtataaaatgtgatgatttgatgtatgcatatgttgtgtaatgattaccacaatccagctaactaacatgtctatcacctcactagttaccttttttttttttttttttttggagtgtgatgagaacccttgagatctactctttgggcagttttcaagtatatgacacattgttattacatagagtcaccatgctctgcaatagatctccagaatttattcatcttgcataactgaaactttttaccctttgatcaccatctgcctttttgctttttctatcactcagagaaagccagttagtggataatttctacatgattgaggttaatagaatgcggccacctaaaactgtccctgaggcttgggaatttgggtgaatcctgattctgccatgcactttgggcaagtcacataccttcagtctcagtttcctcatccgtgactaaagaatagcatgaatgccttctccatggaatcaccatgagaggtaaaggaaatattgcacttacagctcctgctatgaaatatctagcatctgacagacatgcaccttgtcttagatgtcgagctgcagagcagttttcatggcagaaagagagcaatagttgctaacacgtatgaactgcttactgtgttccaggtactagtctccagtttttacttgtattgttgcatttaatcctcacactgagcccacgaagcttgtcctaacattattccctttcacagatgaagaatgtgaggcacagataaggtacattcatccaagggggtatgtctggcaagcagcagagcagggcttggcattgggacatcctgattccagtgggaatagttgtcctaaccacttggctagatggctgcctgtggggtggtgcttctggatggaacacagggtgcacagtgatgcatttgggaatcactgaggcaggagagtgaccccacccagccctccaggtcagccaggataaccctggagggctggagggggacacgtcctggtgagtgcaccctccctctgggttccaggtgagatacccttccagctggccttttgagcccagctcccccaggaaggaaggatgctctccagcaggcgctcctcagagcaccttctgtgttttcacctcacttagaaaattcaacctctaaacatcattgagtggcactgagaactaaagccacaaactcccaacttgagaaaatgcaatatttatacatttaaaacagccaaaatggttttaacatacctatactgattcaaaaaagaagtctgagccaggcgtggtggctcacgcctgcaatcccagcactgtgggaggccgaggcgggcagatcatgaggtcaggacattaagaccatcctggctaacatggtgaaaccccgtctctactaaaaacacacacacaaaaaaaaagttagctgggtgtggtggcatgcgtctgtaatcccagctactctggaggctgaggcaggagaatcgtttgaactggggaggcagaggttgcagtgagtcaagatcacgccactgcactccagcctacgcaacagagcaagactctgtctcaaaaacaaaacaaaaaaaacaaaaaaaaaaaaaaaaagaaaaagaaatccgttttcgctgagccctcctggcaggtagtaaaatcttggacttgagctccctggggccctgtccagttgccctcagtgccctcccttccagcttacccatttaccaggtgttcgaggctgctgccagtttaaattttgtttcaaaaactggccttctctttctttttattctgcaacattttgccttggggcctagaaaggaatccttagtcactgattgccgtaggcggatattacctcacccagtatgggcttccacgctaaagacctctcacaaacacttgcacactttcagactcaccctgcacaaggcacgctgacgctgtttcctagggcttattcccaagaacacgtctctgctgagacttggtttttgttaggatgtgtgtgattccatgtgttccatcatgcagaggagatgctgaaagttagcgctgtggctttcaagatcctcctgtggcgcctttgtatatggcatagaatggtgccaactggagtagcctgagaaccagaaacaagaattctgcttctgaacagcttcgtttttgggccagagaattgtttccaccagaggaggcgtgatgggagcttaggggctatgtgctcggtttctgaagttgtacaacggagcattcatttgcattcatttgacaagtcctgctgtgttcctttacttgttctcttctgtattatgggcttaagggtcgcttatttcaacatctctatattttccctgaaagctcagtaatgattgaatcacagaatttaaagagcttgtcgtataaatacatctaaagtgaaaaagatgaactttttccccagtgaatacaggcaaccatcaatcaaaggaatgcatcctggaaaagaaaggcacagggtaaagcctgcctcctttgcgggtcccatctgttcttgggaggacagtccccatgtattgctcctgggccctttgtggccgagcacgaacagctgtacatacaaaggaggctgtgtgtttgttcatgatgttggaaccggaagtggaaggggctttcttgtcaaagaaggcacatatgagtgccatagttacgggacaaaaatatttctcctggaaaatctattgaagcctttgtgcgatgttcagcagagtgtgttgggggtgggtgtgaatgtatctgtgtgggtgaaatgaggataatgtggtcatgtgaacaattcaaggcaagaaaagatccggtgatactgagaatcctgattctcctttagagataggagttctctggctattctgaagagtgaagttactgcccatgatgttgcaacatatggacatttgcaacaattttttttttttttttgagatggagtctcactctgtcgcccaggctggagtgcagtggcatgatctctgctcactgcaacctccacctcccgggttcacgccattctcctgcctcagcctcctgagtagctgggattacaggcgcctgccaccatgcctggctaattttttgtatttttagtagagacggggtttcaccatgttagccaggctggtctcgatctcctgacctcgtgatctgcctgccttggcctcccaaagtgctgggattacaggcgtgagtcactgcgcccggcctttttttttttttttttaaatgattcttttgttccagttattgacctagcaccagcatttgtcttatggataaggtgagggcaaaattgcactgggtgtggcaaggtgattctgcacttagaggttcgtgtttatggtgctactgagggactgaagaattcatctggaaacttttggctgctcccctatcctcttcttgctaaatcagaatggcatacagttaaaaatacgggccccaacccgaacacaggatttcaaggcttgctcactgcttgcatgatcttagaaagtcacatctgactccaaaccttcgtttcttcatctgaaaaacggtgacgatgatgacagaactaccacctgcatggtgatgctgtgcactcaggaaggttttagaaccactagagtggactggggctggaatggcttctgtcacagaattcagagttcccttgtactgcagagagtcaagtgcagctgaatggctgctaccagggatattacccagatgttcacaggtcatgaaagtgtgggacaagatgacctcagagcttcccctccaccggtgacaacacatgtaacatgcctcctattaagcctgtaatggggtaaattgtatccccaccaatgataagtccaaatcctaacccctgatacctgtgaatgtgaccattcttggattataagatctttgcagatttatggatcttgagataagatcatccttgatttaggatgggccctgaaatccaatgattagtattttttatgagaaaggagtgggagatatgagacacagacacacagaggggaatgacatatgaagatggaggcggagacagtagtgaggcatctcaagccaaggcatgctacgggttgctgacaaccaccagaagctgggagagaggcacggaaaagattctccctcagagcctcagaaggaacccactggactaacaccttgactttggatttctggctgctgggacaatgacggagtaagtttctgtagttttaagccacccagttttcgatactttgtcatagcagcattaggcaactaattccatatctcacccataataaacactcagtgctagcaattggctgccactgtggtgcttatcagcatggaactatgtgttcctgaagagaattagttattccatttctatgaatattttcaacccaagattgttgctctcagttaacgtactgaaaatgaacttggtgaaaaagtaaaagctcttctacatatcccatttgtggatagacttaagagaacagaaagcttattatggaataagcaaattaatacctttgggatcaatagagtgtctacagttcaaaaccctatcaaaagtgggtttacgtaaaaaaaactagtgtgttatccatgtgtaatattttgtataatatacaaaattctggaaaggaagactcacaatgccagatcaagtattgcaacgtcagttatggcaggaacaaaggctcttcccagaagcctgtcttcattgtgcattctttcaccagaacaacttgctgtacttaaggcacaggacatttggatctagagatgtagctgttgtgactcaccatttctataaacttggtgactggtcccaggctgtcatatctgtacctgatccactacagggatgaattgacattttcagtggctactttgagtccagatattaatagatcagcctgaaagggaggatgaggcagtaatagcacttttacaagcaatagaagacaagctcagggaacaaaagagaagggaagctccttgaatttaaaggcaagggcagagatttattcctccactaaatctaaggactaaaagcttaggtggagagagggctcaaatgtgaattcacttctcatgctccctttgtgacctcctttaaggaaggccagatttgaggaatgagattttcccaaggggaggaagcattgtcttcatcacttcatgtatttttctcagaaggctattggcctcctggaatttttacttagaattccagatagtccaatgatgctttctaggtaccgtggctttcactgtggtgagagttttggctgcagtgcttttctgtaacccactcacaaagcctttggggatggtgatagtatagggattgtccttccaactagttgctctccaactagaaaggcgaatccctttttctttgagtcacagaggatggagaggctcagcattctcattccctgtttgggtttccacccctgtggccatgcaatttccatttatagccatgtattggcttacaagcctaacaccaatcctgacccaaagcatgaggcactctcacacatttctaggttaagaacactaaaaagcaggatcatcaggttattttttgttatttgtagatttctgcatagcctgatgcttcaacttcccaagacctcatttcttcccagagtagctggagtagctggacctttatcatgttctggtatcaaattctgccttggtaatgtgtacaatgcttcaagaattgcggactccatattactctcctgtgtcatgtagttctctctttgtgaaagccatccttccctgaaacccctcatccacctgcctaccttgccaacattccctgctcctgggttgcccttcattgtgttctatttatgggtaaccatgctttgccaggaaccatgccaagtacttggaatacgaaggaagtcattgatggagaggacacacaagtaagtaaagggccctgataaaatgcgacgagagctaggcacgtggatttttatgcaacaaaggagataggcaaggagcccacgaactagtttccaaatgctggacccccttgatcaggaccttttcggagcaggctcaagtgtctcccaacacctatacctggctggaccccttgccattgtctcaccacaagttgatgctatagttccagagggctgccccgccaggccactctgtcttttgcaattccagggtgggatgtgcattgtctacttggacctaggaactcccttcagcagttctcctgtggacctgtatccaagccaccctacaaagtgagcatgcactctgatttaggaaacttttcttgagagatttattctatagtctccctaacatcccattctggtgtttattccattaatttagagcaaacacccattcagtgaagggccctgaaaggcatagaaaaggacaaagtatcagacttgatttctgctctcagctattaaaactggagaggcaaggcacatagaaagatagggatgacatgatatttaaacaaatgttctacacagtgtttctcaatataatgttcttgtcctgttggggggcttttcagtaagcagtgtcagtgaaagggcagtgacagcaggagatgatttttggttattttctgcataggcatcctcagtatggaaggctgtgcccacctacgtttgaaatgtgcaagcttgattcttctctcttttcttctttattagtctagctagcggtctatctattttgttaatcttttcaaaaaaccagctcctggactcattgatttttttgaagggtttttcgtgtctcttatctccttcagttctgctctgatcttatttacttctcgtcctctgctaacttttgaatttatttgctcttgcttctctagtcctttttattttgatgttagggtgtcgatttgagatctttcccactttgtcctgtgggcatttagtgctataaatttccttctaaacactgcttcagctgtgtcccagggattctacaatgttgtgactttgttctcattggtttcaaagaacttatttattcctgccttaattttgttatttacccagtaatcatacaggaccaggttgttcagtttccatgtagttgtgcggttttgagtgagtttcttaatcctgagttctaatttgattgcactgtggtctgagagacagtttgttatgatttccgttcttttgcatttgctgaggagtgttttacttccaattatgtggtcaattttagaataagtgcgatgtggtgctgagaagaatgtatattctgtggatttggggtggagagttctgtagatgtctattgcgtctgcttggtccagagctgagttgaagtcctgaatatccttgttaattttctgtcttgttgatctgtctaatattgacggtgggatgttaaaatctcccactattgttgtgtgggagcctaagtctctttgtaggtctctaagaacttgctttatgaatctgggtgctcctgtattgggtgcagatatatttaggatagttagctcttcatggaggcaacctcaagtagcattattgttcttttcatccttcctctcctactcacctcccccactcctgacaaaatatggaaatcctgtccctgagtagtcttgttcacaatacacaatctcacagccaaaggaatgtatttttaaccctgagacgccgaaaacggcttgaatcattcatgctgtcgtctattagtctgccgctgtgctgttatttttcccaggcttaatgagccctcatggcactgcgctgcctcagagcacggccgcagcttcaagcacagacaagcctgctctttaaatatgcaagtcatcagcctttcttggaaaatgctatggggaaggtgctctggacaagcaaacagatgatttttgcagactgttctgtagttaatttgggtcatgaagcccactgtggctcaaggagtttaggggacagaaaaggggcttttgaaggattaacaaccagataggaagaaagaaacaaatgaagggtaatcctggttttcttttgagactgacaagaaaaagttgtttgaaaggaggacactccaccattgttgttgttgaaggagagctgtacttctgatgtcccccaggctttgtagtagttaaggggtgagggattgcaggagctgctcaaacctggctgctaatatgacactaggagcctgggtgacacaggggccatggtgccagctgcaggtagcgtgggattgaccctgttagccctggacatcaagcctggagtgagagatggcccgaaaacccctgggacctgatacaagcaagggctttgggatcaaccaggctctcactaacaggcatcactcaaaaagaaaagcatttatttaatagagagtttcagaaaatgttccccttattatttttctttgatttttgaattggaaggcgcttagagatcctgtcctttaacccttgcgttgtgcagatgagagatgtgaggtcagggaagtttagtgggctcagggacgcacacggagttcacagggtagcccgatgcagtgggagggtcgatgggcttctgcctcagagttcttttcaccctaacatttcctgtgcatttgtttacgtgtgccagggatcgctctaagtgctttgtacacattaaacttatctaatctttaccctaactgtgagaggtggctgccatcatttttatttaatttcactttgcattaaatgatgttggcacagtgatgttaagtctgttgcccacagtctcctgcctggaagtgacagtcaggattcaagccaggcagtgggagcctctggagcagccctccaaacctctaccccatatggctcacatagcctctaaaaagggttttgtgactgatctgagatcctaaccattatctatgacttcatattcctgagcagggggcagctggggaagcatttcaagatactcaaggacaaagcacccatcaacatagatgggtgcaaactcaatgctatctagttcgctgcagctgtttggctaaaggaaaacagaatacctgcagagctgatggcttggagactagatgtacaagattacaagccagatgcaagtctagtttctggggtccatctgtgagcagaggtgtgggtggaggcccagaagccaggctaccatttgggattgactcttagctccttacatgcacttaagcagccattcatgaccttttctgcagctcaactgatacactcaaggctgggcatgtccttctgttctagtcattctgcttttggtccacttctatatgtttgttaccaaactagacattgtcttcaagacccactctggccaagtcctggggtcatgtttagtcctggaaggacctccaggagatggaggtagttcttagttgaccagaggggagcaggaccacctgtgctttaaggtcatcctgatttcctggtggtcgttaatacgaaagaagctacaccaggcttgacttctctgagtcagtggtgttcagagcccttgactcaccctggacctgggcttggcaggaatttctctaaccttaggtggatgtatgggtgagtctgcacagcaacttactgttctggtgcatttgtgttggcatgcccatgtaccgggagatgccctagggacttacttatgacatactgacctagagagggtttgcgtataaaattttaacttgactcactggttcctggcagggtcaataaatatttgtggactcactgagtgaatgagtgagtgaatgaatgaaccagtctgctaagaagtgtgagcacagaatatgtgtgctgttctgacacatgatgaccctatcatcctttgaggacctaccatatagctcagttttgacactgcttgtgatttttttttttttttgtctttgagacagggtctcactctatcacccaggctggagtggagtggcatagtcataactcactgcagccttaaactctttgactcaagtggtcctcctgcctcagcttcctgagtacttgggaccagaggcgtgtgctaccatgccagataattaaaaaaaattttttttttatagacaaggtctcactgtgttgcccagggtggtcttgaactcctgacctcaagcaatcctcctgtcttggcctctgaaagtgctggttttacaagtgtgagccaccaacccctggtcccacctgtgatatttttcaccagctcatggccgtggggagcccgactatttgcatacgtgttttttgctcagtactgacacctggtggcagtgtcccaaattgcaagcacagtctctagcattaactcagtgtcaggactttggtgtggcggaccataagaatgggagcctctggagttatgcagagagaagtagccctaccagggaagatgtaatcttgcaaaataacctacctaatgacaatgagtctcttgtcttttcttagggctgcataatcagcaccacctgatttagtggtaagaggaaaggtgctagtgggaaatgccattatttaaaaatacctggagactactgatctagtttaagaccaatatttgtcccacatttgatattagaaccaatagaatgatagaagtaatagctatggtactattaatagctcctattgaggacctgtgaacacactgctggaccctgtatatttagtatttctaatcctcatgataacctaacacatagggattattatttccattttacaaattaggaaatggagctttggtttagtaacatgcctgagttcatggtaggggctggatttgaatctcaatttgcttgacctcaaaggctatgctctttcactctgcttcaagggtactgtgttactccaggggtgccattcacattctagtcagtgtacatggcatttctggggttgtgtgacttgtagccatcctctttccatcattcccactgcctctccaggagccaatcatttatgtctcttctaagctcagtgggtgactgaggctgtgaagacatttaaaattgaataatgtatcctgtagtagatgcattgactatttctctagagttggcatcctaaaattcaaaatttttggtctggcagcctgtgaaaaaaatcgtattttgcctctaattctcaaccctggagagcgccaattagttgtgaagttactttcaaactgaagcccaatttatactcctaataaaaacatccaatgtaatcatatgtgaaatggaggctaatggccctataccacccgagcatcaccatagtgatggtgttgaggataaaaatgatgacaatgacaacagcagcgatgataatagttaaccattgtcgagtacccattatttccttgactccttatagacactctgtgagggaagtaatagtattgtcccaattttcagaggaggaaatgaggtgtagagatgctagttatcttacccaagctcagttgactgtgctggtaagttgtgaagttaacctaggttagcctgagttcacaggctatgctagattaacttcagctagccttgcttttaaccacctacactgacagcctttcaattgtaagaggagctttgggtttttgctttgaaagtagaaacaagtatctagtgataataatatgcctaataattatcctgcacaaaataaataatccagccacttatcaccacctctaaggcaccttctcatcctgtcgttttaaggttttgttcttttggttctgtccccagccaggttttcttttccctccacatgcctggtgtggtgtgagtaaagcatctgccattttgattatggcacacttgctacctcttcttaaaacattcgttctcatccctagtattgtgacattctatcatatctctgatttttaaaaggacattggtgaatttccagaaaaaaaattttccaacctccttttaacctggcatcttttaaaattaaatatgtctctccaaacatattggtggggaagagttggtgtcatgagttaagtaggggtataattacaacccgaaagtttgggggcaaaatggagcagttccctcattggtcagagttctgtcattggcccagcctcctgtcctccacaaatctgagtcagggtgagacaccaagagcctcccttgagaccggcactacttggaaacatgactggctatttctgctgcaggattcctggtccgggctccagcaaaattattgttgtgaacataggccttgaagaggaggctgaagccgagaagccaatattcactcaccttttcaaccttcgacaaggctgaaatttctcccatgatatcactggaaggaagggcagagggagtcaacaatgaagaaagtgggaagagggagggagaatccaggcaggaaaaggggggtgaccgtgcagcaatagctgtgagggcttcccagcagcgttagacacaccctttgcttcagggtcgccatctctgtctgcatctccttcctctccttttgacccagcgtccacttctactttggttagttaaatattgaaataaactcctttacaatgtgtggaagtctcagctcctcagcattgtatcttatgggaatagttactcttcagcctccgtgtgtatccagggcgtggaggccatgctgtggggactgtgtgttaatgtccttgtagctcaagaacagctgctcttaaatggtccgtgctgcggtttagtggacacaacatagcacagataagtgaagaaacaagtcatttttaagtgacgcaaatcacagtagaaatatgcaacttatggaagtgaaatccttttagtattaatttttcttaaatagcaatcctttgtagttgtaagatatgtaacgtatatattgttacctagttggatgaaaaacagctaaatcaatgattgttaggtttcttaggtgaatgatctgtttaataaaattattggaaatgcatattctttattttgatcaggtggacaaattgttccatttcatagttacaccctgacttccatttctgaagagataacccaaaggttactggtggtgatggagggcatcccagtcctcccctcatttgaggggcagagcttaattctggattgtgcttcctccactggagttgatttagagagcggtttggtgaaaaccgaagaaagggtttatctcagagcctcctgctcttgtttgaacaggctgcagggattaacttgtggttgggactgagccagagagataaatgacatagcccttgtgtgctcacattcagagggagctcttgccaaatgggacaacgaaggattgtgttaaagagatttctgaacatcttaatacagcaggatgatacagtctgctctctggactttctggggagcactgagccaagcctcagaggactgtggcatgtcgtgagtgtttaatatgcaagtgacatctaacaggggaaaacaagacatttggaaacaccattgggtggggtgggtcccccgcatttttcagcacggattttttccaacaatctcatatatacaaaggaagtaaattcacaaaagattgggtgttgggggcgtggggcgtggtgaggaaggaggaaagcactaaattttattagagtgcttctcaaaattgagagactgaaatttccaaagcaggaaagattacactgaaagttgggaatgtcttacaaatgtacatattgtcctctacgcgtgatataaaattgttcagcaatagatatttcaggaaacgtaatcagtgtaaaccctttgatgaggaaagccatgcaaacatttttaaacaattgcatccttatgtaatcctggtgttaaggggtgggcttaaaaagccaattcggtgagtagagggactcgtaccttatacagggtttggcgtctaaagctaacacctaaggcataaattaagcacatttacaattgcccttgaaaattccttaagttgcccataaagtacacaaggttttgtgtgtttgggtcttttcagtaatataaatgtggacgtgcacaatggacaacacttaatagaacacacatgcaaaatagaattttccagaatttttattgcacaaaacattcacatagagtgcacctggttgaacgtatggaagttacatgcgcatgtggtatgactgcagttgtggatagacctttttactgcgtcctcctctctagcacctaagtggttcctgtattcttcccaacgtaattaaactgcaggaggaaactggccattccaggtttagacagctgcccctttgaaagagaggaaagtgtgtccatgctggggagaggcagctgcaggaaacgtcctgagcttgtgaaagtctgaccccaggaaccaccctgagctgacctcccaacattctggttcctactcctcaggctcagaccctggttggttcacggccctggggtcatctacacctctttggccttgaccttggacattcggcccagccaccttccactccacttttttttctcatagattcaccgttttcatcctgcccatattctcccagcatccagccaatacctagttttcccagcatctagccccagttcctagttctgctgcccctgctctaggctggtcagttatatagcgttgcttccctgcaggtgaggtggcatgtgacagggtagggtaggtctgacacccctgcactctctctacccacaccgtgaaaaatagtgagacaacagcattgcattcttcattttgaaagaggtttgaatgtttttatttgtggaaggtagatgtcatgaagagttgcataattaaactagtacagaggaaaaactggcagagaagtgagttgcagggctaggtttacatacaggatgacaaacctgtctctaaagatcccgggaactgttgtcacatggtgacagcttatgatggtggctgaggacactgctctttacctttgtgtctcttgtctcgtctctgaatctcaatacctgtaattaagaaggagcccataggagttttatccatcttattttcagatatttaagcagaataaatatattttcacaatcctttgaaactctcttccttcttaaaccttaatgagattccaaggtagcaacaaaggcctttctgatattacctgtacaatcaaaaactgagcttgaacttcctataatttcttctttttggtcaaaggagtcaccctccaactgacatatttataacatgtccctgtgataacgagaaactactcacttatctctgagtctcatgacagaaagagtatcagaaaaaaagatactacaatccttcaaacacacagcagtgtgagacaaaaattacactctaatctgcagttgaacaggttctgtcttccattaaacctgtatccccattttattatatagttgagccagttatatatgactcactgggaaagtgcattttatgatcttgttagaagaaatggtttctctgggatccttttaagccaataattttatacctagctcctcctaaatatctaggacattaacttattagccattccggtgtcaagcctaatgctttttaaatacttaaaacaaataccaggaaactgtgggggttggagaatagattttccataggcatttagtgctttcagagatcagggggatcgatctcaggggatttagtaggaaaagacttgattctctgcttcctctgcacacagagctttcattttatgcaacaggagggacagcatgcatgtgggataaagccaggctgattatttcaaaaccaggctcacatctatttgactgacaaggtcctggcccccggccagggttacagcaccggaacatggtctcttctctgcggctctgctggctgggcctgtgtggaggcgggtggatggggggatgtccaggctgcagctgacagggcacttggagatctcagaaggcagtggaggcttggggactgaaggggacccggcttcgatggggtggggaagcacagcagcttggtaggaaatgacctgaaagagggattcctaaacatgcatgtatgtttgcgtgtgtgcatgaaagcagctgtagatcacaactaatcttttttttttttaattgcaaatcccactcaattcttcaagctttcttggcagcatctgatccagttgatggctttggaaacacttcattcttcattggcttctatagacatctcctcccgggggttcttggcttccctgaccactccatctctgttctctttactggtccttccttctcatccgtcattttaaggttttgttcttttggttctgtccccagctgggttttcttttccctccacatgcctgatgtggtaggcagaataatgaccctcccaaggatgtccatgcccttatccccagaacccggtgaagatggatgttacaaggctaaagggattttgcagaagtgaggaaggttatggatcccaaggtggggagagcatcctggtttatccagatgggcccaatctaatcacatgagcccgtacaagtggaagactttctcaggctgggcacaggaggagccatgaggcagagggagtgacagtgaggtttgaagtgtgagaagtgctggatgacatgccactgcaggctttggaggtgaaggggggcccatgaggcagggcaagtgggcagcctctgaagctgacagcacacaagaagaggaggacctcagcctagggccacaggaaactggattctgccaacaacctgaccaagttcagaaatgtcttgaatcccagagcctccagaagagaacatagccctgcgttcaccatggtttcaacctgtgagactgagcagagagccagccgagtccttctgtgttggacctctgacctacagaaccatgaaaccaatcattcgtgttgttttaatctgctaaatgtgtggcaatgcagtaccacagcgataaaaccaatccacccaccaccaatggtcttatgattctaatagcttcaattaatcctataaactgacagccggtccctattccccattctgctgaatcccaaagcctcacgactttcttctgttaggcaactctgcttggctgtgttaaaaacacatctaaccctacatgttagaaactctgccagctgacaaaaccagaaaccttgagtcagtctggattctttcctctctgttttattcattgtgtaatctcaactccatcaggtcttggttgaaatgtcagcatctcaaatgggtcgcctccgaccacccaatttaagatgacagcccccctcctacacgtaatcgtcctttatgcttatcagcatcagtgtattgtatgtttacttaccactttgcttattattagctgtcttccctcttggaatgtcagcacatatgtgttttattgtattaattctatttaataagtagtaatagagtggtttccaagtgtcaggaactgctctaagcatttttacaaatatccacttatttaatgctgttttttcaccgtcatagctctagctgttagaatagtgcctggcatgtagtagttgctcaataagtagttgttgagcgaataaatgaataaatgaatgactccagcctaacacgaagtcctgtcaattctatttcctaaatacctttcctaacaacccacctttctccatctgtaatgaactaagaaagtggccgtatcattctcctttgtagggcccttgaatggcttccctttgtttgtgggagaaaatccacactcctgcagggattcacacacgtttcttgtcatgccctcagttttctgcctccatctttatttctcaaaactcccctctcatcctctcttgccttccttacatgctaatcttcaatcagcccggacattcagtttccctaatatgtcccatcctccctcttcttccaagcccctgagtatgagctccttaccattggcattccttcctactacctgccctgttctctgcttattctatttttttttttgagatggagtcttgctctgtcacctaggctggagtgcagtggcgcgatctcagctcaccgcaacctccgcctcccaggttcaagcaattctcctgcctcagcctcccaagtagctggaatcacaggcacgtgccactgtgcctggctaatttttgtatttttagtagagatggggtttcaccatgttggccaggctggtctcaaactcatgacctcaggtgatccacccacttcagccttccaatgtgctgggattacaggtatgggccaccatgcctgggtttctccgcttattcttaatattttaactcagctgtttccctcctccatgacaggacacctccctcacctccacctccactgagaaagtgcctttcctggtgctcactgctattctatcttgtcctctgtccttcccctctctctgtgtgtggtaaagactgctttccctgtgcaattctctcaccagtttgcacggttcttgaggccatgagctggagagtacgatccacttgggcatcaagtgcaccagctggcacctagcagggactcagcacatacctgccgagtgagtgaattggtttcccatggcttggtgagccccggccaggcactctcccgagccaagggggacacttgttctgccagtgttgatttgcaggcgcaattatatgtgtaaatgcattttcactgttctgccttaggacccaatttttgaaaattagattttaaatgtcgtattctcctcacttacatcttatgcttcccgacattcagcacataatttaaaatgaaaggcatagaaaattggactcatttagtttactccacttgaaatccatgtgagtctatttttaaattctcctagaccctgtgctcttttagggtgtatttgagaggaaggaagggggtgggggagaaaggaaagaagacactcattgtaagctgttagagatgctgcgtgttattgcactttgttttaatacatgcagttttcacattagcattaccccaaatacaatttctaaagccaaagactgaaattgagactctgccttcaacatttgctgctccatgacgttcttgattgcaatgagaggctggctgtggccagcttgcgggtgcatcacagcagggagctttaacattctttcctctgctttccagctgacatgttcctccggctctgccacacccatcagatggcaggtggggagcagattaagacatgggcattcgcagggtgcacagaacgctggcttacaaacacctcctctcataggcatgcaggtgaacagatgggtgggtgggaggttccccttcacccacagtcctgaatctgagttcttgggttaggatttggtatggcagccttcacattgcacagatatccctacattgggctgctctgcatgcctgcaatgagagtttttgggcttcttgcaggcaggaggtgctgagtattcacaccaaagcttggacatataagacaccagtgacccctattctgctaattcataacactcagccggctcccacattcccactgcctgtgcccatccccgagaggctttcctaccttcctttttctgctttataaagcaacagtgagattccaggagcaaggccagcaaagcgaggtaggagagctcatagataatccaacaaacgtgtatggagagcccaccatggggtgctctccccatgaaacttcaattttttttttttttttagatggagtcttgctctgtcaccaggctggagtgcagtggcgcaatctcagctcactgcaacctctgcctcctgggttcaagcgattctcctgcctcagcctcccgagtagctgggactacaggtgcacgccaccatgcccagctaatttttgtatttttagtagagatggggtttcaccatgttggccaggatggtctcgatctcttgacctcgtgatctgcctgcctcagcctcccaaagtgctgggattacaggcgtgagccaccgcgcctggtctgaaactcgaattctaatgggaaagacaaaaataaaaaacaaaaaatatataattgttaaaaggactgcagaggcaccagtaaaggatcagagagcaaattatcagggtggcagccagccaagaactgtaggggaaagtgccctcaaaggcgggaacatttaagacaaggcttaaaggataagcaagctgcccccacagggagggagcagagcgtgccagacagaggatggggaaagagctcctgcagtggagatgagaaaaccagacgtgtgatctgggggccgggggacgaggtaaccaggggatgagggaaagagggaaaaaacaagcaaggctgaccatgccccacctgaaggttttgggaaggatttggattttattcaagatccagggaaagccagtgcaggtatcaagcaggtttttctgggatctacttccaggaagaaggacaagtataaaaaggtgcaggggaggtgtaggctcctcccctaagagggaacctgctgggtggccctgtagaagacagcagtcatagtttccatcagagctgtgcattcaaccttctctatttcccagctgtgctgcatggaaacagaaaatggcatggccaggccaggggcagtggctcccgcctgtaatcccagcactttgggaggccaaggcgggcagatttacttgaggtcaagagtttgagaccaccgtggctaatatggtgaaaccccgtctctactaaaaatacaaaaattagcctggcgtggtgtcacatgcctgtagtcccagctactcagaaggcccatgcaggagaattgcttggacctgggaggcagaggttgcagcgagccgagattgcaccactgcactccagcctgggcaacagagtgagactgtctcaaaaataaaataaagtaaaataaataaaaaagaaaaaaaagaaaacgccatggccagaggcgccacattttagcttcaggaaactgtgttgaatactctgagttgtaccagcagggacactcccagccgcccataggtccttgtgctgagcaccgggcattgcctccttcctgcttctaccaggaaaattgctgtctgggagccttataacacagactgctggggtttgtgggagatcaaggattatgttccctgtggactagtttgaaaaggttgaaattcagccccttcataatgtcatgctcgtagctaagaaggcttgcctttttctcttcctttgtccattttagaattaactgtggatatcggtaaaagcagcctcaccactaatacatgtggggctggggccgtgatacagcccaaggcccctatactatatatctgcatattttcagagataaatcagtctagtaaatggctaaatatagcatgttctattgtcctaccttgatgctttaaaatgtattattcaggcatgatgaggccaacagatcaggagacagctgccattgaaaagagtttgttactcacagttcccaagggctgggacatgccatgctatgccaggccacatggcgatgcaccagcattggtgaggaggtagagagagtgagggggaagatgtgggcaagagtattgcggtttctgtgagaaggaatgggaaaggcaagacaaccaggcttgggattagctagtttgaataacttccgtggactctggagtatagggggtgtccctagttatctgatgccaggggcaaaggatagtagcccagcatgtgagaccctagtacaggaggtggttgggggtgtgggttctggatttcttggttatcctagcaagggtgtgctcacaggttagttgtttactctttctaggaatgaccctgggaggagcagtccctctagagtcagcaaggccccaagatgtcaaagcatcataaaatactgaaaatgaaaaagaacatgattgttgacgaagaacatgacttgacaatatgactttttttttttttttttgagacagggtctcgctgtgtcacagaagctggaatgcagtgatgcaatcttggctcactgcaacctccacgtcctgggttcaagctattctcctacctcagcttcctgagtagctgggactatggacatgtgccactacagctggataatttttgtatttttagtagagatggggtttcagcatgttgaccaggctggtgttgaactcctgacctcaggtaatccacctgcttcggcctcccaaagtcctgggattataggcatgaaccaccacacccagccacaaatatgacttcttaatgattaatgattaggagaccaggtatgagtttagaatgcttgaattccttggactctatatcagaaagcagaggtgccagagcactggtccactgaacccagcctccagctctatttttctgcacatctctgttttccctcaccatgactgtcttgcagatttgtgcacagacactccagcatgtgtgtctgagttttgtctacctgctctgtggtgggggcttggatgcactgcccagatccttcttctggaaggaagggtcaggtttctgcagctactcccagctgtcagcctttcaggtttgtgggggctaaagaaaatggccttgtccaaagttgcatctggatctggtatccaatcaatgcagaggcataaaagccttgtcccttgtgctaactcggaagaagggctccttggcttcagagctccctgtgggttggctggggcatttgtcagatatgctttgcagctccgtgcaatcctgcctcttctctgcactttcacaggtggtaagcagaagagactccctaataagcatccagggtgttaaactctacctcagggtcagcttcctggggaagcccacccaccacagtccctttccactcactttccttccacatacccttaacgcagcaagccccctgcaccctcaggcctaggaaagcacagactggccatactgtgcacactcagaagcctaagctggcaaagaggcttgcttgagtttaagaagcggaagttacaatcctaatctctgataaaatagactttaaaccaacaaagatcaaaagagacaaagaagggcattacataatggtaaagggatcaatgcagcaagaagagctaactctcctaaatatatctgcacccaatacaggagcacccagattcaaaaagcaagttcttagagacctacaaagcggcttagactcccacacaataatagtgggagattttaacaccccactgtcaatattagaaagatcaacgagacagaaaattaacaaggatattcaggacttgaactcagctctggactaagcggacctaatagacatctacagagctctccaccccatcacaaacttaatccatcacataaataccaaatacattcttctcagcacctcatcacacttattctaaaattgaccacataattggaagttaaacactcctcagcaaatgcaaaagaatggaaatcataacaaatagtctctcagaccacagtgcaatcaaattagaactcaagattaaggaactcactcaaaacctcacaactacatggaaactgaacagcctgctcctgaatgactcctgggtacataatgaaatgaaggcagaaataaagatgttctttgaaaccaatgagaacaaagacacaacaaagcagaatctctgggacacatttaaaacagtgtgtagagggaaatttatagcactaaatgtccacaggagaaagcaggagagatctaaaattgacaccctagcatcaaaattaaaagaactagagaagcaagaggaaacaaattcaaaatctagccgaagacaagaaataactaagatgagagcagaactgaaggagatagagacaagaaaaacctttcaaaaaatcaatgaatccaggagctggttttttgaaaagatcaacaagacagatagaccactagccagactaataaagaagaatagagagaagaatcaaagagacgcaataaaaaatgataaaggggatatcaccacctatcccacagaaatacaaactaccatcagagaatactataaacacctctatgcaaatgaactagaaaatctggaagaaatggataaattcttggacacgtataccctcccgtctaaaccaggaaggagtggaatccctgaataaactaataacaagttatgaaattgaggcagcaattaatagcctaccaaccaaaaaaagtccaggaccagatggattcacagccgaattctaccagaggtacaaagaggagctggtaccattccttctgaaatgattccaaacaagagaaaaagagggaatcctccctaactcattttatgaggccagcatcatcctgataccaaaacctggcagagacaccacaaaaaaagaaaatttcaggccaatatttctgatgaacatagatgtgaaaatcctcaataaaatactggcaaaccgaatccagcagcacatcaaaaagcttatccaccacaatcaagtcagcttcatccctgggttgcaaggctgtttcaacatatgcaaatcaataaacataatccatcacataatcagaaccaatgacaaaaaacacattattatctcaataggtgcagaaaaggccttcgacaaaattcaacaccccttcatgctaaaaactctcaataaactaggtatcgatggaatgtatctcaaaataataagagctttttatgacaaacccacagccaatattatactgaatgggcaaaaactgaaagcattccctttgaaaaccaacacaagacaaggatgccctctctcaccactcctattcaacatagtattggaagttctggccagggcaatcaggcaagagaaagaaataaaatgtattcaagtaggaagagaggaagtcaaattgtctctgtttgcagatgacatgattgtatattaaaaaaactccgtagtctgagcccaaaatcttcttaagctgaaaagcaacttcagcaaagttgctgttatcaatgtgcaaaaatcacaagcattcccatacaccaataacagacaaacagagacccaaatcctgaatgaactccctttcataattgctacaaagagaataaaatacctaggaatacaacttacaagggttgtgaaggacctcttcaaggaaaactacaaaccactgctcaaggaaataagagaggaccaaacaaatggaaaaacattccatgctcatggataggaagaagcaatatcatcaaagtcaccatactgcccaaagtaatttatagattcaatgctatccccatcaagctaccactgactttcttcacagaattggaaaaaactattttaaagttcatacagaaccaaagaaagagcccacatagccaagacaatcctgggcaagaagaatgaagctggaagcatcacgctacttgacttcaaactatactacaagcttacagtaaccaaaacagcatggtactggtaccaaaacagatatatagaccaatggagcagaacaggggcctcagaaataacaccacccatctacaaccatctgatctttgacaaacctgacacaaacaagcaatggggaaaagattccctatttaacaaatggtgttgggaaaactaaccagccatattcagaaaactgaaactggaccccttccttacaccttgtacagaaatcaactcaagatggatcagagacttaaacgtaagacctaggaccataaaaatcctagaagaaaacttgggcaataccattcaggacataggcgtgggcaaagacttcatgtctaaaacaccaaaagcaatggcaacaaaagccaaaattgacaaatgggatctaattaaactaaagagcttctgcacagcaaaagaaattatcatcagcatgaacaggcaacctacagaatgggggaaaatttttgcaatctatccatctgacaaagggctaatattcagaatctacaaagaacttaaacaaatttaccagtaaaaaacaaatagccccatcaaaaagtgggcaaaggatatgaacagacacttctcaaaagaagacatttatgtaacaaacagacgtataaaaaaatgctcatcatcactggtcactagaaaaatgcaaatcaaaaccacaatgagataccatctcatgccagttagaattgcgatcattaaaaagtcaggaaacaacagatgctggagagggagtggggaaatagggatgcttttacactgttggtgggagtgtaaattaattcaaccattgtggaagacagtgtagcgattcctcaaggatctagaactagaaataccatttgacccagcaatcccatatacccaaaggatcattgtactataatcattctatgataaagacacatgcacacttatgtttattgtggcactattcacaatagcaaagacttggaaccaacccaaatgtccattaataatagactggataaagaaaatgtggcacatatacaccatggaatactatgcagccataaaaaaggataagttcatgtcctttgcagggagatggatgaagctcgaaaccaccattctccgcaaactatcacaagaacagaaaaccaaacaccacatgttctcactcataagtgggagctgaataatgggaacacatggacatagggaggggaacatcacacaccggggcctgtcgggtggtggggggctcgggaagggatagcttttggagaaatatctgatgtaggtgaccggttgttgggtgcagcaaaacaccgtggcacgtgtatatctatgtaacaaaactgcatgttctgcacatgtaccctagaacttaaagtataattaaaaaaaaaagaagtgctcccagggacatttgggcaggaaattcccgtgttctgggtaccaagaacacaaaccagaattgaaggggcaaatcttttggccatgtgactgcctcaccatgcagaggggcattctggaggaatctggaagtgagggttctctatcatgatgcccagggcaggggcccctcttgggcaggtccaagggctattctagattgaagcagatattcaatcatttgtatttttcctgtgttaatttttttttttttttttttttttttgagacagagtctcaactctgttgcccaggctggagtgcagtggtgcgatctcggctcactgcaacctccgcctcctgggttcaagcgattctcctgcctcagccttctgagtagctggcattacaggtgcgtgccaccacgcccagctaatttttgtatttttagtagagacggggtttcaccatgttagccatgatggtctcgatcttctgacctcgtgttccacctgcctcggcctcacaaagtgctgggattacaggcgtgagccaccgtgcccggccttcctgtgttaattttttacacatacttgttcatcacccatgtatctatcacctgcatattaaaggagaggagacctctgtgtgtgtcttactagccggggcacgttgtcttagcatctttggcctctaatgagactatgtttataagcaaaaggtgcccagtcaggcatagtgaggccacttgggggtgagggccggtgcctggatgtggacagcatgtgtgtgttttgaggtgggagtaaggcctggagtgatgaatggaactttatagccaacaaaaggctttcctcaaatgggaagttgttctgacctcactttgtgcctctgcttggccaatttggcctttttcctgccaaatccatttggcataaggagcaggcagtatttgggctggctgcttgggaactttgtaagacagttgaggagggcacctccagcctggaaaacactgcgtagtccggatctggctgccttacgggggcgccatccttggccactgagcacaaactacgtcttcctgctagtgtcccagcagctctcccaacagcaacagctcagaccacccatcagacccacaagctcgtgtgtcttttaacagttgcatatgaaaagcctctgctttagagggaaaagtaaattctttccttttgcgaaattccctcagtgaaattcataaattatgtttcatcacaactgggcaacaatattgtgtatttgtaaaaacagagcctttggcataaaacccaagtgggtctgaattttttatttactccttgaaataacttctcccagccccagtctccttatcctcaaaagggatttagagagttattgtgagaattaaacaaaataatgatgcacatggagcatcctgccagcactcagtgtgagctcacttttcctagcttaagaagatcaagtgtggattggggcttgttttaaacacaagttgtttaagaagatagtattccacttttaaaacaaagtcccaaattttcttccttcttctgtctataaaaaagaatgaaaaaaaattctgtgtgtgtgtgtgtgtgtgtgtgtgtgtgtgtgtgtgtgtgtgatgcccatatttcagggaaataacaggagaaagaatcaaagaatgagactgcatattctcagttgcatactactaggtaagacagtaaataggcattctaagcaatttaaaaaatactgtaaattaatctccaggtcacaactctttcagttatatgcgccagaaagcaagaaagcaaacccaaatatgcctgctgctgtcagcagggattgctgagaaaagttagcctgtctttccatttagaaaaagcatttgacaaaggcacgtgagtgggaggctgtgaagtgaacctgcttggaactgatagtgttagctttttactgacctgctttccataccgcaagcatttggtttttcttttgtcattgacttgtgcggatttattagactgtgtgcttcaagggtgtcaggagattgcatgtaggagcaggtctgaactgggaaagtgagaattaccatattagatgatacccaattaactagtgacaggcacagcaggtaaaatcggtacctgggctttatctactataagcactcgccacatagcaaacatttttaaacctggtggagcttccttactcatttctcctttccttcatcctgcccactctcccttcctgtctaagcaaggagctgtgtctacctatgtaagtatcaagacagacaggtctttgagatgtgctccagggttcaagggcaatggggcagaactctctgagggtggtgactcactgggaagcaacagccacacaccaccccacaggacaaaacagtggaagtggaggcatcaacatagttcagaataattgattttacttttttcatggacaactgagtcacaggatgatgtcccagttctgaaaacactttctcactctctgttctttgggtacctttgccagcatgaagttacttactataactcagcattctcactcgcgttactcaaaggtgaaaagctggaagaatgagttaatcttacttccacattcaaatgtggctattagggcagtgatggaagctcagagcctgtgcttttggacaggctgatttcctgtagctactctgtcttcctttggtgtgggatcatgtagtccatctagtgatcataatgtaagcttggagggaaatgatttggaaataattgggaaggtaaaatgatatgacatgaaatgcctgctattctaaaacacaaatcttattttatgtgcaactgctgttttggattatccatgcctcctcctgcatcagctagcatggaaaatcctttaagatctctaactcagtcacttcctcagggagtcatgtttaaaccccctcaagctgggccaaatctccctccatgacgctctgagaatgactgctgcttttatcattgaatctaacttgttgcttttattagtcatctattgatgtgactctttctgttaccaagcctgattttcttaagcccacgggcagcgtgatattcacctctgtggccccagtgcctaacatggaatctggcatgtgttaggcatttaaggaacattagaggcagggtgtggtggctcacacctgtaatctcagtactttgggaagtggaagtgagaggactgcttgaggccaggagttcgagatcagcctgggcaacaaagtgaaccctcatctctacaaaaaaattaaaaaaaaaattagctgggcacagtggctcacacctgactcagctattcaagtctcagctgttcaagagattgaggtgggaagatcacttgagcccaggagttcaaggctgtagtgagctataatcacgccactgcactttagcctgggtgacagagcaagaccttgtctcaatgtctcaaaaaaaaaaaaaaaaaaaaaaagaaaagaaaagaaagaaaaagaaaaaacattagatgaatgtatgaatgacagtcaggtataactccaaagagaaaccctttccctgttaccacttattaaatcagtaggactcatatctgttaattttccttctctctgtaaacatcttatcaacatcagagaaaaagagacagagaattaacaacaacatactgaacgatgccctgacaatgagaaatgaatcccttgctagtttggtaatgatgcatttatttggctctggatctagagaatttatattgagtagtcaaaagcctgggaaggactgaactctgttgaactcagaaatcctctcttgagagttctagctaaactagaactaccacagataggtgatagcagaatgctatatttgaaatgctgcaaataaataaatttatacatgcaaatcaaaatcttttagtaaaatcacacaattaacctctcactggggagaaagagccaatgtagatatatgctttagaaagttgttaatcattttctcattgcaacctactttgaaatcaccttggcctattgtctctcatatatatatgtttatatatatatatatatgtatatatatatatataaacttattttacacaatgtagatttattttatgctgatatactagtaatgttcttccctacattttacaaacaatgagattttcatttattgatggctggtctttgcaatggtcagtactctttgtaactctgactttttacagcacagcctttggcctcccctgaatttagtgtctttgaacacctgcttcattttgttggtgctgagatttcacatctcatgtgcactaactgctgtcatgttatatgaagttgaagtcatgtgttttgtaacaatgagctctggaactatcccttactggcagtgtgactttgaaccttactgctgctccatttaaccaactgtaaaatggtgataatggtagagctgcttcactgatactattatttagttcatgtttagaataaggtgtttaaaacaggtcttgcaaaagaaagtgctcagtaaaatggtagctaaattgatatcacgcgtgtccccacagtgggtctccaatgtgacagtcaatatcatttgcgtatgagcagacaaaactctctaggttttaggggttcatggttgatatttccattttgcccttcagtgtgaaatttcactcacgtaggacttcatggaaagaatctaccatctttcaaggacttacacaatcttatgccatcctacctgccaagacattccagctgcaagtccattttcctgtattgctgactttcctgggtcttttcaggattatgttacctcttcatcctcatgcatgatttaattatccgaacaaaggttctttcattcactcgaagacagcataataccttagatatttgaaaatttctcagagttctaaaatttctcctttgtctttcacatcttccttctgaaagattttactaagtgggagttaattttatctaaattgattcttgaatattgatctttgaaatctgatgacttattttcataaatgtaggccaggtctcacttggtacttaatgttaatttagaaaattccaataacgtggctaatgtttgacaaactttgccattaatgctaaactggggaggtccctttggcttccattttcaaaggtgagatcgtatcgtactgatcccgtctgaggatgccttccttattaattgagggtggtggggctggagtttcttcaaatcactggtccattcaatctgatagcaagtctgcctgggtgttactcatttcccatgctattttcatgtcaaatactgctgtccccttatgcaagggatacaattcattgaaacctcgttggacttcctcccacttaacattctcctaccttccgtgttgacattcttctaccttccaacttccgtgtttacactgaaaaagctgttgctgggtagcttggttattttttttcccatcagactcatagggatatttttggattattggttatgatgaatatttatggaaaatgttgctgtgcactccagtgagaaatcagtgttaaagaggctggtcccacagctatctctgtgtccctggaagccgtgtcctttttctatttaattagtgccaagtatatggtcttgcatgaaggaggacccagattgaactcctgtagcatgatgtgtgtttcatgcactctactgttttcactgatttatggcatttaattatcaatctgttaatccaagtttttgtttaattggattcatcaaactaattgtatgaattccactctgttatcatggcctgaacctgaatatcagattcccttaataaacagaaacagtgaatgtgttcctgcttcttcctgatcaggaagggggtctgcagtcctctggtcttgtttgtttcgtagcatttcattttgtattcagcatttctttgagcgccctctttgcttcttggaaccttgccttactaccattgccattctcataggtccctgctctactggacctaaaatggtagggaagaaaggaagaggaggggagtaagaagagaggaaaaggtgagctctattctccgtcagtgtgtctgtggctgtattgattcggaagtttaaaatctaaactccctgtctacagtcttggcctgtcttgaaggttgtgagtcaacttagtgaatacatgcaaggtacttttaggctgtctggctgggagataagttgggtccaaagaaagtaatagttcaacatagcattctccttagatggcagcctccaggcaagaagaaaagcccatggctttgcctggaagttcttgtgcaggtccagcgtgtcaccaactggtgcttcagacactgagatgaggcaaatacttagcattcagtttcttaacaaagtgattaacttgatagacatctagattctttttaaacataagaatatggctttcttttcttcaggtggtgtgtccatttttgtccatcggatagaaggtgctatcacaatataaatggcgcgttgcgtacgatcagcaagggcttcttaagttactcccacttccttagtgatactgtccagtctcattgcttcaaacgccaatcccaaatgtctctgttccagaactttcccaaactccagactcagatatccaacctcacacttgacatctccactgaatttctaaaaacttctgaaatttaacaaatccaaagccaaattcttgtctccccaaacccatttcacttctcattcttcccatctcagttgatggcaatttctgttttttttctggtggcttagggtaaaaatctgtagtcattcttgacttttttttttttttttttggaaacagagttttgctttttgttgcccaggctggagtgcagtggcacgatctcggctcactgcaacctccgcctcccacgttcaagggattcttctgtctcagcctcccaactaggtgggattacaggcacccaccaccacgcccagccaatttttctatttttagtagagacggggtttcaccatgttggccaggctggtcttgaactccagacctcaggtgatccgcccacctcagcctcccaaagtgctgggattacaggtgtgagctaccgcacccagccaacttttctttttcttacacctggcatttgacccaccaggaaagctattgtctctacctttaaaatatatctaaaatctgcccacttatcactaactcctgctaatgcactagtttaagtccctattgggacatagaatatgatactacaaagtacagcaccttggaaactgagaaaacagcagaagcagaaagggtactctgaccatctgctgtctttctgtgtgagctgatcttaaaggactctcttgcttaccttccctgaaaggtgagcataagacccttatgtgacagttgccctgccccccaatgtggagggaaggaatgctacacagaggccaaggagattctgaacaaacagccatgctgagctccagtttatcaccattagatcatgtttttgtccaatcacgtttctacacagctgtccatttttcatatgcttcattgaacctaagcacaaaaatagacagttttctctgggtcttggggtcttcatctctgaaggctcctatatcacataaaactttggtcacataaatttgtcatgcctttctcttgttaacctgtcttttgttataggggtgtcagccatgaccctggtgatgggtgagaaaaaatattctacttttcctcctccacatctccatcatcttttcctggacgattgcactaacctcctccatgtctttctgcttccaccccatcctcccttatggtgtattctcaacatagttgctgtaggtcaatctcatttttttcttctacagtgtttttccattccactcagaacactcaaaatcctgatagtggctttctagttactacagctgtgcaacaaaacatccccaaacttaatgacttaacatcaccattaattatgtgcaaaattctgtgagtcaggaattcagacagggtatagtgggggggacttgtctccatcctgcgatgtctgggtccctcagactcagaggcactaaccacctgaaagctcattcactcaggtatctggaggttggtgctggatgtattctaagaccatcacccaggttttcagcttaaacacctacacagggcctctccatgtggcttgggcttcctcacaaaatggtggctgggttcccaggacagagagccacgcagaaactggactctagcctcagaagagttatagaatcccttccatcatactcagtgggttggagcagtcacagcctgtccacattcaagaagagggaaatagtctttacctcttgatagggagtggcaaggttctggaagagtatgtggtaccagaaatattgctgtggccattttgagactatagtctaccacagtggcccgcttgattggacctgggttgtttctctgccttcatcttttctccctatggaacatttggctccggccacacttgctagagcatgcagatgtgcttctgccctggggccttcagactgcctactccattcacaagatgcctgttgatgccctcttccctccctccgcaaacttttatggagtgtcatttccccagtgatgccttccctgaccactctacagccccttttcacttgctgtctttttttttccccttaaatccttattgtcattaccaccttctaatgttttatggaatttttatgtttattctttagcatcccttgctgccagaatggaagcactacagaagcaggaatctttacctcttctgtccactgagctatctcacatgcctagaacagtgtgtggcacataaatatgtatgggatgtgaaacagagagggcgtttctggtttgggcatttggaatttgcaataattgctccagctagcacaactaagtttgtgtgttagaccagcataagtcaataaaaaaagataccaacttaaacagttgttttcattgtgtaaatgtctctttttatcttttatggactaatgaaccagaatgtttaattgttttaatttccatctaaatatttagtttctttatgaggaatggcagggtactttttccagttccacagtccctcaccttacacatacacgttgactgaaatagaagtctaagaatccccagacactccagtagcatgaatctgggcagcctggcttctgtgtttccacattctccaactttagagtacatgagcccttcagcataaataacccttcagaataaaggttgtaataaaaacaatgataaaacccacaataacaataataatactagtaatagacatggcagcaccattgataattccagccaccatttgctagaaaccccttggctgcaggtgttcttccaggcacttggtgtgcacgtctgttagttattatcttgagaggaaggcaccttcattcctcggatgagcaaaaggggagaacttgttcaaagtatatcaaatctcttttatccgtaaagtgcctctttgatctgctgaaccatagcaatcattcattccttcaacatttggtaattaggaagcgctgagtttatctcaaagagtagctgatctcatcactcattggatgttgagcagttgatttctagttactggcagaatcccatgtttatgtttatttctcaatgaaaggttccacaatcctcctctacccctagtgtggctcttctggttcatctgtaggatgggaatcattacactgtcaggttctctttccctgtattggacaaccgagccaatggctatcagttgggaaaggtaagagatagagcacatgtcatccagtgatagactatcagtgagctgctttttaaagactacagcaaggctggctcagcgctattgctccagcctctgactttctcctgcagagacactcagagccccggaatcctccccaactcatgacttcaggcagccactccagtggatttgagtgttttccaaacatagaatgttacgattactagtggcttgacctcaatcctttggctttgagcttttagttgaatggtttttattcaattgtgactgcagttgcattaactttggatttcctttttttcccccagaaacaagtgtgaaggaaaatactatgaagtacatggaaacacttaagaataaactgtgcaggtaaggataataatttctgtatttcagactccgtagcacatctagattctttattataacagaatttagttaaatcgatgaaaaaggctggccagtttctctaataaattaacaaagaaagacacaaaaaagccttttgaaccccatcagtgaaagagcaggtgccagccctcatcttgtcttttaaaaagtaagtagattaagatgtttaaaagtgtcttggagagatcacaggagagttttcatgttccataagagaagaatcttctttactatattaaattcagaattcattccttagtctgtttttcccttttttaaactttagtgtttgaggggggtcttaaggattttaaggcggtttatacatggtttggaataatatagaaatgcacgtcttaggttctgttttgaatcctgaatcaaaaccagcatgaaaatttctggttgctttttttaaaacccaattaggaattcatctttgagaaatgtcagggatgctgcagcatgacaagatgtttctggcttttgtggatgtgtgcttaggaaaataaatcccagtcatcagaatctgttcctaattaaggcaacaagtactagagtggaatatgcgctttcttccctggaagtcatttagttttatggagaccattttgctattattttggaatttgttaagtaactctttagataggctatgccttaagcctttgtctgctaggacgctgtcttgagctaaaatgctgcttttccattaagagatgttgagagggcctgccttgcagagccctactcttcagggtaagcaaggcactacaggatttattctcatccttggaaagccgtcctataacctcctgattgatctttccctgcttcccatgctcctagacttgggaagaatctatgacacaggtggttagcagaggtgagcagaatgaggagagcttgcacctgggtcagatgctccgctctgagtctggccttcctcctctcgcatgtgttcggggcagatttctggcacatccttcttgatctcaactgcagctgccattgttttagccatcagcacagcacacaccgtaagttacattaggttatcaggcagccagtggtagccataagcacgtgggtattggtaaagagacacccatttaaattgcagctctcccacataaaaactgcctaaccttaggtaagtgctcactttctgttcagtttgttttgttttgtttttttagctatataactggaggaaaggtacctacctccccagctggtgtgtgaatttaaataccatatgtaaagcattcatgtgattggtagtaggcacgcattagtttcctttaccttcttcttatttatttatttatttatttattttgagatgaagtttcgctcattgcccatgctgtagtgcaatggcgctatcttagctcactgcaacctctgcctcccaggtactagcgattctcctgtctcagcttcccaagtagcttggattacaggcagtgccaccatgcccggctcatttttttatatttagtggagatggagtttcaccatgttagtcaggctggtcacaaactcctgacctccggtgatccacggccttggcctcccaaagtgctgggattacgggtgtgcaccatcgtgcccggccacctccttctttatatcattagaactgattggacacttatgagtggaaaaacacaaactgcttttcctctgttctcacacaatgcaataatcaacacagaaggcttctgtgatgaaatacatgagggtttctccccaccaaaaagtaagcaatcagttctgctgcagataccagctgggtgtcctctaactcatttccgacaccagctacctggagacagcatcagatgccacaggttgagggctcagtcccacaagactgccccacttacaatgccaatggcaagcccaggttgttttgcctgggcttctgaccaaccaactagaaattgggattcccatgatcccctccttgggtttgattaatttgttagactggttcatgaaattcagaaaaacacttatatttactggtttattataaaggaggttacataggatacagaagaagagatgcatagggtgaggtatgggaaaggggcaccaagctttcatgccctccttgggcacaccatcttcaaggaacctccacatattcagctatctggaagctctctgtaccctctcctcttgggccttttgtggggacatcactggataggtgtgactgaagtatggacaaccatgtagcaatgtgattggacagaaactgtgacctaccacaaatagactgagtgggaaaaccccacagggcctgtgtgttcagattccccagcttctctgtgcagcgtttcttccttcaggtgtgggacaggactccttctgaaatgagggtctatgacctacagtcagataaggtaggtcagagaatttctttccttctttctttttcataagttcaacttttattttagattcagggggtatatgtataggtttgttatatggatgtatcgtgcgatgctgaggtttggggtatgattgatcctgtcactcaagtagtaagcacagtacccctggaattagttttcaacccttgcttcccttcctcctctgtcagtctccagtatctattgttcccatctttatatccatgagtacccagtgtttagctcccacttgcaagtgagaacatgcagtgtttggtttttcgttcctacattaatttgcttagaataatggcctccagctacatccatgtttctgcaaaggacatgattttattctttatatgactgcatagtactctgtggtataaatgtaccatgttttctttatccatttcaccattgatgggcatctaggttggttccatgactttgctattgtgaatagtgctgtgatgaacatacgagagcatgtgtctttttggtagaatggtttattctcttttggatatatacccagtaatgggattgctgggttgaatggcagttctgttttaagttctttgggaaatctgccaactgcttctacagtgactgaactaatttacattaccaccaacaatgtataagtgttcccttttcttcacaacctctccagcatctgttgttttttggctttttaataatagccattctgactaatgtgagatggtatctcattatggttttgatttacatttctctgatgattaatgatgttaaactttttttgtatttctgttggctgcttgtatgtcttcttttgagaagtacctgttcatatcttttgcccactttttaatagagttatttgttttttctttgtcaaattgtttaagttccttatggattctggatattagacctttgttagatgcatagtttgggaatattttctcccattctgtaggttgtctgtttactctgttgataatttctttttctgtgcagaaatggtttagtttgattaggtcccacttgtcaatttgtgtttttgttgcaactgcttttgaggatgtgggcatatattctttcccaaggctgatggaaccataaaagagcctgaatatccaaaacaatcctgagcaaaaagaacaaagctggaggcaacacgttacccaacttcgggctaaactgtaaggctacagtaacaaaaacatcaaggtgccggtataaaagctgagaatttctttatggtcagctccaagacagaaaggcagggggagattagggtatatttttagtttttatgaactgcctaggggagaaataacagtggatgtgggagttatgagccaggaattgtagatgaaaacctatatacataatttcaacagtcatgcttggaactcatcctctctccctccatgtcagctcctcctcctgttcatccagcccaatgcacggcccaccacccacctggctgcctgggtgggcgggcaccatgggctcatgctggctcaccagcctcctttctcactcagttcccagtcttgtcagtcttgcctctttagcatctcacaagcctgcctacctttatcacactgacattgtgggcccctcttctgatcataatagcaacttttcctgctttgctgttccactgttgccctcttaccaccttctccaggtggttttgagtaagcatcttaaaataccaatctggtcattgcacaaggctgcccgatgtcctaagcataaagcctaaatgccttaccatggttcatggcattcttccatgtggcctctgcatgtacttgattatcacccatcactaccccatcatcaccctattgtagctgatacttgttcccttatgcttcccaatgccattgcattttttttttctggaaagaaactaatttagaaggggacatggttaaggagtatcatccagagaaatattcgattgaatcatgtgaaattgctgatatttcaccatttttgacctagaaaaatgacaatttcatatagttaacccaatatttagggatttgaagtcatcttcagaagggtcagatgctgtggctggtctccttgcccttgacacacaggcatagtttgctcccccacccctctgcatgtgccctggtgggcctctcccagcccacccctcaccctcaccaggccttcccattcagccttcaaggtttagatttctcctctgtgcaaccttccctgactaaccaagactgagtaatgtgcttgcaatgatttattctcactttccaagtgctccttgacaggtattataatgtagcaggacaagccgcagacaaaactcctcagacgctgagttaaagaaggaaaagctttattcggctaggagcttcggcaagactcacgtctccaacaactgagctccccgagtgagcaattcctgtcccttttaagggctcacaactttaagggggtctgcgtgagagggtcatgatccatgtgagcaagcagagggtacgtgactgggggctgcatgcactggtaattagaatggaacagaacaggacagggattttcacagtgcttttctatacaatgtctgaaatctatagataacataaccgattaggtcaggggtcgatctttaactgccaggcccagggtgtggcaccgggctgtctgcttgtggatttcatttctgccttttagtttttacttcttctttctttggtggcagaaattgggcataagacaacatgagaggtggtctcctcccttaataagattaagtctgccttgttcaggactgtattctcagtgatttgccagtgctggatggtacaggggttcccaataaacatgtattgaatgaatgattgaataaatatgtgaattaatgcaaataatttgtaaacatcctaggctcatcttttgtcatctccagcctctttctctgcctctccagccatgctgacgttgcaaagccaccttgcccctggcctcttgactcacataccttagctacctaggatcctgccacagtctcaaatgaccgtgatagtagctggcccttcctgtagcctggagggctcttttcatgctatttcaagctattatgaggcctgggtcagatttgtgtgaactggtatggtgtaaacaatggaacagggaggagaaaaagcagctaggagtctgcaacccctctggcagtaggcaattctattcccacttcagaacaggaggccagagtggatgctgcaaaagcctggtgaccatcaggctctctgtgacagagcccagtagttatggttgttttcagacactctgtgggctccactgataatctgtcaccttcacagttcctttccaagaggatcaacattttacaataggaaaacagttttaacacctgacacagtggtgcatcttagtgactgcttgattaacatctcaagttatccattaaagaagatgaaaatctttacctgttcccactgttcagcgtttcttggtcttacaggattttagagaggaagcagctgagaacagaatggattgctccttttccattagaatgctggagagcatatacttaaagatcagagctaagaaacctaaatctggctagtcaccattttggggacaaattcaaatgatagcactatctttgttactctttcaaagtatacagagacctgaagacccagatattgaggcaaactcaggtggactcaagatctattctctatcaagtatatcaagtgagttagaaagtgaggaagtatctgatgctggcagtggttcaaaagcacatcttgcataactcaaagcaaaaagtggacaaatattacatgaggacttttagtgtatgtttaaataagggtttgccttgtaatcatctgagttataagttagatgcatgtattcctgttcctccttctacaaaggagagattccatttgtggattttttttccaatttccacctgttttaggaatatccctccttctccttatccatagccaaatatccaggagggtgactgcggtcagtacctggtcattccatagaggctttcctctgcattcccatcactactacctgcaacttggcccattaaataatctcctaacagcctctcttccctcctggctcacaacagtttagtctgctcttctcccacagccagaatgactttattaccatcctgttaggctcctttcgcatccagcataaattccacagtccttgttatgtcctcctcctctctgccccttgggctcttcatgaggtggttccaggctactggtccaacctcatctctgtaatcctcatctgcaccaggtgactgatgctccattctagcccatttccctacattaactgtgctccacagcagcacctttgcagagccctccccgacctagcccctgtgctcacactcatccttatgactcagcacaattgtccttctctataaagcctttctggccttctgctatttcctgcatggtacccatagtggtagccatgtacacgaatgtgttgcattcactcagtctgtctaattctattagactgtgagctccttgtagatggagcctttacttttcttatattccaagtggtattctaaggtttccatgccttactttccttgtattctaagtggttgtcgtgctgtttggcatgtagtcaacagacaaattgtatttaatgcaagaatgaatggataaatcgcaattttatcttgttcctccttggaaatttatttgcaacttgattatcttgacactatattctcaactattacattcagaaagtcaaggcaacctgagaagatacagtgcccaaatccatttgtcttgccatcaaatcttagtggtatataatagaatagaaaaaaacgactcttaaagagcttgacccacttactctcactccttcagggttattgtttccagaggtgagtagttaagtgtgattttctcctagcttgttttctcttatggccaaaccttgctttagtttttattttctcaattattacatattatctgttatcttttttaaagggtcaaatgaaatattcagaaggctttactttatagatgggttcctgttgaaatggatcttatatctctaaccattgtacaggaggaattcattattgcctgatggcaaactcatgtctctggaccaagtgggccaagccctccccctgaggatgggtgtagtggttccatttaactgatggaatctcttgtatgcatgactaatgtgaacatttctcttctttctagaatctcttcattctaactctactttttttcctgaagttcaacataaaacctttaccacgaactcttgagcacttggtagattataagtgatgcttgcgtccttgtcctctagtgaacctttaccacaaactctcgagcacttagtggattatagctgatgtttgtgtccttgtcctctagtgtgttcctcaagtgtttgcttccagtgtgcatcacacttttatcatcagaaaagacaaacaaaaaatcttttaactctgttttgaacatagaagaaagtagttggatacctccttggaggcccttcttagctttagaaggaactgtcaagaactcaatggtcttatctgaaatttgctttgaaatttagagattgatgtatttttacaaagatgatccagttctctttttaaaaactaatgtttactttttaattattaaaatttcaataggacagcctgatgtggaatgatagccaggtgaactcaccctgctaatgaatgtccagaggtggccagcagggtgagcagcacctgaaagaccaaggtctgttccctcacccaaggctcccagagcctgtgtgtcatggccaaaagagactgtaaactgccaactgctctcaatctaatgaagacgggaaccggggtcaaaaattggagcaattgtttccaaaacaggtgcacacaaaacagtttactggagtgtgggaagaacatattataatttctattttatgcttcaatttcatccatttatattttatcttcaaaaatgttttatatgtatgtagtaatacatgtataccacttgtgaaacaaatattggagtttcataattttcttactgatgagtgcacacagtttaaattagagagtgttgaaaaaatattcatttacttatgttctaatattaaaccatagcagtctccataaaatattcactgtcggatttatacacttttgaactttgaagctatttgactattttgaccaattttacaagagaaacaatgatttacattaccttatcagtttgaaatgcaaactgtaagaaaatataaagcgcttaattctacaaagttaagtgaaatcattaatttgataatcattgatttttgcatttaacttttaccttatctcatcagaaaaatcttaagtatgcttaaaataataatgcataagctaaacatacgcagagaaaaactgcataaaatataacaaaatggcgtgaattaaaaagagtaaaaaaggaaggaaaacaaaggtaggaaaaacattagtaacactttgatggggattagactcaacaccatagtagttcactattctagacactcaattaagtattaactgatatgtatataaaactaagtaacactttacaatgtaaaatgtaaatgatataatttataattaacttttctgcattggcctattggtcattataatactttccattctataagaacccatgtaatgaattttaactcagaaataactttcccaggaaatgttcacttgtgatggaatttagtttccagagtactcagatcaattcaaaaaatctgcatgcagttcttcggagagagaaagcagagttccatcttctagaattccagctccctgtgttaggaaagcctttccttcaaaacaagaaaagaagccgccaaccccgaattggaactggcctcttcacatctggaccacaacatgggaggcggaggcaactcttcccttctcggtaccctgagcagacgtaccagtcacagtaattaatataaaaggtgtccttcctcttgaggcatcacttttaaagcaaaaacaagggaggctgaggcaggagaatggcgtgaacccgggaggcggagcttgcagtgagccgagatcccgccactgcactccagcctgggcgacagagcgagactccgtctcaaaaaaaaaaaaaaaaaagcaaaaacaaaaacaaaaagccctctcacacacacacaaaaacctgtttctgtttccctatgtaatgaagacccctgaggttggcagcagtgttgtccaccgccaactccctgtggtcgatctggaagcttcatctagggaggggctcatgaaggggcctcatgagtaacccctctcctgaggattgttattttcaagtaccagctctggaatcagatagtctagattcaagggtggccatttctgagctgtgggcctttaccaggttaatgcagctcttaaagacttgattttctgtcataacaatgggataacagtagaataagataaaaactatttcttatatataataagggattaatcaatgatcactagtatgtactagtaggaattatggcaccatggaaattatgaaaccaagaaactctacattaaaaaacaagttttattttataaaaacagaagagaataccttatcttcctggtgaaattgtggggagcagagagatgtttgcttgtagctaataccctccattaaggatctgccaaacctcctgattatccaaacactcagcggtttttttttttttttttttttttttgctgtctgccctttggccagctgttagcacctgctgcagagggtgggaagaaaaagaaatgaggtaattgagttcttgctaatggctgtgacagaagatttagagccttcagtggttcctacagtcaagtggcagggatcctagagcacactgctgctctcagaatggatctggcttgttctggagtttttgagattgacagagctcaaagttcccaggctccagagctcaggtgctggggaggatttcccatcacttctgagatttggggagctccaaggcccctcctcttgaccctcagtggagctcaaaagaaaatcgtcttgacctcagagacagcattttggggtgaagatactccaatatacttgtttctttctttcttttttttttttttttattatactttaagttctagggtacgtgtgcacaacttgcaggtttgttacatatgtataccagtgccatgttggtgtgctgcacccattaactcgtcatttacattaggtatatctcctaatgctatccctcccctctccccccaccccatgacaggccccggtgtgtgatgttccccttcctgtgtccaagtgttctcattgttcaattcccacccatgagtgagaacataccatgtttggtttttcgtctttgcgatagtttgctgagaatgatggtttccagcttcatccatgtgcctacaaaggacatgagctcatccttttttatggctgcatagtattccatagtgtatatgtgccacattttcttaatccagtctaccattgatggacgtttgggttggtcccaagtctttgctattgtgaatagtgctgcaataaacatacgtgtgcatgtgtctttatagcagcaagatttataatcctttgggtatatacccagtaatgagatggctgggtcaaatggtatttctagttctagatccctgaggaattgccacactgtcttccacaatggttgaactagtttacagtcccaccaacagtgtaaaagtgttcctatttctccataccttctccagcacctgttgtttcctgactttttaatgatcgccattctaactggtatgagatggtatctcattgtggttttgatttgcatttctctgatggccactgatcatgatgacttgtttctttctttctggtgttttccttggagaaagcaaaaatattgccctagagaatggcatggacagaaaagaagaagaaggaagattagaagtgaagccctgtgggcttgtctggtgagggccctcttcccaggacttagctgcatgggaagaatctgggtagcactacaaggatggaatccatggggtcttagttgcctgtcatcattttctttgccattgataattcaacacttaatcaaatgcggtggtgtttttgaaagatagcctgaagaaaaagatgaccatgactttcactaatagaatagaaaatagacaggagattgattatcacttaaaagaaaagggttcattaaacaggttccactgtggtttgcgcaattcaacccaaagtttctctgctgtaaagcaatgataagatcactctgcccactgagatcaattgagaaatcaaccaatatttaagaaggtctgagacttggcaaggtgcccagtgactgagaaaagagggttcctctttctttaagttggcagaaagacattcagctgtgatttttacgtggcctgagctaaggaagagactgagctaaggaaggcagtgtcttgtgtaggttatatccatggtgctctatgagcctgtgcacccattatccccagatatgtcaatgtgcttcacagtgtgcacatttcatggcacctgttacagttttaaaaagacagtttaattaattaatggtgaatgttcaatcttagatggtttttttaaactcaagataaaccattatagcttgagtgtttttgatgcatttggctaggagttaggaaatcttaaagaaaaattaattgctgtatcaatggaaaccccagtaggtagataacaaatttgtcattaattaaatgagaagactttttaatgattcgaggaagcgtcgtcaagattgtatgatagtttaatttgctaacatggtatgaacctgttagcttcagacacatgattaataaaagtaaaacccctcatggaatttctcagatgctcagttctagcatgcagtcatttttgagacttgctcaatgtccttatctcactttactgacagttctgcagcagccgtggcaaatgtaggttagacaaaatattacatgcaacattttctatgattcattttgctcctttttccctcttccccttcctctccagccaccctgagtcatacaacagctgtgagaacattagttacaagggagcgagctgcagacactttaggtgctgggctgtatcccattatatctggatgctgacaccaggatgggttctaaatcccttatcacaactgcctcaggcggaaaacatttttttttccttctgttgctgctgatgtaaagatgaagtttctcgagctgagagaattttatgtgatcgtattgtatgctaagcctcagaagataattctgtagctcccattcatcacaaaagcagggactttcagttgtgcttctttaagaaaaaaattccccagtagaaatcatacaatgatttagcggactaagaaaaagaagagaatcaccaacaggatgacttgtgacaattacacgaagtcatttgactgagttatttcctttattattctgtaaatgggaaaataacgaacatgctggttatcagctgtggttttgcaatggaggcgttccaccagtgcagagcggtaattacgctgcccggtctcactttgcaaatgaactgaagcctgtctcttttaattgactgtctgtctctagaattttcttgatttattgctgctcagtagaatttacttttgttttgttgatggcatttgtcaactctagtagttaccaaatggaaattgttctagagggttgctttggcataagtgtgctcatttgtgtggcttattggagcatgaaggagagatgtgcttctgtaagatgtcttgcccttctgcctgccagaggggcaggggctcacctggagtatgtttcatctggttccttagatctgtaagtgactatgaagcctttcaactggaagagtttagtcaagtgtaactgtatgatttcggaatgaatatggccccatctttgtttcccaggtggtgagtgtttagggcattatatagcagctgtgatgatgagagcttggcttctcatctccagctatgttagtctacctaggaagaaggattcttctctaagaagaattcagtgggacaatatccagagatacaaatctcaagagacagactcctgaaaacaaattgactgctcatttggcttcagattccatgcataaatctccagctctgactgttaatcacagccactagacctcacgacataggattttagaggcagataaagaaaatggcagttgatgtcttagcctgttgctatgccagtctatgatgaactagcactacctgaactcaagagtaagaaacaaatgaaactggttataaggtttaggaaaaagcaaataagctgttactgagagtggtgaccatatggtacctatagggtacacgggccctctgtgaaacccgtaatattgggctgcgtctcctctttcctctacaacctgaccccatcgcctcatttgatggattccagtcaattgtaattttgagaattgtaagactagtatactagtatgccaatgtcttgttcttttttttttttttttgagatggagtctcactctgttatccaggctggagtgcagtggtgtaatctcagctcactgcaacctctgcctcctgggttcaagcaattctcctgcctcagactcctgagtagctgggactacaggcgtgcgccaccacgcctggctaatctttgtatttttaagtagagatggggtttcaccatattggccaggctggtctcgaactcctgacctcgtgatcagcctgccttggcctcccaaagtgctgggattataggcgtgagccaccgcacccggccgccaatgtcttgttctttaaaggaagaataaatacacatttagaagatggctacaacctcatgcaaaggtctcgaagcagcaagttgagggacagggcttactggtccaagagtaacttcaggcagggaagccttttcccatgtccttcaaattgaccacatcacttggatcatgaatgctgttgatctggtttcaaaacataagaacaagcatcttcgacaatgcggttgataaacatcatcaacaacaacccaccgaagcatcagttgttttgtcttgtccgtggcagtcctgcattcagatctgtattcactgtgtgatcacatgcatttttcctaggcctataataggtttccctccgcatgcccaaacagtggagctagcatttttttaaatttacaaacaaagattgtaaaattctaattgggagtgggacatcctttttaaataaatagtcgtattaatagtaatagcaaggagaccatctagatagtactctattttcagggctcaaaagtgaaaagctagaaaagccagctgtttaagcattggcaggcaagttatgatacggagtaccctcctcacacccactccaaactaatgtgtcatctttctctgaagagctgtggctgtttttgtggttctgagttgacggggatttttttttttcttaaagaggtacatgtttatgtttgcaacatggtatttcttgcagccatactcctcaagtcaccatctccaaagctcacacactaaacagggtcaagtgagtcaaagcagcaggagagaaccatgattggggtgtctgggactagaatggggagggcagcatgtgcgggtgcggggctggccttcccgtggtctcaagagtgggaggtgtgagtctctccctggatgtttagctcagcatcacctcagagtttgagcttgactgaaaacaacaacaataacaaatatgccgaaatatgatatcatttaaaataaacccaacaacctttaaaaattaacattattccttaatcggaccattttactggtctttttttcttaagtcaggaaaataaatgcaagcctatgtgcaggtcctcaaaaaatgtgaaaataagcctagtaaaaatctggcaagagatgtggtttcatcagccacctcataagcagatcttttcacatagattttaagagagaaagttggtttatctgcactttagtggatgcttccgtttgcttaacttccgtaataagaatccctagaaaaacctggagataattagcagaagggcggaagcatgaatttaaattcttatacccacacttaattttgtcaactttatgatttgctaaccagtgctttttctgccagtttctttaagtctagcttagtattataataaaaggaatcaataataccaatctatatagtaattttcttcaagaaattcaaaatcctatggaggaatttaagaaatattttaggccgggtgtggtggctcacgcctgtaatcccagcactttgggaggctgaggctggcagatcacgaggtcaagagatcaagaccatcctggctaacatggtgaaaccccgtctccactaaaaatacaaaaaattagctgggcgtggtggcacatgcctgtagtcccagctactcgggaggctgagacaggaggattgcttgaacctgggaggcaaggttgcagtgagctgagatcgcaccactgcactccaggcctagcaacagagagagactcaatttcaaaagacaacaaaacaacaataacaacaacaacaacaacaaaaaacaaagaaatgttttaatatgagaaaacattttgcaaaagaagacatacacatggacaacaggtatatgaaaaagggctcaacttactaatcatcagagaaatgcacattaaaagcacaatgagatatcattgtaccccagtcagaatggctattatctaaaagacaaaaaataacagattttgatgaagatgtattgtagagaaaagaagacccttatacactgccggtggaaatttaaattagtacaacctctgtggaaaacagtatggggatttctcaaagaactaaaaatagaacctccatttgatccagcaatcccactactggaaatctacccaaaggaaaagaaatcaatgtatcaaaagcctgcacttgtatgtttatcacagcactatttccaacagcaaagatatggaatcagtgggtgattggataaagagaatttggcatatatacacaatgaaatacataaaatgcataaaatacaaatgcataaaaagaatgaaagaatgagatcttgtcatttgcagcaacatggatagaattggaagtcattatccgaagtgaaacaagccagacacagaacatcaaatatcgtgtgttctcactcctaagtgggtgttaaaaaatgtgttcacatggacgtagagagaggaatgatagacgatggagatttggaaaggtgagagagtgagagggggtggatgatgaaaaattacttatgggtacaatgtacataatttgggtgatgggtaccctagagccctgacttaaccactaggcaatctatgcatgtaacaaaattgcccttgtaccgcatacatttattcaaatagaaaatgaaatattttagcctatgctcattagtttacttatgaagcatctacatggctcactgcactttcttcctaagttctctgacttctgaggcaggaggtgaggccaggcagcgggcaactgtgcttccctttctcaccaggacaggtgccaggagcaagggacctaactattttggtgcaaagtgttcattaatgggtctgtgaatcccatctccagctccagcatgactccagggcctaacattaacttgagaacagtatacaggaaaagggatgtttttgaaaatgctgattatttcatagcctctgggtgtcagccgtgaatctcactttaagccccgctagggatcctgttgccaccactgagcagaaaatgcagtgcttctgtgaaggaatggggcacagaacagtcaccgctaatgtgttcctgaaaaagccggggtgacctttcttgtggctgcttcagaggatgatgtcactttgggacagaaaaaggaagatctctttccagttcacataggataataagagttctgattcttagttgcatgttgaagaacaaacaaggagcatagacactcatcctggggaaaaagactatggaatctttggaagctgagaggccagccacttactttcctgggatagagcttttataacccccgtattgggcttaactccatacctttgacgctaaagttgttcactctctggggaaaccatcaaaacaatcaaacagaaacaagagcttttaaaaatggaatatttaatacttatggcacaaataccttttagaggattgcaatgatcatggtagagagactgattcagacatttttcaaatgtttgttggaaatgtctgaaaatgacaggcagtgatagtatcaataactaaccttcatcaagatatctgtgcatcggataatctgctatatactttaaagagattatgtgctgtatgcctcccaacaacccaatgaggggtgagcgctattattaacaagaatatgtaaggcaactgggactcagagagattcagcaccttgccaaaggtccaacaggagttcctttagcaagacttaaaaaaatgattactgtggaaatttccaaacatatacaaaactagagaaattataatgagccccatgtatgcaccttataaattcaacaaatttcaatacgtggccaaactagtttcagctatcctcccacctgctttcctaccttattagttttcttttgctgctgtaacaaattgtcacaaacttcatgacttgaaacaacacaaagctattctcttctagttgtggaaaccagaaatccataatcaagtccactggataaagtcaaggtgtccacagggctggttctctctgaaggctccaggggagaatccatttgcttgcctttttcatctcctagtggccacctgcactccttggcttgtggccccttcctccatcttcaaagtgcctcactccagtctctgcttcttcattgcatcactgtctcctttgacactgattctcactcttctgcttccctcttataagaaccttgtgattacatcagatccaccagataatccaggatcatctccatctcaagatctttaatttactcacatctgcaaaatactctttggcatgtaagataaaattcataggttcccgggattagaacatggacatatctggggagccatgaatctaccacccgcaccctagcaccaacaggaatattttgaaacaaatctcagacattttatttaatccataaatatgtcagtgcatgcttcccagaagataaagacttaaaaaataactgcaataccattatcatacctaaaaacattaataagaattctttaatatcatcagctatttagtcagtgtttcagttttacctaattgtctcataattttattttaacaaatggtttattcaaattgagaaatgtttcttaggtctcttttaatctgtcagttccctttccttttcctttacttccttctttgtaatgttgagagaactagattgtttgtcctacggaatttggcaaatgtgttcctgtggtcattcacatgtggttttttttttcctgtattttccataaactggtagttaggtcttgagacttggtcatatttatggccgagaatttgattttatggccaagaatgcttcatcaatagtatgactttctattgtaccacacggggaagccaatgtctgttgtctccctcctgtgatgttaaggttggttgctgagttgaggtgttgagcactccatccttcttgtatcaaattccccatcagctttttacctacattggtgattatggcttagattcattacttcatgagggggggttacgacatagtcataatctaattctgtcattcagttttcatttttagccagaattcttatataaaaaaataaactttcctctatttgattatcttgaggtacaatttatgaaagaaagacaggagaaatgtctaattctttctcctaatgcatccatttgcagaatagtaactggttttctagcatcctacaaggatgaaaaagtgtttgtgtatgaatgtatgtgcattagtaggaagtcacggtttcgtatattcgtgatatttcagttctttgcagaagttattctttttcaaattgccccatctttagccaatgagagccccttcagattggctacagactcttttgacattaacctagaaacttcattgttttctgatgtaacaaaatgttttagactcatcttgtatatttactgtcccaaatatcaaatcagtgtttactccaaaaaagcccgtgtttcttttagtaggaaacggtatttagagaccatactctaaatcctgtagatcaggggtctccaacccccgggccatggaccagtaccagtccgcggcctgttgagaaccgggctgcacagcaggaggtgaacagcaggtgagtaagcgaagctttttctgtatttgcagccaatccccattgctcatattactgcctgagctccgcctcctgtcagatcagtggtggcattatattctcctaggagcctgaaccctattgtaactgcacatgccggtgatccaggttgtttgctccttatgagaatctaatgcctgacgatctgtcactgtctcccatcacccccagatgggaccatctagttgcaggaaaacaagttcagggctcccactgattctacattatggtgagttgtataattgttttattaaatattataatataatagaaataaaatgcacaataaatgtaatgcgtttgaatcaccccgaaaccatccctaacccccttgatctgtggaaaaataatcttttatgaaaccagtccccagtgccaaaaaggttggggaccactgctgtagatgctcagagctacttggccttatcattagtcgaatctagaaaattgtgtaccaaaagaactgatatcaccggtttatactgttattttcaactcaaagttaatattacatggttttacttaatttatgttatattatatttgtatttattttctcttatgctgaaaattttggttccaaatatcctcagtataatgacatatatatatatataaaagcatatgtatgtacatatttctctctatatatgaaataatatatcctctctatatgtaatagtatactgatatatatataaaatatactaatgcaaatacacatgtaatagtatattaggagtataatatatagatacatatagttttataagaataatagtgatgttattaatactataaaaacaacttaagatttaactacagtttcttttgttcttaagataaattctactagagatgtacagttaaatcgcagagttttaaaaccactgtaattaattccccttagtgtaattaaaccaccaactcgatgcatagttagctcaatgcaccaataagcttatgggcttattagttttattttgctttctacttagtgattgctatttttaagcatatgtaacactaaccttatggttcaaagtcaagtgtataaaacaagatgcattcagagaagtatgactcttattctgtctccaacctgacttttattctctcttctaccttccatctatagagaaccattttaattcaatttttatccttctactgctttttaataatttagccatagatattcataatccccggttaggcaaaaggtgtgggactaaacacactgttctgcatctggcgccacaacttttgaaagtaaaactccctaggcttgggaaatagaccattatttactttcttactgtagacctatcagtcgttctatcagaaaagggtcagtcctgcaaaaatgggaaaccagaatcctctttagattttagatttttcaggggtgtgtttgtgactcacactgtgatgatattaatgttttactcattataattccagtataccaccccaaaatcccccaaaacaaacaacagtcataattaattgtatgcactgattttggacatactgctttattttcagccagatggtttgccaaaaaaatatttttctatgttactatgtgataattataaacatggttttaatagtaattgatgttccagtaagtgcacatactataacttgcttaccatatttcattgaagggcatttggttggtttctaactttttgttatatgatagtttaaaacactaatttctctttgctcaagagccctgaagctttgaactgatggggactgacaccatttagctaaaagatatcttgttcttactttcctggggtcctttttttgaggggtggaagtgtgaggaaacatggagatcttctcaacccaaagaaagccttttactcaacaatttcaagagaagaaaaatatgcaaagtacaaaagatgaagatagaagggaaaatcgccttttatattaggttaaatttttgagatagggtcttgctctgtcacccaggtgggagtgcagtggcacgatcacagctcactgcagcctcaacctcctgggctcgattaattatcttaccttagcctccaagtctaggtccacaagcacacaccaccatgtctggctaattttaaaattttttgtagagatggggtcttgcaatgttgttgagactggccttgaactcctgagctaaagtgatccttctgcctaggcctcccaaagtgttgggattacaggtatgagccactgtgcctggcctgaggctgtttaaaagaacaaaaatctttataaaaagtttcattgctgtttcttttctaaaataagttgtctataccagtggcatgcaaaatgtatcatatcagatttaatatgtgaataatgagggaaactgtgactttggacagaagactgtcgtagactgctctagtagaacagaatcttagctaatcaccatgcagatcccctgggttttagagttcatactgatcctcaactgggggctaacaatggtttctcatttatcattttcccctgcttgttcagcattctacttgaagccacagagaatgatggagcttacatatttcctttgataagatgaagaaatgaaaacatacattaatgaaaaataattccagaggttttttggactataggagttaagaggagctgaccagtgagcctgtggttgtccatgaaggttctgtggggtagagtttgaactgtccctatccagaatagtaggagggacagagatgcttatgagtgaaggccgcagaacaaggatggcatgacttgttcatggggctggggagaaccagtctgaccagacagaaagggttattgtggtttgacggtcggtgaaggttgttaggtggcctttggccacataagagagtgttagaaggtagacagattattttaagtgtgatgaaacaagtagcagttggtatgtagagaagtggggagaggtttgatgaaaagcagtgtgttagaaagacggttggcaacactattaagagtagattaaaaaggaaaaggaatgtgaaattagagagaccagaaaggaacctattatgataataaagtcatgattccatggaaagctgaccagaatgatgatactattagagaagagagaggagaagtaaggccaattttttctttaattaatgagtcttagtgactgaatgtgggaaataacagagtagtgattccaggattttaagcgtcggtgattgtgagaatgggcaatgcaaagtattgattaaatcagcagcattagggttgggaactagattagaatgggagggggatgatatagtgaattcctccctccctccctctctgccttcctccttacctttctccttccctctttcttttcttccttcccttcctctcttccttccttctcccctttatttcttcttatctttacatcattatttacttttacatttagcaactattctattccctggagctctggtaccaataaacaaaagaaacaccatcttcgctctcttgaagcttacatttcattaagcagagtggcagataaaagaacaagataactcagatagtcatggtgctacaaagaaaataaaataggcttatgtgctagctggtgattgaggctgcagggactggacagtactactttagactggagcttctggaaagcgacttaggggaaacactcaggtgtcagccatgtgaagatctggtgacatttcaggtcattgcaggcagaaaaaaacaaatacgcaaagataagaacagccttggagcgtgtgaagaacaaaatgaaagctgagggcatgggagggtacatcgtaagagcaaggaggtgaggccaaagtgtgtttcagtcaaggacagatcaggacacagaaaccacctagtaatttaaacagggatggtctaatacaaataattattaattttaacagagaactggagtcatgagggattcaccagtaggaagtaaagacaagtctaaaaaatgtaagagcagcagatatatgaagcagctaccacccataggactgagatacagggtttcctgcccccaagataagaccagacctggttagagacagcatgaccatggcaaactggatagccaagaagtcagtgtcatgctgcagcagtgtaacctgctggaagtgccttctggaagaactttctgaaagttcttcatcaccctccatgatgccaaggaaagctgttcatagggagttgtttcaccagtggcaatctgctacgaaaagggcttctgggaaatgctggcatccagatgctggggaagctgcccagacagtagaagctgaattctggggaagctgtatgcttgcaggagtcagggggtgcagaagctgagtgctggagaagccactgtatcacaggagctgggtgcagaggaaacaacgcgtgcttcagaggctgggtgctagaggcctgtgcatgttgtaggagcagggtctagagaagccatctgcgtttcaggagctggctgagaacacactgatatgggcccgggggtggggtgggggtgggggtggggggaggtagaggagtggcagggagggaggtagtgggtggggcagtaggggagagggggttggggggttggggggaagggttgggggttggggggagggggtggaggtggggtgggaccctttcctcctgcaaggcctttctagctccctctactgacaaaacttaatactgtgtcagctagcaaagaaaatacctaaagggatcagctaaatttttgctgagcagtcaatgtacatttggagctgagaggcaataaactggcatagagaagtagcaatggctctgatctctgagggcctcgcagtcgtgttgatgattgtattcatttagatgctggttgtggttagtgcttgacattttaactaattttttcttccaattccaatgaaatagataattttattattcccactttacagacaagaaaactgaggctgagggaggttaaatcgcttgtccacaatcacatgctagtgcggcatggggccaggattcaaacatgagcagtcagtctaactccaaatctgcccccagactccataaagtcattactgatctttgaacagacagataaatgtatcaggaaagataaatacttaaaataactttgcagtcagtccttctgtaattaaatcagccacctctattttacagattttatgaatttagaaattttagttacttttaaagtaaagtacaagtttaccaggaagtacaaattaaaataaaacgtggagaatacaacacctttcaaaggaaagtagagaaattggatgattgaggtaattagaaaataatattttgagtatagtttgatggatttcaggcttcttcagcttgacaaaaacagaaaagagggggaaagttcaaaaatattattatggatttgaagagatgtcactcagaagatcttgataaaatgttcctcatccctagtggatggggggcgtgggtggcagggtacaaaacgaaacatggaaccagtgatgggcttttaggaaattctatatggagcttttaccatgcaccagacctcaggctggggaccaggggtacaaggatgagtaaggcatctggccttcccttaaggagcttgttgtctcatggctgggacatgataaggacattactacagacatacatgaagagctaaaggaataatatatggaggaagaactagttctgcccaagggggaagtcaagggaaggtaccaagaaagtatagcatttgagttggatgaagaactggccaagacagctgaggaaagggagatgtagattaggggccgacacaagtaaggggttggcaaggacatgaactgaacggggtttgaggaaaaagcttagcacggggtcaagaacgtagattttggggttagagtacctaattctggcctcctcaatattttctagtttcatgatcttggtcaaattatttaatctctctaaatttcaatttctctgtctatacaagaaaataaagtaggccggccatggtggctcacgcttgtaatcccagcactttgggaggccaaggtgggtgggtcacctgaggtcagaagttcgagaccagcctggccaacatggtgaaaccccatctctactaaaaatacaaaaaaaatattagccaggcatggtggtgcatgcctgtaatcccagctacttgggaggctgaggtaggagaattgcttgaacctggaaggcggaggttgtagtgagctgagattgtgccattgcactccaacctgggcaacaagagtgaaactccatccccccacccaccaaaaaaaaaaaaaaaaaaagaaagaaaataaagtagtacccccttcagtgtgttattatgcagactgaatggtatgaaaagcatgttttcaccattactggcacatgctcagttaacgttttcctgccattcgtagcagcaggatgaggagtattgaaaaggctaaagattagagttctgggaagaataataaggattagatgtcagaaagtgtgtcatgacatatttgtgtgtatgcgtgtgggtacacagaattttgaaatagttttcaattgaagcctttgtttgtaaccagtagcacagggagatgttcagttttgcacataataatgaatatctgttatgtctgttagccatttgtaactactattgttgtttctgtcatctccagtaaagtgtttctgtattttcacaaaaatgagcaagacctaccacaaaaaattatcaggtaagggtgactttatgggtcccctgctgtgtatttgacaccaaaatgactcatcacatgagttcctaagtgctatgtttggtttcagtgtagaataggagattgtgtttcccaggtagaaaaggagactttgaaatctttctcataaaatgcgtgaaaatctggtgccatcagatcatgagtcttgtcatcaggatgggactcactcttggatccatcaaccagctagctaggtaactctgagcaaataccagatgctcttcagcctgtgtcctgatctgtaaagttgagatcataatagtaatacttcacagtgaaattgtacactagaatgaaagaatgcataaaaagtgcctcgtaccctgccacgcacagagagggtgatacacattggtcccctcatccagcatcttctaattcacccctccctgtccccagcttctcctgtctggggatctcaagttgggaatggtcatctttggatgaagctgccatgtttatgtggacttagaggcagatattctattgggaattcaatggatgcataaggcagtgtaggggaactgatttttagggagcaatatgaagtcagagaaattgcactcttatctctacttacgttcctcatggtcccttttattcttttatgacaaatgttacttcaagctacagtagtgttttcaccaggggctgaaggaattgatggagttgttttctttagaatgagccgtaacatccctttgttcacagagattgtaaatcctgcatctttcagattagatcatgtatgttcaatatcagtaggaaacaaacagagaagtaaatatttgctacaaaatgtctttctgctgccttgaaaatgagtttcctaaatctgacatgtcagttaccctgcttcatctgtttcacatttagagtcaaaggaaaacaatcccccacagcaaggagcctgtcacttcacttggtgtatccagtgaagataatgtgaccacagtgcagtgggattgaatactgataaggatgtggcgggccatgcttaaagtttggtgtctcattcaaatgactggctgagagatgaaaagaaaacaaaaattaatccccctcctggaaccttatactgattcacttagtggttggttgctgctctaaggtctgtctccttttccccccattaataatcataatcaaatagccattattggtttttggcaacagggtaattactttctcgtccttattttctgggacagtcggtctgttcatgagaaagggcggttgtgcaatcgttctccctacgtcaactctgagaagtcggttgtgccctgcagatattgatgtcagcctgtttgctctctggtggagtgaaagaagaaaataattttattgtgctatttttagacttcaatttagattgcagcctttatgatactttgtgtactggggatagaactgttgatgcagaattcagctgtgagatgctctaggttctacctgcccctgaaagatttttttcgcttagcctgaatgccttagaactattcagtcacattgccttcatcgtcagctgaaagctgagccatgacaatagggttaagatgcactttgtattgacagtgtttgccgatggaacttgctgccagcagtctccaagtctgcaatttgcctgtaaaggcctaatctgatcttttatatgcataaataatcagcaccatacaaattctctatgaacaaaatgagtttattgaccattcttgcttttctaaatagttttccagaggtgatagatgaaagccagacaagaaaaaaatatttctttgctggatttccttctgaacaaacaagaaggacccaggtacctgggactccaggtatctttttctcagctgggatggaaggccatggactaaagcagtcttcctagttctttggtattagcaatgagctggtcttaaacttcaaagggatctaagaaagtgccagtaatacctgtctgagcttgttttgtgacgtgtatgttaccacatgtattaaaattcagatcaatttgcatctaaattatatgagtgcatgtgacttggcaatccagaagctgtcaattttagtttataagaacctcaacttgggcctggtatggtggcttacacctgtaatcccagcactttaggaggctggagcaggtggatttgaggtcaggagttcaagagcagcctgaccaatatggtgaaaccccgtccctactaaaaataccaaaattagccgggtgtggtgacgtgtgcctgtagtcccagctactcaggaggctgaggcaagagaatcactggaacctgggaggcagaggttacagcgagccgagatcgcgccactgcactccagcctgggcgacagagtgagaccctgtctcaaataaaaaagaaccgcaacttggtccttgctactccaagtgtggactgcagaccgacaacattgacatcacatgggtgtatttaaaaatgcagaatctcaggcacttccccaacctacaaatcagcacctgccttttaataatattccccaagtgattcataggcacgttaattattttttaagtcacaaatctttttaaaaatctactatgatctgaatgtttatgtctccctcaaattcatatatttggacctaatccccagtgcaatgatgttaagaagtggcacctttggtggtgattaggtcacgagggtggagccctcacgagtgctgattagcgcctgtataaaagagggcccagggggctcccatattcctttcaccgtgttaggatacagcaagaaggcaccacctgcaagaaattgggaacttaccagacatcaaatttgctgtccccttgatcttggactccccacccttcagaactgtgagaaataaatttcttttgtttataagccacccagtttatggcatttttattatagcaactggaacagactaagacagaatcccataaaatctgtggaacctcttcccataaaaatgtacctacacacacaatttgtatataatttcaatggtgcaagttccgtggacttcaatgacacttccattcattggaagcagagagcatgcctgagggagcccccaagtgccatgtgccccgaacaatgctgacccatactgctccttgattgtcacattgaccaggtcttcaccttcatgcccagaccttgtctatgtaagcagcaccagcctctggggtgtcccatgtcagcctcagcagtccctttcatccatgtggctctcattaaccagtccttgctatcattttccttgcctggctactctggtcttttgctttctccttccccagtttagggactggtgggtacaaacattttagaatgaccatgaagtaatatcagttagctgaaacatatctatcaagattctttcctacccaggtcaggctcataaacagatgagatggagaaaataggtcttcctgctgtttcagctgacggtccacccatgctgcaggtcctgctggaagctcacttctgtgttctggtctgtgctttgatttcttctaatctttggtgatggcataaggataacgcaatgcaggctaaagaaaaccctttaagaaatctgttcacttactggcggatttgcttatcataggcatgccctgaccttgaagagtccttgctctggtagggaagcgcatgtacatggatgattaaaataaatgcttcatgtcaaaatacaggtacagaatgctattttgctacgaaggaaagaataactagcttttccaagaggagtgagggagagcatcaaagagagctggcttttaagggataaagcagacattgcctgagataagagctatagaattgcttattgtgagaaactacagagttgggaagatcgagatgagacaggcatatgagcagaagtgagagacctggcaggaataagagctagcacttagaccctgcttgctgtagggcgtgcacaggtctaagtgctttatatcaagtacctgtgcagttctctccacagtccaacaatccttccattatggatgaggaaacacatgcgcaccgagttcagtatcttacctaacgctgtgcgactgcaagcggtggagctgggctttgaacctatgcagtctggcttctacactacacttccaggcagagggcatctccctgtgcttctgggataaaacttgcagcactgccttgtctaggactcaagaggcactgttttctcctcccctactggttctgcagtctttccaactctttccacttcatcaatgagccatgtccatcctcacatcactatgtgtctgtgtaatacttagggccactgagttatggggaaaaagagaaatggatatttcttagtattgtctggtggttctgttatctcacagttcatggaaaccagatcactacaggcacaaggcattaccatcagtctcagagaaggcctgacaccctgttatagatcagagagtcctggccaccactaaaggtcttggaaagacacggggaaggcaagcagaagcacaggtggcctgaagacatctccttccggccaagagtccccctgctcatcccccaccccacccaggcaccaccctccacagctaaaggtgtttatgctgtaggaaccctgtggtggtaggagatcgggggtgatagggctgcttggataggaaacatatgtgattgttggcactgctcttcatactgttgtcaaattcctcactgcttctgtgtacttggggtgacagtctgacagcctgtgaggtcagacaaagcccagattacttccctctcgcctttccgtctcgcacttgtgggctgccattcttaaaggagtcacgtgtgggctttctttgccagaagtaggcatggcttacatcttttgggtttgggcactggaaatgactctgcttcccctgcagacacaccctgatgaggctgcaggccactagctctgctcctttttcaacatcagaaacagaggctgaccattgctgggacatttcccttctcctgctcctaactttgtcatagacgtctcctgaactgcagttactgtgtttggaggtaacatcatccccttctttggtttgtgggtagggaataccagatacgagggagagcatccctaaggccttcacctgacaccagtcctgcctgtatgtcctgcagttctcatggtaagccatcagcctcgccaggcggcacctgtgtgccaagcagcatggcttattcattgtcttctctagaacacagaatagtttggggacatttctatgttttctttctccaacagccagatatatgtgtccacttagctgcacataattattgtctctctaactctttgacctacacatttgtcagataaaatattttgggtgagagcttgttagcagatctatttccattccactcttggcatttattagcgagccctcttcgggaagccgtatgttctgagaagtaggaagaataacgcattttacctatagtgcaatgtctggccagcgcctattctttctgggttgagctgctggaatgtattcaggggataagctgagaggcgatttacgaggagtgctctctccttgtcttgctcctgcttccctttaaaattccttggctgcccttagtgtggcatgtgtttccatttatcctatagttctcaagactcaatggagctcttgtacttctgaagggcacttactaggaagcccttctccctgacgttgagcttgcactgatcaaaacggggggccccacaaaccatcacagggatatctatgcaaagggggaatgtttagcaccaaagttaaggactgtgcatgctttggcagaattacaaaaggaaaaataagtggacaaagtatgttactttttttttattattatagggtgtgtgtggtttatttgaacatcaacaaaaacacaacagaaaggggtaaaatgtaaaggaaaagcccctttgctgtcctccaaccctgaggaagctgttagcagttttaagtgcatccttccagaaatatctccctcatgtatggacatatatgtcctttagttagttttagaaaattcaaatggaatcataacagaattttgttctgtgccttgccgtttttgcttaatttttcttggaggtctttcaactttaagaggtaaaaatggctgtatgatatgtaacaataagtgtggctgattccaattttctccatttggttgtttccagttatttctcatgctgcaatgatcatccttttttatatgtctcttttaccttgtctgaatattcctgtagagtaaatgcctagaagaggaatagctagtgaaaaggacatgtgcattttaaattttgaccaatattgctgaattactttcctaaaaaaggcagctgacgtatccctcacctttaaaacagcaaactatacaactctcagacctttgtctccgaatctgtgcatctttatattggatgcaaatcacgtgttgattggctggttttttttcttcctctgccttttttgcttattttcttttgggatatttgcttttttacttcttgactttcaaaactctttgctggttaataaatctaactcatagaccatgcaacgtgttagaaatatttttttctaatatgtcatttgtattttgactttcatttatggcacgtttgccacataagagtttaaattgatatgtgtctaaatttttcactgtttttcacttttggatttcaggtttgtgtttgcttagaaagtttttccccacttcgagtcagtcaaataatgtaaaaattttcatttagctattgggcagcttagaagccaatactagactggccaaatagagtggcatgttgagacttaccctgagattttagtttttaatgcagcgaatccattgggatcacttataaaaaaggattttaccctattaatctttactagaatggatatttttaaacttaatttttttgtgcttctcattgtaggagtcctttgaatgtagcttccctgagtgttcattcagttcattagttattgagttcttatagtggatgacatcttgctagtctataggcttcatagggttttaaaaaatgaatacgaaatattcccaaacctgattaattacatacagtagaagagggcgtctgtagacaaaacccagagatcaaggcagaatgtaacaactctcttgagagtactacaaaatgccatgtggttcagagaaaggacatcacatatggttgtgaggtcagggaagaattttatattaaagtgacatgagccttgagatgggccttgatgaaatggttggatttcaatgggtgtggattttagagaaagggcataagaagtatgcatctgtaattagaaacctgtgcatttgttctgggaagagtgagaggtccactttgcaggtgtgtggagaactcacaggggtgcaatgaatgagtccagagtagggctgagggcatcttgggaaaggcctctgagaattttactctccatttgaaaaggaataagaggcattcacgtttttggagcaatactagatgggatagattggaagtatgaaatatttgaaggcagaaaggcccatcactaattgtagttttcctggagtaaagaaataaaatgcttaatgtggagtagtactggaaatggggaaaagcagacctgaacaatattctcagtttataatctgtaagagggtactggggctgaggaaaataacaagtttaaaaatgaccaagatttctagccttcatttggttcactctcttaacatgcattgagttcttgctttatgtcagcactgctctgggcgcttggactagaggagttgaggagttggcacgagacaggatccctgctctcaaggggccacagaaaacaaacaggccaggatgatggcaggtataaggaaaccatgaaaaaaaatggagaaattaagaagaagggcttgtttgatggggagccctgataactttgattctgtgtcttaaaacttcaattcatgcttcatataattatcaatttaattattgctggtggtgttctctttctctcttcaccctggtatactacggagtgatacaggaaaataaattgttattcgaattttaaataggctgcaaagttggaaagcactttaaaatctgaggctggttggcttatccacaacaggaaagggaagtatgttacactaatgatgagaatagatctttgatttctgattatatcttagtttcttcacctgtgaaatagagacctgtcctaaaacagtccttgtactttgctcacagtttggtgagtcataaatttgggaaggtcttgcctgggcatttctctgcacgggcctgcaccagggctgaacgtgcacaatggctcactggtgtggctggcaatggcaacagctgtcagctgggatcccagagggggccactgaccaggcatgtagtccctccagcatgacagtcttgggctagatagactccttgcatgacagctggcttgtctcagagcaagtgtcccagaagaaccaggtggaagctacagggcctttccctaccttgccttggaagttagatggcattactccctctctgttctattgattactccaaggaaggcaccaaggtcagcccagattcaagagaggaggatatagataccagctctttattataggaatgtcaaaagagtaaaggttatgtttttaaaacactacaatgtagcaataccatcttacctcatgaggttgtcttgaagactaaatgaagtaatatatgtacaacccttagaacagcacctgaccaaaaattattaacaatggtgatgatggtggtgctgggagtggggatggggatgaggatgatgaggatgatgatgagtagctgcactgcctttctgcaaaatgtcccttgttgtctggcaggttgagttttggaaagaatggttttacctaatttatatttcctataactatgaaggggattgtcatcggttaattgccttaatctcatcaccttctaactaacaatccagggaggggttgctatccattgtgttctaagggagacctgaatataaactaaattctattaggaagggcaagacaagaaagagagggtagtttcaaccaacaatgacctctacatgttcctcgttaaatactctttcttatattacatttcttcctttcatattatgaaatggcattggagaagaagactaaaatttccaaaagttcagtggaaaatagtattactttttctttcttagaaaatagaagacaaaggaataaaatttaaacatgtctaataacaacattttttttttctgaattggaggttaagttgcccagggaaaaacatgcctacagacacatgaggactattctaccttcatcagtttgcagtggaaaatttagtactattggccattcacatatcagatattttacaccatcatataaaaagacctggttattttctttttttctttttttatttattttattttattattattatactttaagttttaggatacatgtgcacaatgtgcaggttagttacatatgtatacatgtgccatgctggtgtgctgcacccattaactcgtcatttagcattaggtatatctcctaatgctatccctcccccctatccccaccccacaacagtccccagagtgtgatgttccccttcctgtgtccatgtgttctcattgttcaattcccacctatgagtgagaacatgcggtgtttggttttttgtccttgcaatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagtacctgtttttccctgactttttaatgattgccattctaactggtgtgagatggtatctcatcgtggttttgatttgcatttctctgatggccagtgatgatgagcgttttttcatgtgtcttttggctgcataaatgtcttcttttgagaagtgtctgttcatatccttcgtccactttttgatggggttgtttgtttttttcttgtaaatttgtttgtgttcattgtagattctggatattagccctttgtcagatgagtaggttgcgaaaattttctcccattttgtaggttgcctgttcactctgatggtagcttcttttgctgtgcagaagctctttagtttaattagatcccatttgtcaattttgtcttttgttgccattgcttttggtgttttggacatgaagtccttgcccatgcctgtgtcctgaatggtaatgcctaggttctcttctagggtttttttggttttaaggacctggttattttcaaagcttccaagaaatggagtaaaatactaatgccctttaagtgaacatattaataaatcaggaaagagagtttggttataagagctgaaactctaggcatctgtgtcagaactcagtatttactctcctaaaatggatagaaacctacaaactcactgcctaccctctcccagagcaccattccccatagaaaaccccatagaaaaacactaacatgcctgggtctcaggaggattcaagccacactcagatgatctcctagaccccattttacttccaactggcaggaatcacaggaatggtgaatatcaattctgttctcaagaacttacccccaaacactgaaattgtatctgctagctgcctcattactggttgtgaaaacatcaccaaagatcttgcacagttcaagtagctgtgagtccttctcttcaataattattactaatgatctaattgttttccctgggcagaaatagcaaagcttctgaagacttcaaaatcaaccactactctctttagcacaaacagatcaataagcaggtatcttaaaaatccaaagcttgatgaaattattatgtattatgaaattacactgtaattttaccactacatattttcctcagcactcagcatagcatcccctcaaactggcttccaaactttgacgtgtgcattctaagagaagtttggggactaccctcactcagggtgcacatactctgtcccatcaaatagcaaatagacacaaagttacagtattccagtcattatactgcagaaaattatttacagaagcagcaaacctttcttaggaaagttataagctaggctgctggctctttcctttgaatccagcctcgctcacaccgtagaagccagagcaatgttgatggatctgtcaagttcataataaaaaataacagagaactcctcaggtaactgaaggtgatttggcccacgtgtggggagaaaacagatgacagcgtggagggggcttttcagacatgaccttttcttcctccttcacattgctgaggaaggccaatcctacctaggtgcttcaagaaacaaacccctgctggcagtgaggctcggggttttgaggctagacaagcagtagcagaggagcactgcctgggagggggtcaagcagatggccaggatttcagcatctccatcctccctgttccccaaggggtaggtaattacaattgagggagactatatttctgggagcacagatgattcccccagaggctcttttccctgcaccctcctaccacctgaacccactgggacctgcacaagtgagggccttggcagtatccacttctccaaagacccaagaccagcctaagtagtaaatatgcctaaggaaataagaactcatttggaaaataaacaagactgctttggaggacaactgttaaaaaagaacggtaataaatggaatggctaaaacctgatgaagcatggttattgaagtagacatacaaggtgttcaacacacatatcaaatattccccaaagataaggaaggatgttggaaacatgacataaaacatgaagccctaaaaaggagtcaaatggaaaatcaaagaatgcaaagtttaattattttaagtttcagtaaatgcattgaatgccaagtggattcagctgaaaagccaattggcgagccagaagatctcagaaattctcagaggacatcagcaatagtcagagagagggaaaacttaaaagataaatgaagcaatatgaagaatagcaatatgaagatcaacattcatataaaaagaatcccagaaggaaggaaaacaatcaatagaaaaatggaaggaaacatatgagagaaagattgagaaccgcccagaaaaaggaaaaggtataaaacttccgaccaatgggcttagtagagtgcaaaacaggatagaaaaaaaggtgatgggcatacctcaataggttgtaataacatttatgtaaaacaatgatagagagaacattctaagagcaggtcaattattaaaggatgagaactagatcgacctcagacttctcaatagaacacataatacaagaggctatcaagtaatattttcaaaatgtggaaccaagaatattaaataaaaccattatttaaatgggactatgagacctggaaatacttaaaagatttatcatgcacaagcttcttgggaatattcttagaggaagtatttcaagaagatgaaaagtctaggaggacagtatgagtggtgtcacagagtatgcaaataaagcttagcaaattttttactgttgatgacatacagaacttacaaatagaacaaacaacaaaaatatattttaataaaaatctggaactaaaatatagcctcaaaatatatatatcaatttattgcttcagcggtgggatggggtagaatgagagtgaggtgaaaatacattaaagcacttttcttcttgtttgcgaggaagatgtagaaattgaaaagctcagcaaatttatatggaaaaacataaatatgatcttacagatacaaaggaaactaccagaagacaaaaatataatgtataatttttagaccaatagaagaagatttgatccacccaatggaaagtaggaaaagagaaaaaaaataaaatgtttaaaaagtaagggaggattcctggtctgggaaaaaaggcatggaccatttctctctgcttcttcccactaaatgcaattctaaatcctgaaaataatgcaagagctaatcaaatgagaactctgaaagaccgtgagaggacagaaatctgccttgggactgcaggactagagagaaaacatagcttcagggcttcctacatacctacttcatgaaaaaagatgacctagacctggatttcctgacctccaaccaagcaaccaaaggcagctcagctaggtttattcctgccctggatttggagccctgctaacaataagcagccaggggagagctctccttccctcctggcctccaactcccttcccctcccagagacacctggttagccaggagcccctggcaagagggaccctgccacaacagatgcccagcctgggaagtgttctcctctcccctccctgccccaccaggggcaaggggaattctgccacagtaggtacccagccagggaagtcttcttgtcctccagagtctgagactttacacccgcaccaagagacattcagttacctgacctggggggaggccccttctgccttctgccccttcagctagcaccatcagggaccagtggaagttctcctagagccagatgaatcaagcagaaaaacaacaacaacaacaacaacaacaacaacaacaacaaaacaaccaactccaaaacaaaactcgaaggcaaacaaatgaaaggaaccacactgcaatggcttcaaaaataaaaattccattggaaccacatatagaaaagtaggacgggacctgcatgataaagctaaacagaattccctcataaaataaaaaaattaaatggaactcaacgttttttaacataatgacccacatgcccaagatataattaggaaccattcatcataacaaaaaccaaggatatcacagcttggatgaggaaagagaatcaaccgataccagcggggagatgaatcagatgttggaattatgtgacaagaattgtgtatggtcatcatgaaaatgcttcattaaactattacaacaaatgaaaaaattagaaaaggtcagcaaagatatagaaatttttttaaaaaccaaatgtaaattatagaactaaaaatacaaaaacagaaataaaaatctcactgcataggctcaattgtagagtgaaggtgatggagaatagattcagtgaaattgagaacagattaatagaatttacccaatctgaacaagaaacaatggactgaaaaaaatgaacagagcctctgggctctgtgggacatagcaaaagatccaccatttatatcactggattctaaaaggagaaaaggagagtgaggctaaagaatatttgaagaaacaatggctaaaagctccccaaatttggtgaaagccataatcctacagattcaagaagctacacaaatccccaggagaataaataaaaataaatccacactaagacacataagaattgaatttctgaaaactaaagacaaggaaaaatccttgagaacacccagagagatttactacctatagggaaacaaaatttcaataacagtgaatttatcatctgaaactatggaagccagaaagaagtggcacaattatcaaatgataatagaaaagaactgtcaacctacaatcctacatccagcaaaattatcctttaagaatgaaaaggaaataaatatattcccagatgaagaaaactaccgtgtatttgttgttagcagattaaagattagctagatgaaattctctgggaggtacagaaaggaatatagaataaaaagagtagaaacacagtagaatatcctttacctcatgtgttttatgtattgtattatggtgattgagacaaaaattttaatgtcatctgatacttaagacaatagtattttattttattttatttttgagacagagtctcactctgtcacccaggctggagtgcagtggcgtgatcttggttcaccgcaacctccaattcccaggttcaagtgattcccctgtctcagcctcctgagtagctggaactacaagcatgtgccactgtgtccagctaatttttgcatttttagtagagatggggtttcaccatattggtcaggctggtctccaactcctgacctcaggtgatccacctgcctcaccctcccaaagtgctgggattacacacgtgagccaccacaccaggcaataatattttaaagtgcagaaggtagagattgaaatggaagggaggtttatttgcatacttaaagtagtaaaatattggtgccagttgatggtgatgccaccagcatattgtaatacacagagcaattattatgcaaaatatacaaagagatataatccaacatattataaataaattgagatgaaaccctaaaaataggtccataaaaatatgctcaaatgatttttggcgaaggtataaaagtaattcagtgaaggaacaatagaatttttaacaaatggagctggagctattgaacattcatagggaaaaagatgaactcaaactaagtctcatacttcatgcaaaaattaacttaaaatggatcaaggacctaattgtaaaatataaaactataaaacttttaggaaaaaaaaaggagtcagtctttgagacctaaggcaaggcaaagatttccaagactcgacactagaagcacaatcaagtaaaaggaaacattgataaactgaacctctttgaagtaaaaccttttgctctgtaaagattcacgtgaagaagatgaaaagacaaactagtgactgggagacatgtttgtaaccatatatatctgacaaagtattagtatgtacaatgtacaaagtctcaaaacccaacactaaaaaatattgagtagaaaagaagcaaaagacataaaatacacctcactgaagaggctatatggatggcaaagaagcacgtgaaaagatagtcaacatcattagaaatgagggtaatggaaattgaagctgcaatgagataacattacacacctctcagaatggcaaaaacaaaaaaaaattataacaccaaatattggtgaggatgcagagaaacaagatcactcatgcatttttgataagaatgcaaatggttggccactctgaaaaacagtttggcagtttcttataaaactaaacatgtaactatgatacaacccagcaattgtgctgttggacaatcatttcagaaaaatgaaaatttaatttcacacaaacacctatgcacagatgttcatagcatcttttattcataatatccccacactaggagtatccgagatgtctttctgtgggtgaatggttaaacacactgtggtacatacctagcatggaatactactcagcagttgaaaaggaataaacaattgatacacgaatctccagggaattatgctgagcacacacacacacacacacacacacacacacacacacacacacaaaagccaatcccttaaggtatctactttatgattctgtttatacaacgtttttgaaatgacaacattttaaaaagtagtaacagacttagtggtctccagggactagagagggggaggcatgggacgtaggcaggtgtggttataaaagagaacatggagattcatgtgataattgaattgttctgtatcttgaatgtggtaaggggtacctgaacttacataagtgataaaatcacataaaactatgaaaacacacacacaaggggaactctgacgaagatcagtggattttatcaatgtcaatactctggcatgatattgcactactgttttgcaaagtgttaccattatgaagaactgggtaaaggtacatgagatctctctatactctttcttacaattgtatgtgaatttaataaaaagaaaaagaaaaatagaaaaaaagaagggaatttttttaattgaaagacttggctaaaatcaatgagaaaacaccaataattacacagtaatgagagtacatgggttaaaaccagcaatccaaagataaaatcttagaatgggttttatacaattcagcaaatgttttatgttggagtcattttaaaaatatgcaaataaactgaaaacatagaatggtaaaaagataagctgggtaaatttgaattaaaagagtgttggaataacaattttagtatcagacaatttaggctttaaggctaaaatatcatcaacaatgaaaattgtcacatacagaaaagaagcagttagaaaatttaatgattggaacccctaggtatctaacatcataatctgagactcataaaacaaccaataaaactatgggaggaaatagaagaatcaagaattatagttggaaatttaaaacactcatttcagaaactcatagatgaagcaaacaacaagaaaaacaaatatataaagattttaataacataatatgccttcactttccattcagtgaacacaatgctcattctttttggacatatatggaaaatttacaaaaatcaatgaagtactaggtgataggagaaccctcagataattttatagagttaattctcaaccagtatgcaataaaattagatattaatctaacaaaaagggaggtgaaaaaaatttattctatttagaaacgaaaaaacatatcactatacagcccttgaattaacaagggaaccattaggaaagataatgaaaaggctgtctgtcaaatctgctggacaacaatgctgtaaattctaaaaatatatataatgcaattacagaaaaatatttcaaattgatagattttgtgataggcccacaagtgtttgttaaattattttccatatttttctgtatatttaaaatatttaataattaaaaatttaaataaacatatattggacatggttaaaatattactcagacaaaaattaagggctttaaatatgcttattataacattaaaatttcaaaagaggaaaatatgaaaaagaaaacaaatgagttaagtgtttacagaagctaataaaaagtaagataataaatccaaagaaatggggaaaatggaaatataagataagaacaaatcaatgaaatagtgaacaaagatcaatatgaagattaacaaaggaaaaattagttctttgaaaggagtaataagatagcaaacctttgataagactgaataagataaatcagaaaaagaataagtaaaacacatactgaaaaggagatctacgaacaagtaattttttaaatactttttaaaaatatgaacaaacatgtaacaatacatttgaaattcattaaaaaaggattaatttatataaaggatataaaatattaaaatggcagaagaataaatggaaaacttgaatagaatgtaaaagttaaagatactgaagtggtaataaaatgtctccttcaacaaaacccttgggaaaatgatagggaacccgagaaagaagcaaataggcaatgaatatgaaaagataattcacagaatagtggagaaatacaacttcaaacgagatcccaccttttacctattagattggctaaaattaggaaaatgaaaaataccaaagtgcccccaactgaggactgttgtttctagtatggaccagaccccattcctgcactcctgctccagtgcatcgctcagaaaatctattccctccctccctcgctccatctctccctccctccctccctgcctccctccctccctcccttccttccttccttccttctttccttccttccttcttcccttccttccatccttcttcctttccttccttccttccttccttcttcccttccttccatccttcttctcttctttccttccttccttccctctctccctccctcactccctccctccatccttccttccttccttccctctctccctccctccctccctcctcccttcctcctttcctccttttcttattatattttctttctctttttgttattttatattggcatagacataaaatacatacatcatgaatgtactgcttgatgatttttcactcatggaatcctcaccatcaagaaataaaatacttcttgtacacaagaagtcccattatgcctctcacattatgagccaccatgcctagcctattttacttttatttttgaagaaaattcaaataattgcatagttctagattgccagttaatttctttcagcattttaaagatgttttattgtctcctagctttcaccacttctgtcatccatatttttgttcctttgaagttaatgtgcctttcttttctctcactgcttttaagagttttgttctgtctttgattttagaagtttcattatgatgggcctaggtatgtgttttctttgatcttttcctattttgagttgtagtgtttcctaaatgtgtggtttgatgttctttgtcaatacatgatattcttagctgataatctcttctaatattacttctgcctaattccttctttatccttcccatctcatcatttatggacatgggctttgagagaatgttaattaatatgtccaagaaaatagggaacatgatggagaattttgacagagaactggaatatataaaagaaaatcaaattaaaagtaactgaaacttagaacacaatagtggattgaacagcagattcgagacagtagaaggaagggttattaaatggaagataggtctgtagaaaatatctagcatgaagctgtctggatgggagaaaatatatattttcattgaaaattcctgatttttggttttccaaaaaaaagtcaaaattttgtcaacattgaatttacattcctcatagtttcagtgtgcctgagctgatgagttgttgatgtgctccatatacagggatatgtactcccaactagccacagtcactcctttctattatcttctaccactgaggctgaatattagttgtcatggtttatatcatcccttccctgctccacacatttacattgcgtgctgggcatgctatatatttgagttcatgatccgtgttgaagatgccataaagacccaaaaatgtgaaagagacttggaaccgggtaacaggcagaggttggaactgtttggagggctcagaagaagacaggaagatgtgggaaagtttgtaacttcctggagacttgttgaatggctttgaccaaaatgctgatagtgatatggataatgaagtccaggctgaggtggtatcagatggagatgaggaacttgttgggaactggagcaaaggggactcttgttatgttttagcaaagagatgggcagcattttgccccagccctagagatctcgggaactttgaacttgagagaggtgatttagggtatctagtggaagaaatgtctaagcagcaaagcattcaagacgagacttgggtgctcttaaagcagtgcatttttatgcattcatgaagagatgatgtgtaattggaacttatgtttaaaagggaagcagggcataaaattttagaaaattcacagcctgatgatacagtagaaaagaaaattccattttctgaggagaaattcaagctggctgcagaaatttgcataagtaacaagcaaccaaatgttaatccccaagacaatggagaaaatgtctctagggcatgtcagaggtcttcatggcagcccctcccattacaggcctggagacctaggaggaaaatatggttttgtaggctgtgcccagggccttgcagctttgtgcagtctcaggacttggtgccctctgtcccacacatggctaaaaggggccaacgtacagctcagcctgttgcttcagagggtccaagccccaagccttggaggcttacatgtggtgttggacctgtgagtgcacagaagtcaagaattgaggtttgggaacctctgcctagatttcagaggatgtatggaaacgcctggatttccaggcagaagtttgctgcaggggtggagcactcatggagaacctctgctagagcagtgtggaagggaaatgtggggtcagagcccccacactgagtccccactggggcactgcctagtggagctgtgagaagagggccaccaaccttcagaccccagaatggtagatccactgatagcttgcaccatgcacctggaaaagctgcagacactcaatgctagcccgtgaaagcagccaggagggggactgtaccctgcaaagccataggggtggagctgtccaagaccataggaacccatctcttgcatcagcatgacctggttctgagacatggagtcaaaggagatcatttcagatctttaagatttgactgcccagctggaatttggagttgcgtggggcctgtagcccctttgttttggccagtttctcccatttgggatggagcatttatccaatgcctgtacccctaatgtatcttggaagtaactaacttgcttttgattttacaggctcctaggtggaagagacttactttgtctcagattagattttggacttggaattttgggctaatgctggaatggattaaaactttggggtactgttggaaaagcatgattggttttgaaatttgaaagggacttgagatttgagaggggctggggtgaaatgatatggttaggctttgtgtccccacccaaatttcatcttgaattgtaatccccataatccccaaatgttaagggagagaccaggtgtaggtaattgaatcatgggggcagtttccccagtgctgttcccaggatagtgagttctcatgagatctggtggctttataaagggctctttccctctgcgttctgcacttctccttcctgccaccatgtgaagaaggtgccttgcttccctttcaccttctgccatgattgtcagtttcttgaggcctccccagccacactgaactgtgagtcaattaaacctctttcctttgtaaattaacgagtcttgggcagttctttttagcagaatgaaaacagactaatacaatagagtctagcaatagagtggagaacaacatagttacaagccctgccctcagggaaaagaaaacaataatcacataaataattagaattgtcataaatactctgaaataaaagtaaaaaatgctaagagatccatcatattttccagttggaaggcagggaatgtttctcccaaaaaggttatttaagccgagttctgaagataatatgatttagtcagatgaaggcctggttatatgtgtgttgatggagaatggacagagagagttgatctagcctggaagagttggacaggtctgaggattcaaagcaagtcagtagggctggtaacacatatatgagcagaaactgtgttgtattgggctgctgagtctggaaaaatacataggattttggatgcctttgcagaccaagcagctaaggaccagcacatttcatggtgacttgatggtgtgcaaatttggtccctctgatgaatcttctagttgaaataatttatcactgtgaaattaagtcatcaagtataagatgaccagctgacttttagccaggtagacaagctatcgacttggtatgatgaaacatcactgagttcatttttatgcctttgtttcctctctgtctcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatatattgtatgtcatatatgatgtttacttatatatttagaatctgcatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttatttaactttctttttctctcccctcttttctctctcccttccccttccactcctcactttcctcctcccaccctaacaagagtcttttccataaaaaggccctaggaagtttttcctgatttcagtgccatgacctgagtcttcagagctctttgttggcccaggttcacaggtgttgtgagtgtggaaaggaaatagcatggagaggctggaggaacttgacacatggctttcaagtctcatggttgatgttagatgttagctgtgcttcctccctgggtctttgccaggactcaccactggtgggtggggaaattgccacctccccaggccagccctgccagtctcacatcccatctgcaggaccatggccttcagagagcagacatttgtgttcttagtcactgcctctggactgcttagaaaatcgatccttgatcctatatttggattccatggtcttataagaaagcaaccactgtcactctgcatccttgctggcccagtcacaggctctacgttaatttatagacatctgaactcgtttgttaacccaggtgctacaggtggaatcctccagcaaagcctggtctccaatgctctgggtagaggtgttgaaaagttaccacctgctgcaagtggatggcttgaaagaatattctggggtgaagggaagtgccacctaagcaagggtttattcctgggtggaagaaactgcaggctctgggaatgagtctttgaaggtgtgtctggctttccaaagtgagctaccaggaggagctcggtgtggggcagtcagaagccatgccaggtatgtgatggagtccctgggtcattgattctgctggaggccaggactgattcagcagagatccctttctcctgtagcggagaaaaatgaatatctttcctttacccatctaaaggttctcagctgaggcacctatacagacagagtaacaagagaaaaatgtacaaatgtgcttaatataaaatttacatgacacagaagcctgcaaaaatgaagacccaaagcaacagaaaccagtgtatttttatgcttaagtttgaagaatagcagacagatgtggagaagtataattggacaaaaggagtatgatttaatggcaataaactggggggagcttagcaaggcctgtttgctcggattcttcgctgcatccctgtgtcttcagagataaggatactcctttcctttgggtataggttgtacactttaaagatgagggtgttataatctactttagaggaaggtcagataattatttatggcctgcttcaggaaagaatggctgcagaaggtcagagagactttcctgcttctgctgttcctcaaatgccaaggtgccatattttggggtagtgtattctgaaccccatcactctctccctccctttctccctccttctctgccctgcccactgagccctgagccctccaggttctctggggacagactttcccaggcataggaggattcgttttcctgcatagcattataagcacctgtcaatttcactatctggctataagaacacagagctatatttgttgaaaaataggaagcttggggtcaaggatgaaaaaagagtggagccttatcctaggtcctgtggtggctgctgtttgggtgctccaggggtcccccagaaagcctcccagatcctctccaccaattgaaatgctgaggatgtcctacatttatttgttgctttcttgggggtgagtgggtgctttagaggggaccttacagcttttgctggctttcagtatcatttccctgttcctgtatcgcagtgctggatttattttcacagagagggcagccgttctctgaattcatgagtgccatggattttaagacaatgttttctgagaacggcaaaattatggggccagaaaacagataaattgttgccaggaaaggggaagggactcattacaagagcaacaggaaggaatttggtgcgtggatgttgggggcggatgatagaagtattctctctcttgattgtggtggtagttacgtgactgtgtgtatgtctaaatccataattttacatcagaaagagtgaattttactgtgtatgactttataacaattattttaaaaagtttttttaaatgtctacctatttaaaaaccgggctgtagatgtttgagtcagtgcttttgtctcaggactatcaaaacgcagtgtggcctgctggaaagagcacaaggcttgagtctgagtctgccgtgatcctcagttaggcctcttacaggccgcatctccacatctgttaagaaaaacaccaccacgacataagaggataatgaaaactatctcatgaagctgtgatgaagatttaaataaaaggatgcatcacgaagtgagagacgcatacctagtagaggctaatttgtgttaacttttgtttctatcactctttctggcagtcacaagcatctctaaaatgctttttgcatgcataatgctagcaacactatttgtttgtatgactcagtctccaggcttaactttcccttttgcataaggagtttggggatgcttgagattgttacattttcctttacatgtataatatactcactttttgtcaagaagtagacatgagcaatgagttagtggaagatacccagtcagagaaaggtttaacgaaggaaaactcccgtttgtattcgggtccaggattttagactacagaaggtacggggaaatgataacaagggcctcattaggaaggtgcttttgttttcctgcctgtgttttccgggagccattgaagtctgggtactttgcatttatcctgtggctaaaatgtctattcgctttgcagctctgggttggttttgctttagaactccgtgctgggtctgaccatcctatactggtttctctactgaagcttgatgccctgaaggcagtcaatttctttttgacccaaatcttccatgaaaaattactgacttcttatagaggtccacaggaagatgagttttcaaagcctttcccgtgcttatctggccaacgtggtgatgtgcattctggtgatactttgttatcacaagggctttgtcgttgatcgacaccttcctgggtctacggtccttgccaggctgctgagcaccattcccccattttacagctgggcccattaaggtgaagcaatttgctttggactttgttacagaggaagtcagcaacagggctcagtgccaatcttagcatgaacttcctcgaattgtaagagcccttttcttttccagtttcatgacagctctcctccaagcctttctgaggactctggaaactatcagctgctgttggccctggttcgtagatgttacagaaattgaatgggggccaggcaggagccagggaaatcagtgagccaggcttcctccgctgtgaagtggctcttttgtacgggctgttctggccataatacctgcgtaatttttttctttcctgtctgcaacctagcctgcggggtgctttctgtttccactgctttttctacataatgggctccctggacagtaccactctcccagacttctcatcccagctgcttcctttctgagccagtagctctcaccaaagaggccaaaagaggacctggcaatgttgagtcattgcgtgcagtatgtgagtagccagtgtgtgaacacagctgcagtgaacggaattagcaataagacacaacgcaaccaggtagcctcatttgttcagattgaggtcttcaaaaagcattttaagtttacgggtggaaaggtgtgatacctttcctcagccatcattaagggctaacactcctataacaaaaacaagttaacaagagaaaaacataacacatttatttaatcagagttttacatggcacaggaggcttcagaaatgaagacccaaagacccagggaaaactatttttatgctcagatttaatgcagaatagtcagctatgaaggaatgtgattggacaaaatgggtatgatctaatggttatagactggggggtgagcggaccagcaagccctgtctgttcagattcttcttggacgctctgcatagtatttattcctcttgggtatggggcaggactcctctaaatggagggtcttcaagggagaaggaagagagtgacctttgtaggttttatgtttgctttgagggagaggagtcctagtttctaagactggctttgaggaagaggaattctggtttctatggcttgcatccagggagaaaaaggagtgtgagaggggagggcaagagaaggcagagagaccttgcttctgaggccttccaatctcctttggttcaaagtactcagcataccaaagtgtcacacttaggggtatcatactgtgagccacaacataagtatctccattcctttttactcaatttcacataaagaaagctggaaaaggtgatccacaatgaagatgtttgtcctccttgtcttaagctgatttctatatctagaaatgtctttattgggcaaaagtgcttcctcttcagccataatgggtgcagatctgattctttcttttctctgacacttactggccctgggacagctggaaactcactttgactctccaaggagcacatccctaaatgtgtgatctcttgatatctctcccacttttgaaaagaactgacaagggaaaaatgttcacttacccatcagctggtttttctctttttgtttaatgtctttggggagaaagcaaagagctaggacatgaagaaaacttctgtctccactgcattttgaagttttgcaaacccagccatctttcccaagagcagagcagtagaagcaaccaggatgcaaccagggttggtaattggttggttaattaaaaagtcagaaaagacagagagtcataaaagatgatgcatgcgtattttaaacctttttgtttctagctgaaaacatgccctctcatttgctattcattcgatataggaccaagtatttctgtttgtagagcctgctgattggcttttcacatgaccctcgttgtgtaaacctcacctatcatgcatcattaacaatttccacttttggtgtctttaaagtgggctggaaacgttaagagcacttgcaaaacaattctcagcctccccctctctcttaaatgttattgaatctttccaaggtttccagcttgctttttatggaaacaagcacttgttttcacattaatatttcatcgctctacatagtatttatttagattgtataattaggatatttaaatataactggcctacagaagtgaagaaacaaatgcaacttgaccaatagaaacagaactgcgcaggcttaccaggaccctgcccctggcctggccctggccactgaatttgagagagaaagcagagtccagggacaagctggcaggtggctaagagaggtgtttcttctgttcagtgagctggctcctgcttgttctctcagttaattactgtcatcagcttgtcagcctccttcacctgcccaagggaaggaaggggactcctctgatctgctggcttctccttctttcggaatatggtggaaccttgctccatgctccagggcctcacggtggccctttttccactaattaaaaatagttcagcgcttctgaggaaaacaacctcagggctcttggtgacgccgttcaccttggaaattccttgtcattcactggtgcagtctgagggatcgatagcaggatggcgtctgcctgaatggcaaggactcattttctgcgtttgtaacagaggaggtgttatccaatgaatcctcagtggtgtcctgggagtagctgagaatttttgtaatgtggaaaatcagatagcaccctgccccctcatcacagctacagtgcatttgatttccccaccactgggcagccagggcagttaaagtcaagagcttccgctccccaggagcttccggtccccccataagctggtcgtgagctattcctgcccttcctaactaggagcaggcaggagatgaacactggagttccatgaagctcctgtgtgaaattatcttacctctacccaagacttactgcactgcctttttcagtgaatcgtttaatgccttccattctgaatatgctggtgtttctgctttgccagccattggtcattccacaccccctcctccacccggcccccaggtatttcctggaaccattgattatggcagagcagatcttattttgctcatatgattaggaacctcaggccaacaagcttgggtaatagtgagagaaaagaagagtggtcctttgctcttctttgtctgagtgccttttgagggaaagagtagataccaccaaccatagcatctctatctctttccagcaaactacaggggtgcctgagactttagggtgggaagcaagctctcacttggaaggggtgacatccagaaccaggattaaacgctgacatttaaaaacagtaactgtggtagtcttaatagttgcacagtttacagtgaaacacttagagttcaaatttgttttactataaagtgaacatggatggagtttgggatttgattctgtcttcatagtttccctttacagttcaatatttcttagctcaaagaacacattcccttaaaaggaatccctcaaaccacttttcatttttattttcttatacaaaagggccttagggttggatgtccctatccccagaatctgaatccttttattaaagggactgtatctaggtactagccggtgccatgaatctcattttggattcaaatggattattttctcagagggttctaatgaagtctggttttattcagatttgactatcaaactcagtgtgcttaaagaaaagcagttcacatcctcttgcatgatcgtgtaatataaactgtagcttttcaaaggttgcccttcaagtaaactagaaaccacaggccaattaacatatgccaattagcaagcaatttcttcttctaacaatttgtttggttctgttaattacttttatttagagcttgtttctccgagccaccttcaaaacaagcatgcagatacttgaagacaattcattgcttgctctgacctaaagagatctaaatatttcagatgctttctttaccactgacgacatctggatgcttttaaaagaaatacgcagttactcagggagtaaccgtataatttgaatatgtggatgaatactcgtatcagatagagtaataaagatatacccttaatgtctcaattttgcctctctgcttattggcatttacacgactgtagaactcggcatttatatgaaaagacaaacaccataaaatctatgtcaaatacatgtgaaatatattctttgtgttgtgggcaggcatttgtttgaagtaaatattctttttgtagataatattttaaaaagaaagacaaaaccatatcgcattcctgaaatgtatttaccaagcatgtattttggaaaacagcccaaaggaacatatttaaggcagtgattttaatactaaactaaggaaatagtttgatgcatcagctaagctcatggatgggggtaatcacatctggtttacctcaagccacaggagaaggagtgagacttgacaatgtaacaaccattatgaggctcaagtagcgtttttggcttgtaagcatgtatgtgtgctgtgttcaattttatgttttaaatttttttaaaaaacttaaatactgctatagccccaaaatatgtaaaatatgtaaacagttggcttgatggccataagggaacacctgtccttttttttttttttttttactgtgtagcctgtgactttcactgcaggaattaaatatttttgtggataggcaaatgtacttttgtggataggtattgctgatgccttattacacagccgaaggaaataaggatctgggtaagcagttgagtcacggcaaagagtaccgtatccaaggtggaggttcatgctagagctacaggtactaacccctcccctgcaccactgatccctagcaagggtggaagtaactgatgacttctctgcacagcccccagcacaatgtctgaaagagagacctaaagggtaactgcctgttttctcagattaatcttagaatcctagcagtacttgttacttcagtttggagatttttcttattctatttcttcacactcttacagacttcacatagcccctccctttagaataactcttgacagcattttaagaaatagactatttaaatcatcttgatccagtgactcaacccaaggtgtaacccgtctgctcaaatttgtggcaaatctccattgatgataacatttctgcaaatgtatgctctgttaggtgtggaagcttttcctaagtagaattggcagccacagtagtacctgcctacctagcaatttaacttaaacagtttccttttccaaaggtattttctattcagaatagaaataataaatatgatttcctcatcactctagatacagcctgatgagatattgttaccagatactttctcttatcaaaacaaccattattatttcataatatattccctaccctttgaatataagctccagttctaaaattttaaatgttggtatcttccacatgtcatagggaaagacttaagccttgtttatgggaactataactgagtaaaaatgtccttggagaccctggtcatggaatttgtgactgttcttctactggggcatgtggtttagacatctgctcaggctagcaactgaatgcttttctgggtatacacttttatagaaaaatgttttttgaaagtcactttaatgggaaaatcctgcccaacaaaggaaatcctattttctgtttttaaatcatgctccctgagttgggtgagcaggacagaaatttgacatcagctctaattcaacacagctgaaaatttctgcccaaacattcaggcctacgggttttgatcatgaggtgagttaagcaaattatatttgaaatattgcctggctgagtcggtgctactgaatcatacccgtgtggagggacagcagggaagatggtagggctttattggaggccaataaaagccatgtgtgtacagcagtactgtggagagccccaggaccccatggctgtccctgtggcaagaaaattatcccagataaggctgttcttggctgcactgaggcaaaggcatgtgctcagcatccagaaaggttcttcttgttggttttccttcctggctctttatacttgggtgaaatgatctcttggaagtgtagtctgaaaaacagcatagcttcttccaagttctcataagatacaggagtctccattcattacttcaataagcattactgagcaccttttatgagcaaggtaggacgacggaggcagggccaggacctcatcatctggtgagggagacaggcggttacacacacagggaggaactcctcctacccagaagtaggcagggttggagattcgggattgaagcgttcctggaagaagtggaatctgcagagttttgaaaagagggggtgttaggtgtagcaatcagaccatttacctgttataactgcttttcattctgacccacagggaaaacaattattcctagggttaaatgatgggacggatgttcagaaaggaaaaaaataataatttgaattgctgaaaggaccgcctgacaagacaaattactggagagtcttcaaagacactttgaaatgccgagcaacctgtactttaaatgatccgttcagaattgcaaatcctacagaactccatttctgctaggaatcccagtggctttgtagtgggtggtatttttaattatcaagtatcagtcttgcaggctttctcttttttgtcacatttgatttaaagtacaaatgggagcaaaagttacaaattgcacacagagagacactcagtgtgtgaaattgtggacatggttcagaatatgtttatttggaatccgctgaggtgatgggagagatgggactggatactcatgttcttatttggaaaggagacattctcgccgcctttcccatgtgcccgcttgcttttctctgcttccagcctgatattttatggacttgtggatgagaggtcctgtgcccatcattgcattccagattgtcatggctgttatcattgtcacctccactcattatgcctctgagtcctggagggagcatatccctttaataagactgaaccctccaggaattgagactttgcagagttctgagagtagaagggaagagaacaccatgtctacaggtgctggctgtttgcttctctgatttctttccatcaccactttgcccaagttacatgactctttggccaggtgcggtggctcacacctgtaatcccagcactttggggggccaaggcaggcagatcacctgagatcgggagttcgagaccagcctgaccaacatggagaaaccctgcctctactaaaaatacaaaaattagcctggcatggtggtgcatgcctgtaatcccagctactcgggaggctgaggcaggagaatcacttgaacccaggaggcagaggtcgcagtgagccgagatcacgccattgcactccagcctgggcaacaagagtgaaactgtctcaaaaaataaataaataaataaaaaataaaaggattcttcaagcctcttttcttgtatgtaaaagaaggaattgaaccttgaggatggttcctaagacccctaccaaatccagcagcattctctgcttctaggtattaagattctcagggaaggtttccgacattcttagtagccctgaaggaggcagatctttgtaaatgcatttgctgtcctgggaaacaagatggtgttaagataaggaagctccatttctcttgcagttataacccaaggcagagcctcctgattaatacacctggcttacaactcactattttggcttaaacagaaatgtcagtgcttccaaagctttcactgagacaccttctttgaaaaaaaaagtttcttttattttaaaagaagcaaacaaactctcttcaacagctccctttatttacttatttatttatgtagctttctatgaaggcttagcaaataaaacagataaaattagaaattgaggtagagttgacagtaaaaacccttttcctcctaccaggggatctctgcagaataaggcctaaagcccactggtttgagagaacatcctccagcaaggtgctttccaagcaagggaaaaactagaagtagtgaaatacacctgatgcttcctgcagagactatgccatcctgtgtgaccgtaacatataaacatcacataccaggaggacatgatcatttaaatagacagcaatgttgtccttcagtctaggcaatgggtgtgccccaaggccagtgtgagggtccgggagacaggaatctgtatatttcttacctgcctctcatgatttgagcaccttgctctgctaagtgtcccctgaagaaagagccacttctcccaaaggtggaagaaagtgaggccctgtgggtcgtattgcactcagatatgttggactcactgtggtatgtcttcctgcggaattttctaggaaatttttactgtacttgttctatacacacacacacacacacacacacacacacacacacacacaccctcagaatatgtgcctgtactgttcaataacttacacattgaactaggagccagggatctgggattactgaccagtggcagtggtcacttgttgtaatgtctttgttgcacttcccagcctaatggccatagtgccctgcatgggtaggagttcccctccctgagagaagtctgggcattagcactttagtgagcttcaaaaatctagtcagtcaactccctaactaggtaccagtgaagatgcactacctgctagcattttgcaatagttttatccactcatgcgaggttctgtgtagggacaacccatgtaaggcccctgttttacctactatggctgcatcaaaatcaacacaaacttagtgatttaaaagaactatttatgatattcgtggatctgtagatcagaaattggggtggggcacagtgaggagggtgtctctgctccacaatgtctgggtgttagctgaatgacttgaagacaggggctgggaccatctgaaggttcagtccttcccaagtctggctgttgactagggctttagctgaggctctcatccagacatctacaaacagcccgtccatgtagctggggcttcctcacaacatggagactgggttccagggtgggtgatctgaaaagacatgtcaccttttatgacctgactttgcaagtcaggcagtgtcaccttcactatgttccatacattgaaggaatttcaagggccatccaggtttaacaggagaagtaataaactctgttttttgatggtggagaggcaatattccagaaaagtgtgttgctatgaccacacctacactctgccatacctgggcatggcatggaaatggccaaggaagttttgcctagtccctcatttatggactaagaggcaggacctgggcaactttgcacagctgatacccatggttcttttttttttttttttgagatggagtctcctctgttgccaggccggagtgcagtggtgcgatcttggcttactgcaacctccgcctcctggggtcaagcaattctcctgcctcagcctcctgagtagccgggactacaggcctgcaccaccacacccagctaatttttgtattattagcagagacagggttttaccatgttggccaggatggtctcgatctcttgaccttgtgatccacctgcctcggcctcccaaagtgctgggattacaggcgtgagccaccgcacccagccaatacccatggttctgatcccaccctgctctctctggacagacagatttctttggacagaacagaattttttaccagattgatagaaatatattaatctaccctctcatcagctgtcaattctcagtttaggtctaaactaattctattctcaagattccaagtgagagcattatagtaaaataatacatctcttaagtcatatctacccagttcacattcagtatcctctcagttcagaatcagaagctgtcagaccaacaagtagaggttcctgcacaagcctgagagagatcctgtaacttgtgccttggaaaaacagccccacgaaagaatgccagacagatcttctcttagcaaacatggtgacttgagctctctgaatttgttcccttatgctacattgtttgttttttaatctctaaaaaaactaaaaaaaatttcaggtaaattttcttcctttttcattatggtttgaattagggtttttgataactttttttccaaattttagggatgttaaaggttcaggaaagtataaagaagaaaataaaaatttcccataatactgccccacaaataataattataaatattttgatgctttgcctatttgagttatttcatcatcattaaatgctcttttattaaaaatgactttaatggctaaatacaaatctgctgtaccagaacttatttaactattccctttattgtttgacaattatttcctctttcctatacttttaatgccatcatctttgcatgaaaaatcttttatttctatttgatatatgtgataggcattcttccatgcttattacaagggcttaataaaagttatttcaatttaaatgaacaaattatttctttttgatagattccaggaaaggaaattattgggtcttaagatatgaacaatttaaagcgcttgttatgtggtctgaaattgctttccaaaatttatgccattactatcaatctgcacgtaatttaaaaaggaaaacaggcaggaattatatgtttgggggagaaatgtaaaactgtattttaaatttgtttaatttagctctgatttcatatttgttgtagccgtaagatgaagattgagtcatttgatttcgtttaagggtgttttaaattccttggttttctgttctgagtctatgctttttctctctttaagtgtgttttcagtcatatatattttcctgctaacactgtatgtttctccttcctgtatgatttgtggtttcatgactgtcaatcattttttcccagatgttctttttcttagtgtctcatttatttcatgtgtgatgacggtgttgctcattatccagtgtctacacttctgtgtaatctcctaccctcaatttcatatctttgattattttagggtcagtaaaaatatatatatatatacacacacatatatatgtatatatgtgtatgtgtgtatatatatatatatatttatctgtgatttttatgtatttgctgtcttctcaccactgttatggtcaattttgagtaaaccttcaagggtgcttcacactaaagttcctttaattgtgtccatatgtccccacaattgtatgttattgccactagatttcttttctatatacacttacttgcagtaaatgcgtatagtcattctgtagcttgtagctcattcttcagtatactagacttctccaatatttacaagttatttgcagttcccattagcactattttattctaaggtagttggccattggcatgtaaattttaaagctaatatagcaaaaatcaaattatatacttggatttaattgttatttgtggaatctgattataatattatataatgcataatctccagactttttaacagtgactattaccgcacctgggcattttgttgttattgttgggtattcattgtatcttttgtagtaaacttgtagtttaagatgaatacgtatcttaatagtttcccttatgcaatttttttttttttgagacagcgtcttgctctgttgtccaggctggagtgcagtggcatgatctcagatcactgcaatctccgcctcccgggttcaagcgattcttctgcctcagcctcctgagtggctgggattacaggcgcccaccaccacgcccagctaatttttgtatttttttagagagggggtttaaccatgttggccaggctggtcttgaactcctgacctcatgatccacccgcctcagcctcccaaagtgctgggattacagctgcgagccactgcgtctggtctgcaaaaattttttagtgtatcttctaagcttttcactcttagttaaggaaatattatctttacatttaagttttaattctgagctcatttcttgcttctccccctgctttattctaagaatctctatcttctgttctcattttcttaaccttgtttattgttttcctttacaagtctgtggccttctacatgcccagcattcaactttgggccctgggatgaatgactaacccatggcccttacctcacttgagtggacacagaacttatcagaatggttgcactacaaggtgaaattattatttggggcctttgaaggaaaggctgggtttcagagaagagtggggaagaatgcatgggcaaaaagaacagcatgagagagggcaacggggttagtcctattggcaaagcttagcttgcctttaggagagttgaggggatacagctgaaccatgggctttgtgcgaggtcctatgaagacagagtttagactctgctctgtggtggtttcgtgcaggaaagtgacataaagaaggcccttttctggctcatagaaataagtttgaagggaaaaagtgagagaaggaaggagctctaagacttaattgttcattcatcaaatcgatcaatactacgtgcctgtcatgtgccagatactatgccaggggctctagggatagcagcaaaaagacatcatcatcctgctctttttttttttttttttgagacggagtctcgctctgtcgcccaggctggagtgcagtggtgcaatctcggctcactgcaagctccgcctcctgggttcacgccattctcctgcctcagcctcccaagtagctgggactacaggcgcccgccactacgcccggctaattttttgtattcttagtaaagacagggtttcaccgtgttagccaggatggtcttgatctcctgacctcgtgatccgcccgcttcggcctcccaaagtgctgcatcatcctgctcttatgcggcttaagctcccatgtatggtggtggtagcggcggctctatatgcagtatacacctcatggcacttaaattctagcattcagggactgtggtcagtgtgtaaacaaatgttcagtgccctagtcaattcctgtgtccttaaaggaatattccctttgtccttacaggttagcccagttgctcctgtgacccctctccccactttttttagaatccctattaaattttgaatttgcccattgatacagctggaagattcagggattctgtttgataaatccacttcgggacttgacatactggaagcagcactttgaaatgaccagacaagggaggtggcctgtggaactgcatagacaaagctcattctttggtcataacttgaaatcagttcacaacttctcaagtttgatacccaggggagacacaggccctagcacaattctgactgaggtgcagaaactgggagagctctttccaggaagcttccctttgtgttctgtctgtgtccacggcactaacaagtgatcttgttttccccctctcgccaggaatcttacatcctttctgcagaacttggagaaaagtgtgaagacataggcaagaagctattgtacttggaagatcaacttcacacagcaatccacagtcatgatgaagatctcattcatatccttttcatcttgcagatgaagcaaggcaaagttattttataaaagagagtctttaaagggtagtttttcatgcctcagaagatggcaacaaatagatgctgccgttatttatagcacagagcacctcagatctctgagattatcaggtatgaaatgttttcgctctagttttcagtaagcaattcagtattttttttcttttttcctttttttttttttttttttttgatgccttggctggagtgcaatggtgtgatctcagctcactgcagcctccacctcctgggttcaaacggttctcctgcctcagcctcctgagtagctgggattacaggtgcccgccagcacgcccagctaatttttttgtatttttagtagagagagggttttgccatgtttgccaggctggtctagaactcctgacctcaagtgatccgcccgccttggcctcccaaagtgctgggattacaggcttgggccaccgcatccggccgcaattcagtatttttaattgctaaatccaaccactaacaattaagttcagacatgcacacgaggaagccaaagaaaatgcagtttcaagtgagtgtaaatccagctctgtgtggccctggtgaaggaaaacagttgactggctcgttttcctacgagctttttcaataccaagcgtcctaaatccacctctgaatttctttatctagcaactctacctagtaatgggcagtacagtaacaaagcaaacaggactttagattatttcctttcaacttctaaccatatacacatggttgaactcaatttagtcctttctgcttcccggtgatagaatttcttgcaccagacttaatatccttggtgtcacacctacaaacaccttcatcaaaactagctgctagtgagcaagatggcctgagaacatactggcttaggtatgcatccgtatgaagcactccattctgtgttgatctgtggacgcagtttgtcactggttagttctgctgagagcaaatgggtgggtacccagtggatgaagggatatgcagccctatatcctttcagttatttaatcacaagttgacacttctctagctaaaaacacttccctattcattcatctttctattcagtagaatgtcttttattagatgcgtttgtggcaaatttagctattttggtctttgcttgtcattgctgtcttactttttagaattccagtttttaccatactttatgggctgtgtgtgtgtgtgtgtgtgtgtgtgtgtgtgtgtgtataagtagctttgaatggccaaggattaatcttagtcataaatactcagatctgtgatttaatgatagagccaatgctacacttccttccttgttataactttacatttttgaccttgtttattaagctgggcagaaaatttcttcaacttaatctgcaatgattttcacattgctttaggtagattttgaaaagcagatattctgttcttcataatttcctgcctcttaaaaatcttgtatttaagctattatcagaaagtttcccaaagaagcatacaaacatagaataaggatggcgtttttatttattccatgttcatgggatcacaaatctttgagcacgtgtaagggggtatggcttccagcaaatgggcaggtgatggggcacagaggaggagtccgctgcagagagtcaatggatatgaaggggttcccgttccccagctcagcagatgggcagttcctaagtgggttgtacctctgtcttcaggtagcagttctgagggctgcagtcagggttctgtgctggtctcttattgtgaaattttctaaaaggttagtttgattctggggaattggatcttatttttactagagctggggaggcagctctagtaaagacccctgaaaaacaaggggttaagcagtatttaaacaagatccttttagtttttccacagctgatccaagccagatttaatagcagcgggatcatggacaagtgataatgcctctttaagcattagggttcccatctgtaatgtcaggataacatacacctctaaggtttttatgggggttaaataaggctatattcataatgtacatttaatatagccatgggtaagtgcatgattttaggtagaaaagtgttatccaagtccatttgtctcacagttcttagtatattagtcacaagctccaagaacatcccatttatacacaaaaagtttcaaggtagattgattcaactattttgtaataaatgcttgaaggaatcaatcagtaactccacagtggcttagatgaaaagtcatttaattataataaaacttctataaatggatagggattattatccctacttgacagtcgaaaaaaacaaggcttgggaacaacttggctgacacaaggtcatttctgatgagtagcagaacttttcagccacaagccccatggtcctattaggcccatcagaaagcagccattgcctataagtaaatggacaggtctgttccatggaacacacaattactttaaatttttaagctataataaaagtatttcactgatgttatgttttttgagaatttcactgatctctgttgtgataagcggagaagcactggtttaggtactgaagtcagctctctccctccctccaataaaatctacaccacgatatggatttcaacccagacttttcttcgaatcccagtcttctgtcactgattgagaataaatacacagaaggtgtctttgaattcatacaaagcagcacttaaatttgagtggaacattatgccctaagatagaaagacatgtttacaaggctctacggaggctcccctacacaaaccaaagccgttgtttcaaattagagcttatctagagattcagagaggctgccagaatcctccagccaaactctgactggtttgtatttccatgtttgatcaaagatacaatgctgagtgtggctgaaagaaacagcttgttgtcaacaatacagaaggattgcacagtgagtgcagtgttttgtttgattccattaagcatgctgccagagcctactgtgcatgtgaggtacccaattaatctaagtccacattggaatgtgattaatgtaagcccacattggacgtccacgtctgaaagattcaagccacagatgctaccatggatgtttattctttgtgtggaaaacactcagtttttgcataaaccatgtgtgtacataagggctattagtgtggcatcaacagaggttaggggtgggcagtgggactgagtttccaaataggtccttgtggcctcctgatttaatatccgagttatgggcagcctcatgggtgtctcctacttttattaagaagacactgattgaccaatccaaggagggagaggaaagagcctttgcctcttcatcgtcctgacaggctcaccaaattacatgtagcatgaccaaagaacaacacaaacccatcagctactgtggcagcgagtgtctgaaaacagtctgcaccattaattgggagagctggtggtggagaggtggctcacgcctagtgcctgagaaggggacaggaggtgtgacttcacggccagtcaagtcgggacttccaggagcattagtgtgagtctctagtgcattttcacagtcatctggggtcctaattagcagtatgttttgaaaaacattttgactgtgtgcaaggtctcctccacgctcaaaatattgtaaccaaaagccttccaaattaaggtggatttttaagcaggaattttctcattttcttcctccttcaatttctacaacacactttcaaaggaaaagaagtacacctgtgatatgtacatttttggcatatttcaaagccctcagggcagttctgcctggccctcagtcatagacgaggtagagacactctgattctatttgtggttgtatttacatccatgtctgggaagcccttatggaattctgtttctctgcttatttggagtgcatggtgcccaattgtttagttttggtggtgcttgagggcatgctctaaatacatccaggtttgtgcacaaataccacagctccgtaggacccttgtttagttcaactttccaaattttagcgtgaacagacaaaggtaacgagagttttgggagactgtcctgcctccttggagatgttttccacttctagagctgaggggctggaagagggatcatgaggatcatggagctccactcatgtagtttatagataagaaaatccagagcctggccaggtgcggtggcttacatcttaatcccggcactttgggaggctgaggtggatggattgtttgagaccaggagtttgagaccagcctaggcaacatggcaaaaccctgtctctattaaaaatacaaaaattaactgggcgtgatggtgcacacctgtagtcccagctactccagaggcgtgagaattgcttgaacccaggaggtggaggtcgcagtgagctgagactgcacactactacactccagcctgggcaacaaagtaagacactgccaaagaaggagggagggaaggaaggaaggaaggagggagagaggagagagagagagagaacaggaaggaaggaagggagaaaggagagacagagagagaggaaggaaggaagggagaaagagagagagaaagagaggaaggaaggaaggagaaagaaagataaagaaagaaaaagaaagaaaagaggaaggaaggaaggagagagggaaggagagaaaaggaaaggaaaaggaaaagaggaaagaaaaggaaagggaagggagagggaaaggagaagggaaaggaagagaagggaagaagggaagggagaagagacaagggaaaggagaagggaaaagggaaaggagaagggaagggagaagggaagggagcaaaagggaaggaaagaaagaaaggaaaggaaaggaaagaaagaaaaggaaaggaaagaaagaaaacccagagcctaagatgacagtatctaaagctttgtgtgtgatgggctggtgcagatatagtagtcacagttctttccttaggctctcacttggctttggagtgggacggggaagagttggagccccacagtgggtgggggagggcaagggcgtagacacagggctgtcctgctgctggctgagcacgaggtgggcttggcacaaggtaggcaacacagagtttctgtgtacaagcatcaaatcctttgaatcaatcttgggtatagtcaaggttttcctctttgctcttgaaagactgtgatcctcatggcttttccatgaggatctccagtaccaaattctccagcactatgggctgtagtggctacccaggaaggaatggtggtaagaagaaataatgtagcaaaagagtagcactttcaaaggataagagagtcccttatctgaaatgcttgggactagaagtgttttgaagttctgctttttttcagattgtggaatatttgcattatacttaccagtggagcataccaaatccaaaaacccaaaatctgaaatgttccaatgagcatttcctttgaacatcacgtcagtgctcagaaggttttggattctggagcatttcagattttggatttggggatttgggatgctcaacttgttctattgtttctttttgaatcaaactaggtcagatgaaccgaagacctaaatttgactaagccattgaaatgcttacttggacacttcattaacagtaaaacactcaattgttttcttataaaaacagaagactccatctaaagaattccaggatcttttgcaaatggtaccccaaatgacaatattgccttatcatctattcctgaatgcacctgtcctgctgtcttactcctttgctaattgcaaacacagacattttaacaagttacatgcttacctaccatgtggatagtctattccaaggaggtacagaatggccttgggttccaaaggtgttttaaagatgttaggatgttcatccctgcgacgttgttataatgaatctgctaattttcttagataccacaggtacttggtggcatatctgttatggggggcagatacttagctactcaggtccctaaggcacaggcttcataagaattattctgcttttttgaggcctattcttgcaattaggtgcagttagcacctctattctagttttggaatttgcctaaattgtcaatagttttggaatttgcctaaaatttctatttgcctaaaattccaattgtttttcagctctttgacaacaattaaggtcaaggtcaagtgtttcaatgggcttcaactatgagcttattggattagtgatcagaaaatctgattatagctactacttagccttaagatcttgcttagatgtatcaaatgagatagtttatttttctgtaagtcagtgagaaaatgttgtaaaacacttttttttaatttatggttcaatatgaatgccagacttatatctgttttctactcagcatcttctcttggctaataagcttgtccaacttaccctgtctaaaatccaattccctccctcctctaccaaaaacaccaaacgctcattcctagtcctcttcttctcaataaaatacagatgtgtttttctaattatttgctcagataaaaaatcagggagtccttcttaatgccttttccattttccatatcccacatccagtctgtcaccatatatatgctcttggttgtatctgcaaaacacatccagaatctagccacctctcctacctccactgccactgccctgttcaagccatgattgtttcttgcctgaactattgcagtggtctcctaactggtcactctgtgcttccgcccttatcctctttaatccattctcagcacagcagccaaactgacgatgtcacccctctgctccaggtcctcccacggctcctcccatctcactgtgaacacagcacagctggacataactaccaacatggcgcctgtttactttctgctgcactcataggtatttatgccatctatgatggcagtgactttgattcactcctgtgctgctgtgtccataacatttgttaacacacagtagaaactcaggaaacatttgaatgtttgaatgagtgaaagaaagaggatctctctctgcactttcatttctcccaactgcttaacagggaaatgtttccagtggtttattttataaacatattgatttaaatatgaaagcaatgcatttccattgtgaatatcacagaagtatggaaaataaagctgtttccctcccagtgcctctacctagaggtcactactttgtcctcctgaagcctttttctagagctataaatggcttatctcaatagtcttgtttgcaaaattaggatcattccatataaattattctacaatatgctttcccccaccccattctgcatttttttttctggggacttttccatttcagtacatccaaaatgctttgtaactcacattttgtaagggatcctacaggcaggttggttagagagaagtactttgcaaataaaatgtgattttaattattattttgatgattattacccctacaggctcattaaatgaggtttctaggatttctggtgtctaaccctgctttgacagagcctaaggtatttgttacatctgttatattaagaaataaaccttaaatctcatgatgactcacaaaagacactatactctcacaaggaaaaaatatttctttgaaccctaaccctatgaggaaggtacaagattcagtattttacaagtagaataattaagcattgattgatttgctgagcttaccatagctagggagttatctcctcaaatgctggttttctgacaccttctgtgttagcgattgttgtatgagcggctgatgtgttaatttagttatagactaacttcatcctttgcttttgtaacttctcactccttatttttaaccttttcagtgggttctgccagttccagaagatttatcagtttttaaagaaacatcacattttggttcaagttctctctctaaaaacctttgtcatcatttagcacattacaaatagtggcatgtagtcccaggctgcatgtcaaaggtaattaaatctcaggagttggtcaggattcataaactgcttaagctccatgcctgctcttcacagatgtggcatgactttgtgattaaattccagtttggtattcagtctgggaccacttatgcttttgcttgtataaagtggtatatgttttcaataaagattagcggaactatgtaagaaatggaagcaaccaaagcctcttaaaaaaaaaaaagaaagaaaggtaaatattggattctttcctcccctgatcaccctcctacccaactcccattttcctcaagttcaaatgcaaggagagaaccctagcagtaaatgcatgtaaattacgcaaatgatagagtctggggaagcttcaagagggtgaaaaactgccagaacttttcagggtggttcagcacgtttgcttagaagagattcatttccatcattcccaggatcctctggagttccttgttcaaaaaagaaaggaggctgggcatggtggctcatgcctgtaatcccagcactttgggaggccaaggcaggcagactgcctgaggtcaggggttcaagaccaatgtggccaacatggtgaaaccccatttctactaaaaatacaaaaattagcatggtggcacacacctataatcccagctatttgggaggctgaggcaggagaatcacttgaatcccggagacggaggttgcagtgagccgagatcgcaccactgcactccagcctgggctacaagtgcaaaactctgtctcaaaaaaagaaaaaagaaagggaaagctttccacagtggttcgtaagggtgtctttttctctttttgttgcattgacattgcactttgggaaaaccacattgtagtgtaggtggtctgtaaacagtcagactccctttcccaaagctccccattccctccatgtctgatctagtactgttgtagtggtctggcttcatgtgatgacttcagcatatttaggtggtgtcaacatatttctactttctcccttggtccctgttggatgaaagtggatcaatttgcttgttaaacccaacgctcaccctgcatttgccttagagttgttctgactacaagtaaaaagggaaaggatgaactggatgacgtatggacagaaaaaccactgttggttaaacattcccctgcttgaacacccagacgagaacccgtttcttaagagaactacagccttatctattactgtttgctaagttctctatgattgttttctccatgtgagaaataactttataggttagaaaactaagagcccaacagcttaagaaaagaaaagaaccaaccaaccaacccagaaaaagcaagctctctttgccctttgatggactctatcaagtcttgagtgcccttcctagttcctgggaatatactaacagataacagcaggttagagcctggagaggtttcaaagtcatcatttcaagagaaaactgaggctttaactggtttgcatagggtgacaaggctggttaatggtgaacagagaccatgttaataactgagtctgctccagtatgcctctccctacttatggcaaccccaaatcctgtatttctcaaggagattttgatttcaagcattctaccctttccactgtcaagagtatttgcatctgacagttgccccaccccaacttggggcttagccggagttatggtcacgccaactgcatatcattgagcatctgagttgaccatctgtctctgctaagagctgactcttccatttcctttttaagacctgacttgagagagtcaatacctcaggcattgtagaaattgcggtcattctaaaatataaaagtgtaaagtttatattaatatttaattcatacaattggaaagaactttaaactgcaattaggtgtcagtacccatctgcttccagcaggctcacacgctcttcgatccctcggaggccgcagagggccacgatcaccttcgaatgtgctccttaacaatgtgcccacagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaattgcacgtgtttactttcagatatcagcaaatcagaaaatcatgaaatattctattcccagactcctagattaaggaaattgaaactaacattaccactagagttgggaacaagacaaagatacccacaataccactgaaaatattttactggagatgctggctaatttagttaggcaagaaaaatatagaagggttacaatttggaaaagaaaaaataaagctttaatattcacagatgatgttattgtaagctgaaaacccaaaagaatcaacagaaaaacgtttacacaattaacacaatcaaaatcaacaggcttcatatatgcagacaataattggaagactgagtataagaaaagaccccattttcaatagcaacaaaaagcaagagaaaatggctaagaatatatttatataagaaatgcataagccttagatgaaggaaattttaagatgaaggacatgagacaagaattgaatacatggaaagacacattaagcttttggataggaaggcatcataaatttaaaaatttccatcagtcaatttataaatatttcctgatcccaaatgggacaatagatgtctagttagcccccatatgcattctcccattcatccttttagccgttctgggtctagacacttaaactgcagaggtacatgtgtgcagaattgcaggtgtacatttgtagcattgtttgtaaggacaaaaatgagaacaaccgacattttcatttgcatcagttggagactggttaaataaattattgtacattcacactatggaatgctttacagttgctaaaaaaaaatctttgtgtacatatgtgcttgtctctgcagagctatcactggaaagggatccaggcgacttagtggaaaaaaaatgggaaggagacttacttttctgctctatactattcttttaaacatttggtaccgtgtgcatatatttacctattcaaaaataaaatcatttctttaagaaaaaagtcataattaatgagcctgagagtaggccctcaagtagggcagggcacacaggctgttgaatggttgcccaggtctccttgcggcttatgcaggattcatctgctatttatttacctactgtgtgcccagcactgtgctagggtatgcacctgatattggtgataaaaaggcaagtatgaactatgacataatgtgatcagatgattttaagttgagaaggaaattgatatggttaagctttgtgtccccacccaaatcttatcttgaattacaatcctcataacccccataatctccgtgtgtcaagggaaagaccaggtggaggtaattgattcatgggggcagtttccccagtgctgttctcatgatagtgagtgagttctgataacatttgatggttttataaggggctcttcccccttcactcagcacttctccttcctgccgccttttgaagaaggtgccttgcttcccctttgccttccgccattattgtaagtttcctgaggcctccccagccatgctgaactgtgattcatttaaaactctttcctttataaattacccagtctcaggcagttctttatggcagtatgaaaacggactaatacagaaatgaatgattatcattgaaacttttatcactttaaagacaagagattgattttgttctggccattttcttgaacaactacatctgggggtgtagtactgaaaattcagcactctctggaacccacgttctctcccttctgggttagggaataacatcaagtctccttcctttgagccctggatcaaagagacctgataggtgattgattgtgtgggcagaatggagacttgggaaatgga

SEQ ID NO: 12806 - DNA, 8280 bp, Human
ttagccgggcatggtggcgcattcctgtagtcacaggtaccttggaagctgaggtgggaggatcacttgtgcccaggaggttgaagctacagtgagctatgatcacgccactgcactccagcctgggtgacagagtgagatcctgtctcaaaaaaagaaaaagtaaaaaataaaataaaaaaaatatatgtatatgaaaaaaattggaaagttgctgacaatcattcatacaatgttagacctaaaggtgaccttagagacctgtatggtgataagaaatagagcaccagaggcagggagccattgggttggctccaggctgctgcaggattcctgcctccatcaaaggtggtgcttagaccagatttttttttttttttgacagggttttgctctgttgcccaggctggagtgcagtggcaggatcttggtttgctgcaaccttgacctcccaggctcaggtgatcctcccacctcagcctcccgagtagctgggacagcaggtgcgcaccactgtgcccagctaatttttgtgttttttgtagagactggattttgccacgttgcccagggtggcctcaaactcctgagctcaagcaatccacctgccttggcttcccaaagtgctaggactacaggcgtgagccactgcacctggccagactaaatgattttaaggcctaagattctgatgctgtgatttcatagaattgccctaattggaataggaaagtggggctggggaggggagaaggagggtatggggaagagaagtagagcaaggtcactttatgtagttccaaataaggaatcatacccttaccttcttctaggtggaaagcggcatcctgcattctcttcttgtccttggcctcatctctgctatgggctgtgccacctctatatgctctttctcaccaccaggccttcagaatgcagttggaaatgtgccctctcgtctgggtgtggtggctcatgcctgtcatcccagcactttgggaggccaaggtgggcagatcacctgaggtcaggagttcgaaaccagcctggctaacatggtgaaaccctgtctctactaaagatacaaaaattaaccaggtgtggtggcacgcacctgtaatcccagctactcgggaggctgaggcaggagaatcacttgaacccaggaggcagaggttgcagtgagctgagactgcgccactacactccagcctgggtgacagagtgagactgtctcaaaaaaaaaaagaaaagaaaagaaaagaaatgtgccctctctagtgtgcctcccaggtcactcagctgatggaaaatggaatcctactaacgtgcagggctctagaaattcagcagcgtttcatacatggcatctgccatcaaggaagtcacaggaaggtgggaggcagacacagatatccacaatataaagtttagccaagttcttttttgcaagcctaatcataggtgaggggatgcaccccagagccaccaatccggccccttccgcccctgggggaagcattaatgacgccgaaatgtgtcagagctcccaccagccccctcttcactgctactctttcttcccaggcaaaacaggaaccacaaaccccagcttcctcttgcagagtggctgtggcttgtaggggaggcagaaatggctgaggtgcggatacgagacctgagtcacttgagctgctgttgccacatgtcccctccctctccccctccccagttctaaggtctcctgctcccactttgtcctttctggcctcttgcttgtcctttatttccaaatgtgcacctgagtcccctgtgtgatgtacacccatttcccgggctgcagtgggggctactgtgggcatcaggggccgtgggcagggcctggggtggggacgcatcagggagacaggggaagaggaagtgcctttggtcctggggaaggttggcttgtcttggtgggtggggacggtcattatcagctttctggacacacagacagagacagacaggatggacttcctccggctatacctccctgggctgcaccaggccttgaggggggcactggtgagaagggcagacagctgccagatacttgcaccccattccctggggcctcacttccgggcacctcccctggggcctcacctttcccctcctccttctgatctcctcaaactggagattgctttctcaggttcaggcagactcctggcctaatattttctgaatttcagtccccacctccaaccatgcgtcctcgtacccctaatcgatgccccttctggctccttctgcaaatcctcttcttctcctttcagatcccagtaccctcttccttaacctgggctcctccagccagggcccccagggaaagggctgggactctcctcaatgactctcccctctctctctcttttttcctaggattccctcggcacctttgtctcctacctcctgggagatgcagtccccactgtagagcgggaggcgcaggcggctgaggaactgggggtggtggcggtgggaaagacagggaagattgtagaggaggaagcccaggaggacctggagggccttagaggcagccaaaacgagggggctggaaggctgagagggcctggagatgacagaagacatgaagtggggagctcagctgtagaacagacctggggctggggagatggcagctcccatgggtcccaagcagagaggcaggacagtggggctggggagacagccaaggctgccaggtgccaggagccaagcgcccacttggaggccagaaagaaatccaaggcagggtctggggcttgccaagacaggagcggccaagcccaggagaggcaggagtcccatgagcaggaagtgaacagagaagagaggctgagaagctgggaacaggaggaggaggaggaagaggtcagggcaagagagccagggatggccagaggggcggagtcagagtggacctggcatggggagacggaggggaaggctggtgctgttgggccaaaggcggcaggggacaaccgggagatggagcagggggtcagggaggcagatgcaggggaaactgaggagcctggggccgaaggggctgggaaaggagaagaggtggtagtggtggagaaggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatagcctcaggcggggaggctgggacagcctcaggaggggaggaggccgggacagcctcaggaggggaggaggccgggacagcctcaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacagccccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtggcctcacacacagcgtcaccaaaggccaaggacctgagctgatggggggcgcccagaccccaactaagcaacccgaggaaagggaggcaggggaggtggagctcatgggagttctggccctgagcaaagaggagcaggagaggagcctggaggcaggtcccaggcacgcggggtctgtaaagcctgaggcctccgaggccttcccaggagcctgggaaaaccgcacgagaaaggacatggagagaggaaatactcaggaggatgcggccgatggcgagcagcgggaggaggaggagactgcgggaggccagaccctggcggctgaggctgaaggagaccgagagtctgaactatcagaagtcccagaggcaggcggggaggggctgacaacccaggacgcgggatgtggaactgaggagggagaggcatctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggcgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggtgagggctcttggtggggtctcggggggaacgagtggaatcccgaagccggccccatggtcctctgtgccccctttcctgcaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtaggcacagggcaactcagctggggtggggaagagaccgcgggcacctgggaacctgttctcacgggcctgacttccgcctccaggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacctaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaacagcgaccattttccttacaggccttcctctctaactcccacttcccagcccaactccctgcaccaagaccctcagaactgggcggggataacacaaacctctggagctgcatccaggccaaaggaaggcggttgggagggcttaaggagcactgttcagaatcagagatgagctgccttgagcttccaacacggtagctcggcctcaggatgctgctggttactatggcaactgcctgccggagcaggacatagtaggggaaggtgggccagagaccccaaaaatgtaggagcagagaggggttcaggatggctagaggttgctgaccccgttccaggctgccctgccctctgggtgtcagacagcccttacccgaagagaagcggaggccaggggtggatgagagtgctttattgggcacccagcatgggggcttggcccgaggaggaccatcgggccccaagacaataaataaaccatcatctccctaaacaataaataaatatccaagaaataaatagctggcgaggaccagaggggctttcagttactgggtagagcctggggcagggggctggaagagccctcccttgtccaaggctgatgatgcgaaggctgccctgatgccaagactccagtcctaaagttctaaagggtggggggcagggggctaagaagccaccgatcagggctgggggctcaatgttgggaaccccaagggccagactgagtgcccagccttggacagcagcagcaactcccgcacggcccgagataagacgagctccaaggagtgcagcaggcggtaggtggagaggagctggggccaggacacctgggccgggccctgtaaggcgctgcccagtgcccctgggagcagccccttcctctcctcctcctcctcctcctcttcctcctcctcctcctccgggaggttgaatcctgcagccagcacctgtgaggagaggccatgggtcagggaggggccaggccgagaacctgagaggaatcctcattccctattcatgcccagcggttcccaatgacatcagtgaccacaaggtcatgatttccccggacattccctgcttgatcttccatgatgtcacctgctaacgcgtctcacctgatctttcagttcgagaaaatggaagtcaaggagcaagaggatgctcacagagctagatcaccccaaggactgccccgaggcgtggggttcaggaagtttctctctgctgtgaaagttgcttttgggtcgggtcagcaacaggcagagggtgacatagctcagattccctgctgcttgccattcctctctctctctctttcttgggagccccgctctgtcgcccaggctggagtgcagtggggtgatcacggctcactgcaacctctgtctccccagttcaagcaattctcctacctcagcctcctgagtagctgggactacagacgcgcaccaccacgcccgactaatttttgtatttttagtagagatggggttttaccatgttggccaggctggtctcgaactcctgacctcaaatgatccacccgctttggcctcctaaagtgctgggattccaggcgtgagccaccacgcccagccctgctgcttgcattttctattctcatttcattaagtgtaaaattctgatttccctttgaaaggttctggaggatctgggtgacatcagagaatcagagggagaaaggaaacaggaggcagacgctgtgctgggcactcaggacacaccccgagtgacctcacagcccaatggcctcctgttgaagatagagccccaggagaatgtgaagattgaggggcagcaccagggcctggtgtggctgtgtgtgcgcctgcacacacgcacacactcacacacatactcattctcacaacgcacccacactcattcccatacagtcacattcacacaaaacacattcatggctgggcacagtggctcacgcctgtaatcccag

SEQ ID NO: 12807 - DNA, 23015 bp, Human
cctccgcaccctggttgtctcaaagcctgtgtgccgaacaacaccaagctcacagcagggcctgccctggcacacaactgaaaagccagcacagcccagagcctggcccacagcacagaatcagatactcacggaatgaacgcatgttagtgaatggctgcctgctcgctcgtctcagagggactagccctctattttgccctgcagagccaaccaggtggcctttctaaaaccaaaaatggatgaccatttaagcctgtaccattgttcctcagcaccatgggacaaagttcacaatcttgagcttgcagacgaggctgttttcatctgggcttccgcagcaaggcgggtacttgtgtccttgaaaataattctcactgcactcatcctcactccaggagtacccatcagccagcacccatgtgtggttcacctttgcacccagcaggtatttgctgaacaggaagatgactattagagctgaaaatgttctcaagggccacagggcccaaagcaactcagagaggtggaatgaggggctcagggtggcccagtcccaggcaggggtgcggccacaacctcaactgagttccttggtcaggaaacagagcaattctctgaaaatgctacctgcaactccacacgtatgcatgccagagcccaaacccctggctgatccccagtccatgcaagccttaatcaagctggcaggtgggccaggcctggcacacaagtagggcctcagctaaaacagctgcttgacttagtacagcctctcaccagctgacaacacacccctaagttccatacccctctctaggcctccgtcttctcatctgtagaatggagctaattctgcctacaagtttaaatggccctgagttggtcaccacaaccctgtcgtttgcaaaccgagggggctgaagcagcagttccagcctctgtgactccactgttagcccagctgatttttgtgaactttcccccaaacccactgtgtctcaaaggatggtccctgggccacccacccacgaattacgggggcgtgggtggaggctcgttaaatgcagatcccgggcctgacccggacctgccgtctggatctcattttaggcggcgctagagatcccgggccagggaaacttgagaaccgcagctccaaatcgccagtgctgacggcttccgctttgggagccccaggtgttgctgtccgaactcacttggtggaaacagacatttaccagaaagcctggggtcgggcagcgggcactcctaccgctctaaccccgcgtagctgaaagaattcgctccctcaaaggagtcagtgagcttcggcagtctgcgttccacccgtttcgcttcgcgcggcggggcgattgtgtaaagcgggcccgggtctcggcgtccagcccggccccaaacctccggcccccaggcctctccgggctagcggccgggcggcgctgctgcggggtggtcggggcgcctccgcggctactcacccggggcgactcggccgagagcccgacagtcgggaccggagcgggaggagcgggtggccgcggcccggcccctgccccgcggcactttaaccggcggcgccggcgccccgcgcgctctctgcgtccggaatggggacgcagcagttccgacccggtcggccccggagccgcgaggctagctgggctccagcggaggcgcgcgaagcccgagggcgggtgcagctgatgcacctggctcactgcatgcacgtgtgcgcgggggtaggcgcgcgccgcggcggcccgtgctccgccagcgctcggacacggcccatccctccgagccccagcaggcgagggcgctgcgacctgccccagcctgggagggggccagcgggcccgccctctgttcgggtggcgggaatgggtcggcgctgcgagaggcggagccgagaaggggcggcccggcggcgccgggataaaagcgcagcgtgcgggtggcctggatcccgcgcagtggcccggcgatgtcgctcgtgctgctaagcctggccgcgctgtgcaggagcgccgtaccccgagagccggtaagcccccgccagcacctcttccctcatctcccggccctcgagcccagatcctgacgtcgtctgatccgccagtccaggctgccccgaaggcgtgcgcggactgccggctcgaggggcatgcctgcaccctcagggcagccccggacatcggcgtcaggttgcttgagtcaggggcgtgggaatcagacagacccggtctcagatgccaccctgtactgttggttctgtcatttatgctcaccaagttccaagtcccgaacggtaaaacgaagggcagtaccgaacccaccagggtctcttaaggtataacgacatggcctgcaattagcggcgaagggcctggcacgtagttattgttacttggggtctgctcacctgttggggcacaagaactgtttctccattagtaccccctccctttttggccatattgattgccatgttcactcgtgaaggcagttgcctttcttccccagtaccctgaatgatcgagggaatcttctgggtcactgaagagaaaatagctcatcccccaaataacctttgaaatgataccgctgccctcttagaatagcatatagcatcaagctccgtagtcacctgctggtggacaaaccccattcactgtttcctgatgtcttcagctcctatccttcccctctgtgtcagttcagaagccctcttggctctttgcactaaagggaagaattcatcccttttgctgtagttgctgcaaggccaacaatttgagcttggtagcatttagggttgttgcttggcctctcaccggccatttgataagaactcagctcctggtatgatggctcatttgttaaaaaaaaaaaaaaaagtcaagtctggccgggctcggtggctcacgcctgtaatcccagcactttgggaggctgaggcggccggattgcctgaggtcaggagtttgggaacagcctggctaacatggtgaaaccccgtctctactaaaaatacaaaaagtagccgggcatggtggcaggcgcctgtaatcccagctactccggaggctgaggcaggagaatcacttgaacccgggagccagaggttgcagtgagccgagatctgcgccactgtactccagcctgggtgacaaagtgagactctgtctcagaaaaaggaaaaaaaaaatctgatgatatcccttagagttcattttttaaaagacaaataaatgattgacaattttgcccaaactcaaatcattcaaaccatcaaaaggagatcttagaaggtgtttggaaatgtggatgctcagcagcatattccagagctgctggacgtatcacattgagtcttgtcatttgagcttgctgctgcctaaagccccaatattttaggttcagtattttattccagaaccaaagcacaaattattttttcttatgaaaaaacacgagcagctaacttcaaacgatttagtaccagcctttcttgaacactaataattgcttatggtttcgtgaattgctcagtgagtccttttgtgttagaaggggaacattttaaagaacctgaggaaagtaccatggactgcattcagagctttcttttgtttatctccttagcatagctactccttaacctggggtagcccagtaaatactctaggccgtcctaaaaacctagagttaaacattagagtgtgaaggggcctcacatcggtcccaagtcatcccctgcttgcagcagggaaggatgacatccagagacagatggagacccacctgtggtcttcaagtgaggttatgcactggcttgaggatcaggtatactgatggctaatccatggtccgtcatagcctacagtgggacagcttagttcccccctaagctgtgaagcagaaccagttcatcttttctttgaaagtttgtcacttgtatatgcatttaaggggaaaatggtgttctgcctaatttggcaaaggaaagcttgtggtttgccggcttcaacatgacgcttggtttttttctctcccacagaccgttcaatgtggctctgaaactggtaggtgcattagagaatgggtatttggggctttacattgaaagcacagttggacttttaggaagcctaatataggcaataggtcatcgaagaccagacacagggtgacccattgctttattggctgatgcagatgaagtctctgtctgctcgaagcagaactctggggctctgtgggaatgaggccgtgtttcagacaggctagcctcttggccagtcaagatgggacttgccatacaaggtggaaagtgatgcctgccactctgcagagggagatcaaggccgtggaaggaaggtcacttagagttgggaccgagaagcaaatgtttcataggagagcgggtgtttgagatggtggcatttgaagaatgggtaggcttctgcccaaaaaatgtgggtaggaagagtgagctggaggagagatggcaccagcaaaggttaggaggtgggaaagtgggggctgtgtgggccagctggctggaatccagggccgaagcctgaggaaggcaggcctgactctaataaacatgtcaaatacactaaatatatacatgtgtacatacacaggcacctggagtggtcccacgtgctctgtaggtgaaagccaggaggttgagagtacttctgttagatcaaaattatctgggctataaatcagccagcgctaagaaacatttggccttagcaggaagaactgaggaattgggtcaggcgtggtggcttatacctataatccaagcactttgggaggctgaggtgggaggatcatttgaggccaggagtttgagatcatcttaggcaacagagtgagaccccatctctacaaaaaacaatttttttaattaaaaaaaaaaagaagtgaggaattgtgaatgggggaaggtttggtgtgagtcactgagaggagatggcatggcatcagactgggctgggaaagacagtgtcatggaagtcttgctttttcccagggccatctccagagtggatgctacaacatgatctaatcccgggagacttgagggacctccgagtagaacctgttacaactagtgttgcaacaggggactattcaattttgatgaatgtaagctgggtactccgggcagatggtaagtttgcatccatcagagataaggcccaaagtgtctactaaatcagaaatgtgcagactatatgaaccattaattccccttctatgcataaccaacagaaatacatgcatacacgcaccaaaagccacatactagggtgatcgcagtagcactacttacaacaggcaacattagaaagcactcaaatgcccaacagtagaaaggaatcaccagataaattccgtcacagcaacaagaatgaatgatctgtaactacgtacaacaatatggatgaatgtcacaaacataaggcagattcaaaagagtttgtacatttatatctgtgtgcatgcctgcaggcatacatgccatatgatcccatttacagaaagtgccaagcaaacaaaaccaatgtagtgtttagaagtcaggatagtagccaggagcggtggctaacgcctgtaatcccagcactttgggaggccgaggtgggtggatcacttgaggccaggagttcgagaccagcctggccaacatggcaaaaccccatctctactaagaatacaaaaattagccagatgtggtgttgcacacctgtaatcccagctactcgggaggctgaggcacgagaatcgcttgaacccaggaggcggagcttgcagtgagctgtgatcgcaccactgcactccagcagcctgggcaacagagtgaaactccgtctcaaaaaaaaaaaaaaaagcaaaagaccaggcgtggtggctcatgcctgtaatcccagcactttgggaggccaaggcgggtagattacttgaggtcaggagttcaagaccagcctggccaacatggtgaaactccatctctcctaaaaatacaaaaaattagccaggcatggtggcacatgcctgtaatcccagctacttgggaggctgaggcaggagaataacttgaacccaggaggtggaggttgcagtgagttgagactgtgccattgcactcctgcctgggtgacagagagactgtctcaaaataaaataaaataaaataaaataaaagtcagggtagtggttcctgctggggtaggaataactgtaaggaagtatgaggagcacacctgagggagtttcttaacctgcatactggttgcatgagtgtcccgatgcatcaagtggtacacttatgtgtgtacttttctgtgtatgtacttcatggaagaagataaggtaaggcgagagatgattttccccaccccacttcagtttagggaaagcactggcttagatagattacttttccacttcccagatgacgtcacgaagcttttggcatttccccaagattgtgctgcaaggcaccatatgagttctttcagtgagctactcctgggatcctaatgcccatccttttggtttccatctgctaaattcagatcggaaaaaagtctacctggtcaagaatccatgagtgccaggcacagagagaggagtcacctacagtctccacccaggaggattcagaggggtaggggaggcagacacaggcacaatgtcaggggagtcccagaagggagctgtgcttcatctgagtgggatagggcgagaggagctggaaagggtctctggtgaggttgctttaggtgagatgtggccataagggtttgggcccttacctggcacagagtgagctctttgtcagctgtggttatgggctgtggtgcatgagtgagttgggctttaaaagagtgaaacttgaagaggtagataatgggaggaaaggaccttcagggagaagaatcagcatggataaaggtgcaatcggaacaggtgtggtttggtgatgacagtcttggagggtctttgtgggtctccctgaggccagcctcttcctcttaaaagagacccagaatagtgcagagctatagccacctttgcaggcatcctatgaaattcaagctgacctatgaggaggagggagcttgggctttggaatctgaattcgtatctgctacttgctgatgagttttctaagtttaagcagagctccctgaaacttcctaagcctcacgaaccccatctgtaaactggagacagtggtgcctacctttcagtactattgtgaatatgaaccgagacataaaataaagcatgctagtaaagcatctagcatcaagtcagccacacagcaagtgctaaataaaccaatgtcctcttgcctatctcggcagccagcatccgcttgttgaaggccaccaagatttgtgtgacgggcaaaagcaacttccagtcctacagctgtgtgaggtgcaattacacagaggccttccagactcagaccagaccctctggtggtaaagtaagcacttttttgttttttgttttgttttttgagatagcatcttgttctgtcacccaggctggagtgcagtggtgcgatcatggctcactgcgacctcaatcttctgggctcaagcgatcgttctacttcagcctcccaagcagctgggactacaggcatgagccaccagacctggctaatttttgtagtttttgtagaggggggtttcaccgtgttgctggtcttgaattccagtgctcaagcgatctgcctgcctcagcttcccaaagtgctgggattacaggtatgagccactgtatccgggcatagacacttttatgtatttggctaattgttgctgaaagctatgccctttgtttggggagcatggatgatgtgctgctcacacgggctggtaaatagctatgactcagagcttagagcaagatcccttggttcaaatcccattttcggctacttctctgttttgtgccttttgtaagtcagcatctctgggcctcagtttttccctaccagccaatggaagagaattggacttaaattatatcctggctttaaaactttatacttctctgattctgtaaattgtttagtgcccattccctaagtagacattggttggagacctaagttttcacagagtgagtaatgaaatacaaactaaaagggcaacacactaaggtatactgtttctgtactgcagtgttttgggaattgagagttccttgctttgcctttcagtggacattttcctacatcggcttccctgtagagctgaacacagtctatttcattggggcccataatattcctaatgcaaatatgaatgaagatggcccttccatgtctgtgaatttcacctcaccaggtaaacttcctcatttgtttattattctttgtcttgctgggatgcctgctttgcgatatgcacagagagagcccagggaaccctggataaggcttttggccttgctaaatctcagttcccttatctaaagcatggacacagtagtaaccatactttacccacagagcagagagaataaagtcaggtaaaatgtaggaaaaagtctgttcctgtatgccaggcactgtgctgaatacttgatatgcatcatctcacttaagcatctcagcaaccccaaggttgggatagctgcattttacagatgaagaaactgagaggttaagtcactttccctgggttatacacacataaaagtgaagctgacattcacactttggtccttctagagcaatgcacctgagccactctttatatcactgatgcaaaatgtttgttcgttcctatctcagctttctagagtgggctgcatatggctgggcctctgagaatctacagactccagttggcttgtccccaagctgtccatgagaggcagggtggtcctgagttggatgctgggcccttgccccagctttgtgacacaggaccagttctctggtaccacagctgcaatgtcacacacagggctgtgatgaggatgagacaggatggtgtgtgtgaagggtctatctgagccgagtcacccatcccataccaccatcctgtcatctgtcacaggcaaggcatcaaagccaaacggtaatttccaattcactgctggtcttggagattgtggtccagggtgtttttggtgctgcaccatttactacacgtggtttccaactttcttgatgagagcaaacctcattttgttttcaaataagcttttttattttggaattcttttattttattatttatttatttatttattttttagacggggttttgctcttgttgccctggctggagtgcagtggcaccatctcagctcactgcaacctccgcctcttggatttaagtgattctcctgcctcagcctcccaagaagctaggattacagtcatgagccaccacacccagctaatttttgtatttttagtagagacggggtttcactatgatggctaggctagtctcaaactcctaacctcgggtgatctgcctaccttggcctcccaaagtgctgggattacaggagtgagccaccgtacccagccttattttggaataattttagatttacagaaaagttgcaaagatagtacagtttccatatacctctcacccagcttctcctattaacgtcttgtattaccatgatacatttgtcaaaactaagaaaccaacattagtacgtgtctgttaactaaactccagactttatttggacttcacctgctttttcatgaatgtcctctttctgttccagttgcatttagtccctgtgtgtctctcctctggtctgtaacagtttcttagtctttgtttttcagaacgttgacagtcttgagttctgaccaggcatcctgtagaatgtcccccagtgtgggtttgtctgatgtttgtctcatgattagacagggaattcataccacagaggtgccgggcccttcttatcccatcaggggtccatggcacccacatgacaccaggctgggggtcaccatcaacactagattaatgtggggactgccagacttctccatgtaaatctactgtttttcccaactctcgtttttggaaacaagtcactaattctaccccaccctggggtgaggataggggagtgttaggcttcatgtccttgaaggggcagcatctacagatattaccaaatgtccttttcaaatgatggatggttttcgagtcctctcttagggatcaaagatactgttttgataaaggctgtatttaaattagactctggttatcacgtaatgggcagatgttctctgtttagcagtaaaatgttagagccccacaaaaaattagccgggcgtggtggcgggcgcctgtagtcccagctactcaggagcctgaggcaggagaatggcgtgaacctgggtggcagagctagcagtgagctgagattgcgccactgcactccagcctaggcgacagagcaagactccggctcaaaaaaaaaaaaaaaaaaaaaaaaattagagccccatttgaatttgccatcttacatctggaatgttttggcaatttgttacaggtgtggtatgcgtatgtgtgtgtgcacttggcaaagggggtggggcagagatacctttttctaaaatgtaaaaactttcattcaaatttccaggctgcctagaccacataatgaaatataaaaaaaagtgtgtcaaggccggtaagtaaatacggcatttgcttttattatttgaagaaacttgtaacttgaggcagcatagctctcttcatctttgcacagaagaactgagccctaggggagagttgaatatccaagcacccccgatggtggtggcagaagcacctatggctcctgatctccagccagtactttgcccactgagtgcagcagcctgtccagaaaggggtagaccctcagtacatttatatagtggagcaacagtcacaaagaaccacccccatccacttggttaacaacattttagcccaaatggctcagcagtgccaatcaaaggctcttcctgattgatgggagtcctacgagcccttccacctgctcagatgctagcaccacccacctgtggccatggggatcctaagaaccttctgtttggattagcaaacattcgaggtgggagtgtgagttcgctaaaggactggcccacaattacgctctcaatttgtgtcctcaaagaggatcacttttcacaggctagtgaattttaccccttgaattttgtagtaatcccctttaggattattagtccctagtgcccagtttccaagggtttgtgtaaatttctgagtaatatagtgttggaatgctaatgaggctagtggtatttggatcagcccagaactcttaggcacccttcactgcacaaggcatccctggtaccctttcagacagccgtccatgctgtccttgctagaaggcagatttggacgctgagcttcccaccaagggtacagagaacactgcaggtgtgaggaggtcagagggccttgaagtcagtcctgaacctgaactcctaaagacagttctgagccagggcctcaaatggtctcctcggtggagaagataatttctgctgttatacattgttgttcctggaaatcagtccagtccttatttgcaagtcacatgaatgaaacgactgactttttctgccagagcagacctatcagggtatatcctctaagctacgagccatttccttctttctttgcatctagtgaagctggcagaatggtctgatggatgaagctcctggaacacaaaatattctagtggttgtagtcctgattgtgagttcacttgctctataatcttagacatgttttccaacctgtagctctttctccccatcctgggaagtagaaaatactgaccctatcccttaactcaaaagagaggttgaaaacagcagtgagtagcagaaccaatccgtgcctcccaccatactcagcccagggaagctgtttttagcaaagcagcgatgtacggatccccaaactgtcttgggcagcaagtactttgagactttggaaacaatgataaaaagttcactatgtagcagcgtccctatctcttggacattgttcctgagaacttgggtttgtttccataaagccctgtggggaacttaaatgagggaagagttagcaagttcatctacatggttctctctcaactcacaggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgaggtactttttctcttcgtccccttcacctcgtcctccagctttccttagtgtgttgaaggaaaatggggacagtgttgtccaaacgtgctgggctactttgatgaattcagcagataaaaacaagtccctgtgggcatcctgagaggtgtcactgtgaacctcaaaccatagaaagaaggaagtctccgaagcaggaaatgagcccttctttacacatggtctagtgaaaggagtccttttgggaagcaaagctgctttgctggaagcctcgaaatctgctcactcctgtgcctcataatttttggggggcggaggttgacacagggtctcactctgtcatccaggctggaatgcagtggcacaatcacagcttagtgcagcctccacctcccgggctcaagtgatcctcccacctcagcctccccagatagctgggattacaggcatgtgccaccatgccgagctaattttttcatctttagtagagacggtttcgccatgttgcccaggctggtctcaaaatactgggctcaagccatctgcctgccttggcctcccaaagtgttgggattacaggggtgagccagtgcacctggcacctcataattcttgactctctctctcttaagccacaccagaagaaacaaacgcgagcttcagtggtgattccagtgactggggatagtgaaggtgctacggtgcaggtaaagttcagtgagctgctctggggagggaagggacatagaagactgttccatcattcattgcttttaaggatgagttctctcttgtcaaatgcacttctgccagcagacaccagttaagtggcgttcatgggggctctttcgctgcagcctccaccgtgctgaggtcaggaggccgacgtggcagttgtggtcccttttgcttgtattaatggctgctgaccttccaaagcactttttattttcattttctgtcacagacactcagggatagcagtaccattttacttccgcaagcctttaactgcaagatgaagctgcaaagggtttgaaatgggaaggtttgagttccaggcagcgtatgaactctggagaggggctgccagtcctctctgggccgcagcggacccagctggaacacaggaagttggagcagtaggtgctccttcacctctcagtatgtctctttcaactctagtttttgaggtggggacacaggaggtccagtgggacacagccactccccaaagagtaaggagcttccatgcttcattccctggcataaaaagtgctcaaacacaccagagggggcaggcaccagccagggtatgatggctactacccttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagtttaggttcagaccccgggagtcttgggcacgtgggtctcgggtcactggttttgactttagggctttgttacagatgtgtgaccaaggggaaaatgtgcatgacaacactagaggtatgggcgaagccagaaagaagggaagttttggctgaagtaggagtcttggtgagattttgctctgatgcatggtgtgaactttctgagcctcttgtttttcctcagctgactccatattttcctacttgtggcagcgactgcatccgacataaaggaacagttgtgctctgcccacaaacaggcgtccctttccctctggataacagtaagtgcccagtaacttcaaccagatgatcaaagtggctcacacacagtcactgccccccactcagtatgtggaagggttgtgtgtatgtgggcagtgcaaggggtcgctgcctgtgtacactgaactggggtgcagagaaagccaacagtgctgtcccagagaacctagaatctgagtaagaacaggctttatttgtaaaaccactcgtgactctttacaaagcaggatacacagaagggaaaaaaatacacagtgcaaaatggatgttctgagtgccacaaggatctgctgaaaaaagccaaagatgtaagatggctgggtatatatgagaatgaatatttcactatattctgattcaattaccagtctcagtggcccaggatgagcttttggtgtggtcacatggccaacatttggataacaaatgaggaataatggtaccgcctcactagtgcctgagaacagcatgttctggaaaatgtctctggagttagagatgtgttagctttttcattacagatggagaaatacaatgtttacacaacagtccaggggtggggtcaaaagttggaaggtgtcattagacgcagccaaataaagtgaagacaacccaggtgactggcagccctgacttgtgcgtgggcgaagccttacagattcctgggcactctgtgcctgagcttacctgatgttcttgtgaggcgggtggcactatcctccatgtatgtcagtctaacaagacggcctgtaaaaatgtcatctatatgtgctatgtatgtaagcagttgtacccagaataacattaattccttaaagaaccaaaaaaactggacagaaaccctagttcctactgtgaaaatgccggtgcatatcaggacaaagaagccaaagagattttaggactgttcttaacttcctgggtcccatatcccttttgagaatctaatgcaagacctgcacactctagggaaaaagatatgattggcagactctctaaagagcttctgactgatggttttaaagggatctaaatctctacaaagtggctgggcgcggtgacacatgcctgtaatcccagctactcaggaggctgaggcagcattgcttgaacccgggagacggaggctgcagtgaaccgagattgcgccactgcactccagcctaggcaacaaagcgagactctgtctcaaaactaaaaaataataaaaaataaataaacctctataaagtataccaagtcttagtttttaaattaagagataagtgtggatttgttttccaaaggtgaataagctttgttttttccagacaaaagcaagccgggaggctggctgcctctcctcctgctgtctctgctggtggccacatgggtgctggtggcagggatctatctaatgtggaggcacggtaagggttataattctttaaagacatcctagtaaggaaataacattttgaatttttttttaaagaagattcctctggaggcaatcacatgttggcgtttcccagagttagatagcatttatgtaataccttcaagtgctcctacagagactgatatgagcatgactggattacacatgccaggtgaaagcagggtcaggacttccagatcttctgactgtcccgtttttatttttaccattgagccttctaccagtactgaaatgggcaaaagatggctgataacaaattacactttacctgtgatggttactctatgctagttcctgttttttaaaaaatagttcttatgaggtgttaagaaaagctttcgcttggattcatacacagttgacccttgaacaacacaggtttggactgcgcagagccacttacacctggattttttcaatacatatattggaaaattttttggagatttgtatcactttgaaaaaacttagatgaaactcggatgaacttttcaattaaaatattgaaaaaaatgaagaaaaaggtatgtcataaatgcagaaaatgtatacagatactagtctactttatcatttcctaccataccaatagttaactattttaactattaaaagttaaaaatttatcaaaacttaaacacacacataccaactgtacatggcaccattcacagttgagagaaacgtgagcataaagatgtggtattaaatcataactgcatacaattaattgcagtgcgtactgtcctgctgtgaataatttcctagccacctcctgttgctactgtggtgagctcaagggttgcaagtatcgacttaaaacaccctgtgatgctaaccatctccaaacgagcagttcctgtctccagtaaattacatatcacagtaaaaagtatctccagtggttctctggtatttttcgtgtttagtgcaatatcgtaaaccttcaataacaccttaggacccatacgaagtgccactagtaatgctggcagtgctcccaagaagcagtgtcatgaaaaaaagcaaaaaaaacttttttttttcattacaagaaaaaaagccaaattgcttgatatgtaccataaattgagggtctgcagctgtgattgttcaccatttcaagataaatgaatccagcgtaaggaccatagtcaaaaaagaaaaaaattcatgaagccatcactacagctacaccagcagacatgaaaaccttgcacattttgcagaataccttttaatcttgtattgaaaatgtagcttttatgtgggtgcaggattgctgtaagaaaggcatatctgtagactctaatatgatttgagaaaaagcaaagtcattatatgacaacttaaagcaaaaggaaggtgaagcatctaaagctggagaatttaatgccagtaaaggatggtttgataatttttaaaagtggtttggcttaaaaactgtcaagataacaggagaagcagcttctgctgaccaagaggcagcaggtgagttcccggatgccattaagaaaatcactgaggagaaaggatacctgcctgaacaggttttcagtgcagatgaaagtgtcctcttctgggaaaaaaatgctacaaaggacattgattagtaaggaagagaagcatgcatcaggatttaaggcaggaagggacaggctaactggactgctttgtacaaatgcaattgggtttatgatcaggactggccttatctataaagctgctaaccccctggccttgaagggaaaagataaacaccagctgccaatcttttggttgtacaataagaaggcctggacactgagaaaacttttctggattggttccactgatgctttgtccctgaagtcagaagtaccttcccaggaagcgactgccttttaaagttcttttgatattggacaatgcccccagccacccagagccccatgagttcaacactaaagtcctcagagtggtctccttgcccccaaacacatcataatttggcctctagattgggaggccataaggaccttcaaggctcattacacacagtactttatggaaaggattgtcaacactatggacgagaacaccaacagagagaacaacatggaagtctggaagaattacatcactgaagatgccatcattgtgacagagcaagccatgaaagccatcaagcctgaaacaataaattcctgcaggagaaaactgtccagatgatgtgcatgacttcacaggatttacaacagagccaatcaaggaaagagattgtagatgtggcaaaaaaggtggggggtgaagggtttcaagatacggatcttggagaaattcaagagctaacagataaccacactagaggaacaaagagaagacaacctgctggagacgagtgcttccccatcagtgtgaggtgatgatgaagacgacacagaagcagcagcatcagaaaacaaatcgacattaaacaatctggcaggtttctgattagtcaagactgcttttcacttcttttgtaacacagacccttctatgatacaagcattaaacctaaagcaagtggtggaggaaggattggtaccatatacaaatatttttagaaaaatgaaaaagcaaaaaagccagaaattatgatgtctttctgtaaagttacactgaggcgcccacctctcctgcctcctcttccaccgcttctgcctctgccacccctaagtcagcaagactaaccccttcctcctcttcctcgtcagcctactcaacaagatgatgacaagaataaagacctttctgatggtccacttccatttaatgaattagtaaatatattttctcatgattttaattacatttttttctctagcttactttattataatacagcacataatacacataacatgcaaaatatgtgttaattggctgtttatgttattggtaagacttccagtcaacagtaggctattagaagttaagttgtgggaaaatcaaaggttataggagattttcaactgcatgcagggccggtgcccctccccactgtgttgttcaagggtcagctgtactctctaagggctttgctaacttcaaaacatggagtatttgaatacagaaaccagagcatttacatactcagctcaaggcagagctattaaaaaaactcctcttctccatatgtaggaaaggaaatacaaatgcatcctttgagtcatttgtgatgttgtaaataaaatgagattaactccatgttctaagctaagaaagccacaggggcacctggacctcaggaattcttacatttagggatgctgtctgacctgtattcgttacagtagtttcaaacatggtttgttttacagcaccgtatagggcagaattccaggttaagttccaggggctgaaaaggggtgccacttaactttgggaactataaagaaactctaccacctgcaggtagaagacagtacaagcaactacctaattgacccgactcaaaatgtgaagtgcagaggtcaagtgtccctgttcatatacagcactaaaagtactgaggttacaatcacacacctcaaagtatttttttttttttttttttgagacagggtctcactctgttgcccaggctggagtggaatggtgtgatcttggctcactgcaacctctgcctcctgagctcaagtgaacctcccaccttagccgcctgagtagctgggaccacagatgcatgccatcaagcccagctaatatttgtactttttgttgagatggggtttcgccatgttgccctggctggtctggaactcctggactcaagtgatctaccagccttggcctcccaaagtgctgggattcctggtgtaagccaccacacctggccaacaaagtatcttaaacctaaagtttctatgaatttatctgaaaagagaaggcttggttgagaggattgttttagtgagagggacttagaaaatactgcttttaaaataaggtttaaaaagttaaggtttaaggcagggtgcggtggctcacgcctgtaatcccagcactctgggaggcccaggcgggcggaacacgaggtcaggagatcgagaccatcctggctaacagggtgaaaccccgtctctactaaaagtacaaaaattagccaggcgtggtggcgggcgcctgtagtcccagctactcgggaggctgaggcaggagaatggcgtgaacccaggaggcggaggttgtagtcagccgaggtcacgccactgcactccagcctgggcgacagagtgagactatgtctccaaaaaaaaaaaagttaaggtttaagcatcagtgtgtttcaggtgatgtgttcaaaaggaacatcaggatgtttttccttgctgtcactaacaaggcccttggtgctcagctgacattctctagcaagggatcatttgtcagggatggtttacagagtgaaagcctgctgtttgctgttcacagataacaaatgcttttctcctctcacagaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaataaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcactacaacctctgccttccgggttcacgccattctcctgcctcagcctcctgagtagctgggactacaggcacccaccaccacacccagctaactttttatatttttagtagagacggggtttcaccctgttagccaggatggtcttgatctcctgacctcatgatccacccacctcagcctctcaaagtgcagggattacaggtgtgagccacggcgcctggcctaaaagcatctttttctttaatgcagaggttatgttgtattattagcataaatgttttttttctgggaatgcttatttcacacagcacaatactgaatcttctctggaatgtggatcgatttcagatggatgactattaaaatgtgtatatttgcagattatccttaaagggccacctcatgccttctaatttatgtcttacggataaaaaatcaaaatgaagcataaagtaaaaactgtgtccagctttacaagtggacgcttagtaatggctgaggcaatatgtttaatgtagcaaattttacttatttgtcatgatcagttttcacagtgcttgtaagtgctggtaatagaagatggacatggtttaggtcaaaacttggaccagaaaccaacttcctttgaaacagctctaccagttataagagcaatatgctgttaggtgaagaactgtttaacagaaatatattatgtttttgcaaacaggcagctgatccaaaattgtgttgaaacacctcagaaacataaatgacatcaatactctataaattaatgctgttaacaaatttaaaaaataaaacatacaattttcaaattgaaggcacacatcccagttggtactggcaagtttaaattgtttctaatactggtggactcttcatttgtaacctactgagcagttacagagggtactcccattgatacaaaatgctcaggtaccggcatttctccacatccagagttctttctatattcccttctgatttccatcccttatctgttccctgcttttgtccttccccagtctcacc

SEQ ID NO: 12808 - DNA, 34765 bp, Human
ggtctcaaactcctgacctcaggtgatccacctgcctcggcctcccaaagtgctggggttacaggcatgagccaccgcgcccggccttttgccacaatttataaacaagaatgaattctaacgttcatattaattgaagctaacatgacacacatagcataaacaggtgtctaagcggccaggcgcggtggctcacgcctatgatcccagcactttgggaggccgaggcaggtggatcacttgaggtcaggagtttgagaccaggcctgaccaacatggtgaaacccagcctctactgaaaacacaaaaattagccaggcgtggtggcacgtgcctgtaatcccagctacttgggaggctgaggccggagaattgcttgaacctgggaggcagaggttgcagtgagccgagattgcgccattgcattccagcctgggagacagagcgagacaccatctaaaaaaaaaaaaaaaaaaaaagtgactaagcgaggggtatggtggggtgtggcgtggtgggatgggcctggcttttatgcctagaccaacgtgcggcctgggcaattatctaattatcggttgtctaattgcccagcgtcacacatttctcacctgtaaaatgggtatgacagtctctgccctcccactgcccggggttgctgtacggcctgcgagagcgggtttgggaaagctctttgtcaactgctgtgcggaattgatggggtggccacacttcaatgccttgactcaggggtcagagctttcaagcgaccccaggcagggctatgagggcctccctggcagtggctgcttattccaggctgggcctgccctacggcttgttggcgtcccgcaggcagctgctaggatggtttttgcagggcatttgggccgcagcctggatgcatacctagacctcactgtttttctcagccagggtctgggagagaatgaaacctattgttctagttatctgctgtatgtgactctctcctgtgcgtttctctcttgtgggtcttctctcctgtgcatttagggtggtatgaagtgaagagagaaaatagacacttgtggccgggcgcagtggctcacgcctggaatcccagcactttgggaggccgaggcaggtggatgacgaggtcaggagttcaagaccggcctggccaacatggcgaaaccctgactctactaaaaatacaacaattagctgggcgcaatggcaggtgcctgcaattgcagctattcgggaggctgaggcaggagaatcgcttaaacctgggaggtggaggttgcagtgagctgagatcgcgccattgcactccagcctggacgacagagtaagactctgtctcaaaaaaaaaaaaaaaaaaaggaaatgacactgatagttatctgtgttttgtggttccctgaggaacccccagttgagaagaaaggctgggacctggctgacccagaagaccccctcgacgccaacccctactccaggtttggggacccaggaacgagaggcctaagagagttagggactagttcaaggttgctcggactctcaaaacaagtccctaatgccaggccagtactgtgtggcgggcagcacgaccctccattccctctttattttgaaaacggaacagttacaggacgctagttttgacgtcgctggttgtgaatgtcatttgtggagccgtttcccagacctccgggggcaggagccacaggtttgagaggccgagcagcgccctcctttcctgagagctgaggttgcagctctggctggctctggtaagtgctctgcagccctggcatggctggaggaggggcagcagctaagtggtttctgaaaaagggcaaaaatgatgggaaaagctttgggatcctctgggaatcagagccgcagcaaaggcagctgcttgcatcgctggaagcgttttttccttgagtgccgaagggcgtccacagcgactcctgctagtgcagggcagctgctgccagggccgggcccgggaccccacggaggcggggagaccactcttctcccacacgagcccagctctcccttcgagtagcaaccgccttcaagctcacaagcacccgtgggcctggggtgtgcctgcgtctagctggtgagtccctttctttgtctgatggccaatgcagacattagcttttaagatggcatagtgagtggccaaaagccgggccctgtcacttcccagctgtgcgactgtgggcaggtccactcacctctctgtgccccagttaccttatctgaaaacggggggtagtaagagtggctgcctcaaaggtggtcgtgagcctgaagcgaacttgtggtgccctcagcctggctccttggaagcacctgggaggtgagagtggaggttgttgttactggggtttgttcttgttgctcctgcatcagccgtcctcgggggaggaggctgcagctgctgctgagattgctggtgtgtggccggaggttttcagcgtgtcgccctctctgtggagtggacgagcgcagggctgggaagcaggcacactgggtccttgtgctgctgtcctatctctttgttcttcacccctgggttgggaagcccgcagcctactgcctccctttgacagaagggactactgagaataatctggctgggtcctgggccagcgttctcccagcttccagaaagtccccagtggcgagcgggaggtgctcccaagaacttggatggatggatggatggatggatgctttgggcagagagaggagcaggggagccacaccccatgttgtctcacttgcattggggagagaagggatccttcccccagagggtaggcagtatctgttctggctttggagttgagaaagactcagatcataccacgtctctgtgggcagaatcgattcttttaggattgtcctttagtccagattgatgagtttgtgagtcttgtgtaaaccagaatcaccatctccatcacacagccaacactcgtttgcctaaatcacggtagaagttcccctgatcactgtagaatgttttgcggtgacaggtgcatcaccacgggcttaggtgcagggtacactccaggcctggcagtggagggctgtcctgaccctgttccccggcccagcccagggcacatgacccctcagttcctgtcccaccccgttccctggaagaagcttggtttccagtagggaatcaggtgcagagtgtgcagtatagattcagcgtttgtcgactgactgaatgatagcacaatccaggctgcttcctgttggctgggtttggttggactgggacccgtcagaggaaaaggcaacgccgctgacaaagaacattgccgaaaggttcatgggaggctccggctaacaggtgctctcttgctgggctgcctaacgagcagcccctattcttattcttagcttattcttggagaccatagacatccctgggacagccaggcatgggtatgacctgggtcttattcacactgcattttggggttcctgagctgcttgtttgagcgagaggtgcttcaggttcaggtcttatgcctagccccttgggtgagagggcctattctgattggcccccaggccctgctgtggagtctgggtctgagttgaactgctgagaaagagccccagacctccagcatcgtggtggagcactggagatgctctggagccagcctgcctggggtcaagtccgggttccatctctgactgtgtgacctcggggacgtgccataactgctctgtgcctcggtctcctcatcggtgaagtatttccctcttagggatgttgtgggaatgaagtgggtgaaggaatgcgagtcctgagaaccgtgtctgctttgtgcacgtgctcagacgcatcaacgattctgcttctcattcgcttctggtgccttttaagtgctgccagggctgtccgcactgtgaacggtccttgacggggtgttatcttcagaaagggaagactagcacccggccccccaggcttccaaagcatcatccatgcaaccatgttggctttcaattccttggagttaaggctgacggccatctggttctaacccggcctcctgtcttcctgtcccactgacttcccgttcttcagctgctctaggcttccctgtctgtctccagaccctagcccacctctgttcccttcccaggctcagctcatccatcaccaactgccatggacccctcttcagcaccctgccccctcctgcagtccctccgcccagccagtacctggtttctgtctcagcggggagctgactcctctctgtgcccccagcgcagggctggactctgaggaggaggactcagtagataggtattgagtgatgagatgagggaatcggctttctgtggccgggaacactcctgctgcagggggtccacctgatgggtgagtcagagaaagactcaggcctgttgaaagtggatcaacaggcaggcagggagatggccagtagccagccgtccgtcctgttcacagcctgcggagtggtgaggctgcctctgtgttttcatggatctgagattcagaacgtagctggtttacagccatggcccagttgtgtgctctggagtttcactgcctgaattttaacttgaaaatgtaggacttgggagtctctctgagccattctggcttgggagattgcctgattatatatttcaaaaaaaaaaaaaaagaaaatgcaggacttgagaagcctctcatttcttctgcggctgttttccggaatgtagccactgctggaacagtaatctccctaacttcctatggaaatggcaattagaagggtctgattgctcttatttccccatgtgtgcagctgctgctgctgctgctgctgctgcttctttttttttttttttttttttttttgagacagagtttcactctgttgcccaggctggagtgcagtggcacagtctcagctcactgtaacctctacatcctgggttcaagcgattctcctgcctcagcctcccgagtagctgggattacaggcgcccgacaccacgcccggctaatttttgtattttttttagtagagatgggatttcaccatgttggccaggctggtctcgaactcctgacctcaggtgatccacctgccttggcctcccaaagtgctgggattacaggcgtgagccacgcgcccaggccagtacagcttcttcataaggagatggaccaggaaaggtccctgcccaggaggaggtcacagggtgcgggagagataaatcagtgacagatagcaattgctggaccacatggtaggctgtgtgggacaggcggtcagtgggctgggccactgtgtggaggacagcggggagcatgagcagggcagggatctgggggcttcatggaggaggcggcatcagtgctggatcctgaggggaagtagcatctgagtggtgataggacttgtgcaagggtagacagaggaaaaagcccttaggtggagacccgatgggaatagaggctatgggagggatgtatgggccacccctgggtgccagggagtggggatgcccagccagagggaggggaagcatggggatggggcaggatgggagtggaaaatagcatcagctcatgtgtccaactacacatgctgctgccagcggccagctgatctctaggtgtttaggcctagaagaccaaccagctccaaatcacttaaagcctaaacgttccctgtctctactaaaaatacaaacattagccacgcatggtggcgggcgcctgtaatcccagctacttgggaggctgagggaggagaatcgcttgaacctgggaggtggaggttgcagtgaacagagattgccccattgcactctagtctgggcgacagagtgagacacacacacacacacacacacacacacgcctaaacattcaaggccaggatgcttgacagatgttgattcataaaaatgacaaaaagcacaaaatccaaaatctcgtataaggctcagtggctgtggcagcgaggttgaagagcaaaggcaggccgggcacctggctgatgatgtgtggacccgttgcacagcagggccccgcagtgcggtgtgggtgtgggtgggccagtctctgccgctcaccctattccagggacacagtctgcttggctcttctggactgagccatcctcatcaccgagatcctccctgaattcagcccacgacagccaccccggccgttttccttgttctgtgtggggagggaggcagcgcggtggttatcaacctcaccctgcagaggaggcacctgaggcccagagacgaggagggatgggtctaacccagaaccacagatggctctgagccgggggcctgtccaccctcccaggccgacgtcagtggccgcaggactgcctgggccctgctaggcctgctcacctctgaggcctctggggtgagaggttcagtcctggaaacacttcagttctagggggctgggggcagcagcaagttggagttttggggtaccctgcttcacagggcccttggcaaggagggcaggtggggtctaaggacaagcagtccttactttgggagtcaaccccggcgtggtggctgctgcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggtaagtccgcgtctggagcccccctccctgctgggagcccagctggccatggagatgccacagggtggtctggcttctgggctaaatgtcacaaagccagggggctggagagccttaggggtggtctggtccagcgtccttcctcacgtgacctcgtgggatgtgcagtcacgggggctggtgtctgtgctgggtctaggtgtccacgcccgcaatgcctaccagccacagacacttggacttgaagtctaaaagctcaagggcaggaggcttttggagagcacagcacagctccagtgagctgcaaggcagggcagggagggccacaggctggctgacttctggggagtgtgaggccaccttttcccttagaggggctgtctacacccctgcctccacctccctccgtccccaccaggctcctgcctcccgagctcccgagcaggcagagaagccagtggtctgggagtaggagggtgactttctagatggtgtctatagacagggtggggacagaatggggacacatgccctccactgtccctgttacattgcttttctggacagtcacctagactgaggggcagcttttatatcatttttcccctttttggtttgccttgggatttagtcgtgttcccttgacaagctccgaaggcctcagggccgaggggaggccagggtatgagacgagcgtgttttctggcccacaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaaggtggccccagcgctgggctcggggagggccccagccctggcctgccctgaccctcccttatgtctttcagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggtgaggagggcggcggggccgggcatggctcagcccgcagcaccgggaagcaggggggcatggttgtccctgggcctccttgcttctctgggatccttactccctgtcccagccactgcgttggtggctcctaatcctagggggtccctgcctctcccatctgctggcttgatttctcctggtcctgggggtctctgcctccccgatctgatgtctcctctcttgaccctgagaagtccctgcctccccctgctgactggatggtccctgtccctggaagtcacagcctctggcctttctctctgctgctgttccttgcccccggggcaattttgactcctctggcttccaacccgttatttcctgttcccaggggtctcctgtctcaggaccttgctgggaccccttgggggaccctggcctggcctcctgcagtgggggggtcctccaggcactttctgcccagttcctcctgcagcagctgctgcctgcccagagcccttccccagcacctgtcccggcagccccacaggaccgtgaccacgaagccaaccgtgcgcgtcctctgtaggccagacagcactgcacatcgccatcgagagacgcaacatggccctggtgaccctcctggtggagaacggagcagacgtccaggctgcggcccatggggacttctttaagaaaaccaaagggcggcctggattctacttcggtagggagacagcgtggcagaccctgatctttttggcttttgctaaggggaggtttgggcagagacagagggagtttggaggccggtggttcaggggccagctggatctcactcctgaggcccacctgggccctgtgttcatgcaggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtaagagggggcttcggctcaggctggtgcggtgcggggctgatggcatgggagaggactgcctgactcactgcgggagcctggcgtcgctatctgtgtgtgcgggactctgattctgtcataccagcctgtagggctgttagaataagtctgagaaattgggagccacagggcagaaccctgcaatggccaacgtgccattttgaatttccagctctgagtatcagcaacaagacatggggtggggtagggtgctgggcaatggaggagggactgcctagggtggaacagaagaatagctgttgggctgggcacggtgactcactcttgtaatcccagcattttgggaggccgacgtgggtggatcacctgaggttaggagttcgagaccagcctgaccaacctggtgaaacctctactaaatatacaaaaattagccaggcatggtggcaggtgcctacaattccagctactcaggaggctgaggcacaaacatcacttgaacttgggaggcggaggtggcagtgagccaagattttgccaccgcactctagcctgtgtgacagagcaagactctgtctcaaaaaaaaaaaaaaaaggaaaaagaaaaaagctgttggtgtttttccatggcaggcaggagcatggcaggcaggagctttaggtaacaaggctgatggctccagctcccagctccagctggtggctcctggtgacaggcctccagctcttggcctcaagtgatcctcccacctcagcctcccaagtagctgggattacaggcatgagccaccccatctggctctcatttcttgcattctctttctttctttctggcttgaggttatcgagaatggaccaccgctgtccttcatggtgagatggtagagctggggcctcgccgtgaggggattgtgggcctgatatggtgcaggtagtatctgaggcagctggctggttgacgtttgtgtgttttgttttgttttttttttttagatgaggtttcgctcttgttgcccaggctggagagcagtggcacaatctcggctcactgcaacctctgcctatcaggttcaagtgattctcctgtctcggcctcccaagtagccgggattacaggaacacgccaccatgcccggctaattttttttttgtattttcagtaaaaacaggattttgccatgttggccaggctggtctcaaaatcctgacctcaggtgatccacccgcctcagcctcccaaagtgctgggattacaggcatgagccacccgtgcccggccggctggttgatctcagtggtggtcaggagtgggtggggactcgcctggggcttaggtggggccaccagctgggctgggaagcagagctggttgttgaggtactgtctgaggctgagcctggggctggcctctgacgggctcttgctccccgggggcaggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctgtgagtggctggggcacagccagggagggcctcagggcctctgcacccaagccccaatcccagcccctggtccagctccagctggcttctcaggagggaaagcctgctgcgcccgggcccaggccctgcagcctcacgttccccactcatgcccactgaattttccctaagcatagcaaccatacgtgattatcatcccataaaaacagaaacgtttcagaggaacatggacaaaaggaccctccttttatactatttaaaaatgcacagtttcattttgtttacataaatgagatcagactatacacaatgtacaacaaccttttttttttttcacttgatggcagggcgtgtagatttttctttttttttttgagacgaagttttgctcttgttacccaggctggagtgaaatggtgccatcccggctcactgcaacctctatctcccgggttcaagcgattctcctcgaatcccaagtagctgggattacaggcatgcgccaccaggccctgctaattttttgtatttaatagagacaggatttctccatgttggtcagggtggtctcgaactcttgacctcaggtgatccaccctccttggcttcccaaagtgctgggatcacaggtgtgaaccactgcgccaggccaagaacttatttttgtgtaggtgtgaagtaggcatcttacttaaatattttggctccaaatgaatgtcttagtgttacgtagtgagtaatccatcctgccacgctgtttggaaaggccaccttatctgtcccttctttctaaggtgatgctctgagctcctaaggcagacttgggggctagagtctgtgccatcagcagtgaggggcttccacgacatctcacaggtcagaggttgcgtttacaggagcagagtccggggctgggaaaggcctggtctgctctgcctcccctgggctgccatgctgaacctgggcctccaactcagagtgctggatacaagtgttcccagaggagaggtccagataggaggtggcctcaacaaggactgcagtatttgacctgggggagaggctctgggaccaccactgacatcttcatgtctctaaaggctctcagggacaaggagtgtggacttgtcctggggaccctagggcagagccaggaccactagtggaaagtagagaagaccaaagaagaggtattccctacaggcagtgagtctccataggcctcttgaggcagtaaggagtttcccattcccaaaggcattcaagaagacactgatcaggaacctctttgagggagcttaagtttggggtgggggttggactcgatggcctgagggaggctgggatgatctgattttggctcatcagtctcagggatacttgaacttatttttattttattttattttatattttgagacagagtcttgctctgtcacccaggttggagtgcaatggcgtgatctcagctcactgcaacttctgcttcctggggttcaagcagttctcccacctcagcctcccaagtagctgggattacaggcacccaccaccatgcctggctaatttttgtatttttgtagagaaggagtttcaccacgttggccaagctggtcttgaactccagacttcaagtgatccacctgcctcggcctcccagagtgctgggattacaggcgtgagccactacacccggcctatttgaactttatcaaagtctctggatatgagacatttgccccaaagcatacttgtaatgatggcatgaggcactgggccctcctggggcaggaagggcctcctagttccctgcctccctgccgccctgcctgacccagggctggaaacgtgagaagtgaggacccagaggctctttcctgcctgccctgagcccctcatgcccaggctctgcctaagccaactacttcccattactgtgggctctcgggagggagttattagacacagcgggcagtgcggtgggccattaagtgagcacttaagagcttgtccagtttcaccccattcactgcacctctggggacactgaggccaagagggcaggtccctccgtgagccgcggcagtgctgggaccagccccaggctatggctgccggctggctcagacctcccatctcacctgctccgtgggctgaggactgtgcgggccacatggctgtgaggggcaccacgggctggtgtgggcgtgcgaggagttcctgctgcaggagggaacctcacttctctccccaccccctagaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttggtgcggccagaggctcaggcctcgtgggcgagggtgtgggtggtggggaaggggtgtggacatttcgggagacctccccgaccccaggcccaggctctgccctggactccttcccagcttgcgggagcgatggatggagaacgtggagaacctcgtatccctgcgcccatctcccctgcctcaggctgtacaggagacccgcccccttcccgcttctcagttcctctcctttaaccttgaggtcctgtggggctgagtgtgtggtgactcaggtccctgattgtagacggggtgtactcggttagaaagcatgcaggggccgggcatggtggctcatgcctgtaatcccagcactttgggaggctgaggtgggcagatcacctgaggtctggagtttgagaccagcctgaccaacatggtgaaaccccgtctctactaaaaacaccaaattaactgggtgtggtggagcctgcctgtaatcccacctactcagggaggctgagacaggagaatcgcttaaaccttggaggcagaggttgtgatgagctgagatggcaccactgcactccaggctggtcaacaagagtgaaactctgtctcaaaaaaaaaaaaagaaaaatcacgcaggaatttgggctcgggacagggctcacccctggcctgggggtccccagggatgtgggctggtgtctaagcccagagcccaccatcatcctgcttgcctgccctctttcattcactcacttgctcattattcattccctggatttagacttttgagcagctctgtgccaggccctgggccatccatcaaatcagcctaagaccagcctttttcctctgccaagagccaagacttcatcaaacttctggacttagtccttcgtgtctgatacccaggacacttaatttgctgcttttgtttccagggcactttacaagtttacttacttacttaatttttgtttttttgagatggagtctcgctctatcacccaggctggagtgcagtggcgcaatctctgctcactgcaacctccacctcccgggttcaagtgactcttctgcctcggcctcccgaatagctgggactacaggcgcccaccaacatgccaagcttatttttatatttttagtagagatgggatttcaccgtattggccaggctagtcttgaactcctgacctcaagtgatcgcctgcctcggcctcccaaagtgcttggattacaggtgtgagccaccgtgcccggctgcacatttactttaaaaactcaacttcataattgcatgaaacccgatttctgtccacctattaaggccacataatgacttccttttttttttttttttttgagacagagtctctctctgttttccaggctggagtgcagtggtgtgatctcagctcactgcaagctctgcctcctgggttcacgccattctcctgcctcagcctccctctttttttttgttttttgttttttgttttttgagacagagtctcgctctgttgcccaggctggagtgcagtggcgccaccttggctcaccgcaacctctggctccggggttcaagtgattcttctgtctcccaagtagctgggattacagccatgagctaccacgcctggctaattttgtatttttagtagagatggggtttctccatgttggtcaggctggtctcgaactctcgacctcaggtgatccgcccgcctcggcctcccaaagtgctgggattacaggcgtgagccactgcacccggccagtgacttctttttaagagaaaaatgtgctggtaaggcaagctgatgaactagtgcttaggaaatgtggatggtgacccactccaggaaatggccactgaaacacaagggtgacacccacaagtgtgtgtggcacagtctctccctccatggtcagtgggagtccctgacactcgtgggagactggccatgggctggggtggcagcgggatgtgtatggcgtggggtccatgagagtgcttccacctctccatcaccctgctgtccatcactctgctcccagccaggaggagctctgggcctgccgggacattgcttgggaggcggcacagcattgtaagatgctccgcttggcacctgcaggctgccactttggggaatcaggcccacagaggggcctccttgcgggcgctcccctaataacacactgtctttgtgtgtccttcccctgatggaggctgtgcctcctgggcagggactatggcttcatggacctggtccatgtttgttgaatgaacgaatgagtaaatggagttaccaacttctctgcatctcacagcctccctttaagatggaaaaaactggagactatttccgagttactggagagatcctgtctgtgttaggaggagtctacttctttttccgaggggtaagcgttccttcccacattgtgagtttccattatcaccaaaacaaaaagccaagaagatccctcagcgctcactcactttttaattcatcagacacatcatagccctacttggggagctgagagacgcagaggtgaagatgagagcccttcagtcagtcaccgcggggcgggagggtgctcagggcgtctccacaggcccaaggcaggcaagcttgaaagtagacactccagccactccacggaacggagtatttgattacaggggcagagtggaggcctcttaagtgataggatcatgactggtagttttttaattaaaccaatctgttaaagctctgagcagtgaaggaaatctccttgcatactggaatcttttttttttttttttgaggtggagtttcgctttgtcatctaggctggaggctagtggcacgatctcggctcactgcaacctccgcctcttgggttcaaaaaattctcctgagtagctgggattacaggcgcctgccaccacagccggctaatttttttgtatttttagtagaggtggggtttcaccatgttggccaggctggtctcgaactcctgacctcaggtgatccacctgcctcagcctcccaaagtgctgggattacaggcgtgagccaccacaccagcaaggaattgttttatttttaacctgaaactcaaacatgtgcaatccttggccattttttttttttaatgcaggagtaatcttttctttgaatgtgggactcactgtttcagattttacatcacctttcttgcaaaaaccatatttatataatctaagatttctagtttcagcttctttaaagaagagtgagaacttagctgcgtacaaaaaagtctgaatgtagaatttgagatgatcattggtttttgtttttgttttttttgactctggaaacccttgtagtattttaattttaatttttataagatggggtcttgctgtgtcacccaggctggagtgcagtggcgtgatcatggctcacttcaacctctgtctcctgggctcaagcaatcctcccacctcagcctctggagtagctggaactacaggaagccatcaccatgcccaggctccactgtgattttttttttttttttttttttttttttttttttttttgagatggagtctcactctttcgcccaggctggagtgcagtggcacaatctccactcactgcaagctccgcctcccgggttcatgccattctcctgcctcagcctcccgagtagctgggactacaggcacccaccaccacgcccggctaattttttgtatttttagtagagacggggtttcaccatcttagccaggatggtctcaatttcctgacctcgtgatccgcccaccttggcctcccaaagtgctgggattacaggtgtgagccactgtgcccggccccattgtgattttttttttttctgagatggagtctcgctcagttgcccaggctggagtgcagtggtgtgatcttggctcactgcaacctccacctcctgggttcaagcgattctcctgcctcagcctcccgagtagctgggactacgcgcgtgtaccaccacgcccggctaatttttgtatttttagtagagacggggtttcaccatgttagccaggatggtctcggtctcctgacctcgtgatccgcccgcctcggcctcccaaagtgctgggattacaggcgtgagccactgtgcccagccttctattgtgatttttatcccctagtcttttttggtataagctctatccagttttttttttcagtcactcacctttatggaattgttctgtcattgaacttcgtcttcacagagacaactgtctttcttttcacactcatggtttacattacagtaaagtacagtgccacagtagcaagtgtggctggaatggcaaaagcaggattggcctgtgggagggagcagaagggtggtggtgtcttggacaggactcatggctgacagtggcggcttgttacaagaatttttattttaacgcttacttaaaattaagaaaaaaatatgctcggcatgtgaaaaattaagaaaaaggtggctcacgcttgtaatcccagctacttgggaggctgaggccaggagtttgagaccagcttgggcaacatagtgagactctgatctcttaaaaaaaaattaggaaaaagctccaattagaagaaaacaatttgcccaattcaatacagcaactgataacattttaatgattttccttcttgtctgtacttctgggtatagttgtaaatccactgtgtaatttttttttttttttttgagatggagtctcgctgtcacccaggctggagtgcaatggcctgatcttggctcactgcagcctctgcctcctgggttcaagcgattttcttgcctcagcctcatgagtagctgggattacaggtgcccgccaccacgcgcagctaattgttttgtatttttagtagagacgggatttcaccatgttggccaggctggtctcgaactcctgacctcaggtgatccacccgccttggcctcccaaagtgctgggatgacaggcgtgagccaccatgcccggcttccactgtgtatttttaaccatctctactgactgggccacctagtgtcaccccattggcctgacccttgctgttctgctcttttcacaatctgtgctttcacacattcgaccaccccatcatggtgccatttaggaagcatctgagtgctcaccatttagccacatcgagcattgcctgggatcttactctctctgtttacctgcagattcagtatttcctgcagaggcggccgtcgatgaagaccctgtttgtggacagctacagtgagatgcttttgtaagtgacactttgactcattcccagtccagtccccaggtgaccgcaatcagttctcacttgaggtctcactcacgccgggcctggcacatagtgggacctcagtgaacatgctgagggaatgacggaaggcactgaatacatactcgggggatgaatgaatactgagggcctgctctgtgccaggggccagggatcgagaaactgccgtgacttacagtccgagtgagacggaccttgttcaccttcccactcattgtccatccatctgccgttcgaggggttggccctggaatactggatgaaacagacatggcgcccgcctttggggagtttcctatctttaacggggggttgtgcgaccttggcactgttgatattttggactgggtagtgcttagttgtggtggttggggggcggggcggggcgggggctgccctgtgcatcgtagagtatatagcagcatcaccggcctctactcgcagctgcctggagctccccatcccccagtcgcctggagcttccccatcccccagtcttgacaatcaagaacatttccagatatggccaaaggcccctcacttgttttggggggtggtgccggaatcactcccggttgagaaccaccgctttaggaggaagcagatgagtgaaagcacagttatagaacagtttggatggccgggcgcagtggctcacgcctgtaatcccagcactttgggaggctgaggcgggtggatcacttgaggtcatgagttcaagaccagactggccaacatggtgaaaccccgtctctactaaaaatacaaaaattaggcaggcatggtggcacgcacctgtaatcccagctactcgggaggctgaggtgggagaattgtttgtacccgggagacagaggttgcagtgagcccagatcgcgccattgcattccagcctaggtaacagagcgagattccatctctaaataaataaatagaacattgtggatgtggcaggaaacctccttccttcagaaagtaagccagagcctcaagccccagtgtgcaccgagggccttccaggacctgtctcctgggatctcggctcacagtccccgtcctgatctcttccttcctggaagaacaaggaataatttcaaatcctcttgcagctagcttgtccgtacgactcacaaaccgcatcctttaacccaatttttttttttggacaagtaaaactagaattagctttatttaacatgattgtgaaaggaacacttattttaatttttttaaaagaatttagatttcagggtacttgtgcaggtttgttaggtgggtatattgtatgatgctgaggtctgggggtctaatgatctggtcacccaagtagtgaacatagtacctgataggtagtttttcaacccttgtccccctcccggcttccccacttttggaatcctaagtgtttgttgttcccgtctttgtgcttgtgggtgcccagtgttttgctccacttataagtaagaacatgtgggatttggttttctgtttctgtgttaatttgcttaggataatggcctccagctacatccatgttgctgcaaaggacgtgatttcattcttttttatggctgcatagtattccatggtatatacgtaccactttttgattatccagtctaccattgatgggcacctggattgattccatgctttgctattgtgaatagtgctttgataaacacaggagtgcaggcatctttttggtagaatgggttcttttcctctgttttccccctaatcttgagatacctatactttagccccgaaaggcaaactcaagaggcaaggtctgtaggtttaccacactgatttacctgcctaagagaagcagttttctacatagcattgtgattctcctgcctcagtgtccccagtagctgggattagaggggtgcaccttgcccaggtaattttcatatttttagtagagacagggtttcactgtgttggccaggctggtcttgaactcctgacctcaagtgatctgcctcccaaagttctgggatgacaggtgtgagccatcacgcctggccactatatatccttttatgtactttttatttatttatttgtttatttatttgtttatttatttatttgagacggagtctcgctctgtctcccaggctggagtgcagtggcatgatcttggctcactgtaacctccgcctcccgggttcaggtgattctcctgcctcagcctcctgagtagctgggattacaggcgtgcaccaccatgcctggctaaatttttttttgtatttttagtagaggtggggcttcaccatgttggtcaggctggcctcgaactcctgaccttgtgctccgcatgcctcagcctcccaaagagctgggattaaaggcgtgagctactgcgcctggcctttaggtactatatttatatctgtgctttatacataaagagtgagattttgcacagctcctcaccaagccaatttctgctccttggggacgatgctgcttccacggagaacgcctgggctgaaagagtcaggacagcccaaccctagctcctattgcggcctgcagtctggacctctgagcggcctgtgaccttttgttctgggggtgccaggcctcctgggttcccgtagacggagctttctgcccctccacccgcagctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaaggtgggttccctgggccccagtgggtctcctcagagcccgcttacctcgtggtcatgtgagatggggccaagaactccgcccatcctctctgtcgtgcctgggaaggggctggtttaccccccagcctattttccaagaatcaagcaatctggccctgacccaggtatgtgtaggggggtcccctgaaacctgaccccccctgcacaccaggcctccatctcccgaccagaacaaaggctatgggggaagggtgggtgactccctcatgacccctgagctgagaaccagcaaagcaaaccgccctgcacgttctcaagacgcatccccaggccgatgcggcccggcccttccctcagctcctcctgggcctggcctcggctctgatgagcctgctgtctcctgcagatgatcctgagagacctgtgccgtttcatgtttgtctacatcgtcttcttgttcgggttttccacaggtaatgagcttggtcagcgctgggggagggcaggggtcctgcttggctgagccttctgaagactctgccaggagctgaatgagaaggcactgggtaggcaggtgcatgtctgcaggtgactgagagggtggacagaggacacactgaaatgagctccaggacttggccacgtgttatataaaatgctttaagaattttccaggctggaagtgctgtggctgccacatagcattttggctcagttgttttttcaacttttttttttttttttttttttgagatggagtctcactctgtcgccaaggctggagtgcagtggcacgaccttggctcactgcaacctctgcctcctgggttcaagcaattctcctacctcagcctcccaagtagctgggattacaggcgcccaccaccatgcccggctagtttttatgcatatatatatatacatatatatatatatatttttttttttttctcatacagagtctagctctcttgcccaggctggcgtgcagtggcgcgatctcggctcactggaggctccgcctcccgggttcacgccattctcctgcctcagcctcccgagtacctgggactacaagtgcctgctaccacgcctggctaattttttgtatttttagtagagatggggtttcaccatgttagccaggatggtctcgatctcctgacctcgtgatccgcctgcctcggcctcccaaagtgctgggattacaggcatgagccactgcacctggctagttgttatatttttaatagagatggggttttaccatattggccaggctggtctcaaactcctgacctgaggtgatccacccaccttggcctcccaaagtgctgggattacaggcatgagccacagtgcctggccattaattattttttgagacagagtctcatgctgttgcccaggctggagtgcagtggcgccatctcagctcactacaacctccacttccagggttcaagtgattcttgtgcctcagcctccccagtagctgggattacagatgcccgccaccacacctggctattttttttttttgtatttttagtagagacggggttttgtcatgttggtcttgagctcctgacctcaagtgatctgcccgcctcggctcccaaagtgctaggatgacagggtgagccaccgcgcctgaccttagtcttctttaatccagggcacttcctgcatcattccttgtcatttgcgacctcagaatttgtaatgagtagaggccagtggttttgacaatgtttctcaatttgggtgtgtctgatgtttcctcacgattatagccaggcatgcatttttggccagaatatcaagaagccatgtgtgtcttctgctgtgtgttttattgggagtcacatgatgtccgtctcacttctggtgacgttagctttgatgacttggttttggtggatctgccagacttttccactgtaaagctactatatttacctttgtgatggatacttttcaaggagatgctttgaaactatgtgactagcctgtttctcatcagactttcaccaggagttctagcatccgttgatgagtcttacctgaatcacttcatcctgtgatggtggccaaatgatgatttttttttttttcttgagaaggagtctctgtctgtcgcccaggctggcatgcagtggtgccatctctgctcactgcaacctcggcctcccaggttcaagcaattctcctgcctcagccttccgggtagctgggatcacagctgcccatcatcacgcccggctaatttttatatttttagtacagatggggttttaccatgttactcaggctggtctcaaactcctgacctcaggtgatccgcctgccttggcctcccgaagtgctgggattacaggcgtgagccaccacacccagagaagatgatcttctaactccatcattgcttctgcatttattacctggcattctgttatagagaagagctaaccattccccatttctatgtatttgtttgtatcagaatggcctcatggagtcttttgttttcatggattctcactttgttaaatgggttataatccttactatcctcttttattttaatactcaaattgtctgagattagtcactggagtcccttccagctggctcctgtgctcttttcacatgtccacatcttttttttttttttttttttttgagatagagtctcgttctgtcgcccaggctggagtgcagtggcgcgatctgcaaactctgcctcccaggttcaagcaattctcctgcctcagcctcccaagtagctaggataatcccaacctggctatttttagtagagacgggtttcaccctgttggccaggctggtctcaaactcctgacctcaggtgatccgcctgcctcagcctcccaaagtgctgggattacaggcgtgagccaccatgcccggcctccacatcattttttgagcactggactctgctttgatgctcatccgagtcccacagttacgtggttcacatggtgcaccctccctgtccccaccctgccgtttgcgttggaatccctggctgggagggatgggcacctgtgactaagaaagacctaataggtgtgggctctggcacctggatctgaaggccctgcatttcagtaggtacaggaagggactaggccgggggggtttgtggatactgataggcagcaaccacgatgcacagctgctgcagaggctctcaggctctgggccacacttcccacagaagcaggcagcatgtggggagaggtcattctgctctgagcggctcagtgctcatggagcaaaatggacctctgagggatgcaggccaacagggtgtgatggacaaagcaggtgtggggccagagctgacacgtatggttaagcaggttgtgcactgtacaaaggtggctgtattcacattgcacatagagacttatatatttatttatttttctagcagatgatgataaagttcttaaaaatatactatgaaaatttttttgatagttttaaagaagggatgctttaaaaataacttgtcacaaagttatttgagactgactgagcaggagggtgtatgtcaggggacttgggatattggcttctatccagtggcaccccgccctccctgtgccctgtagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcaggtgggtgggtggagttggggggtggtgagtggcgcggagagtgtgggcggctctgtctgctgtcttacacagctggctgcaggtgggtgggtgggggggggcggtgtgtggccaggagggtatgggcctctctatccgctgccttacccagctgggcacatgagccctgcaggatttgaggagggagcagaaagcccggccaggcccggggatccagcctcagcacctccctcagtggacttccagcaagttcccctgcccagcacctgctcaggggcagatgagctcagctggtgtttatagacaccgtgcttggctgtggtctgggtggtcctggagggaagaagggggagggctcagcccgacagggtgtccacctcagaggagcctggtgtaaggtgggcaccagaggccagactcaggggagcagctaccatgaggcagggccctgacagctacatttctggccccgtgggccacatctgcatccccaactactaataataagtttcgttcttatgaagaagcactttctctgtgatagggactgtactaagtgtctgtctcacctgatctcatttaatcctcacaacagtcctgtgaagtggattctattactgttcctttttttttttttttttttttctgagatggagtctcactctgtcacccaggctggagtgcattggcatgatcttggctgactgcaacctctgcctcccggcttcaagcagttcttctgcctcaacctccctagtagctgggattgcaggcacccaccaccacacccagctaatttttgtatttttagtagagatggggtttcaccatgttggccaggctggttttgaactcctgacctcaggtgatctgcctgccttggcctcccaaagtgctgggatcacaggcgtgagccactgtgcctggctatactgttctgtttttgaatgaggcactgaggcgtagtgaagttaggtatctgtgctcaaggccacatggctggtaagtggcagagccaggacctggcccaggcagtctcactcgtggccctgctctcagccctaccctatgttgccccttgtgagctcctcagggcagggtctggggcctccgtatcactcccggggctgccctgcccaggcccggcaggcaccagtggcacctggacaggtctgggctggctgggctgtgccccttgtatacagtgtacccccgccaggctacagaaacaaagctagcgtggagggcactggacaaccaccctggaggcatctaggcctgggagagcccctggggagctggatactggcagccagggtggccccgggatgcaccctctgcccctcagctcctctacccttggtgtcttcctgcagagagccatcaccatcctggacacggagaagagcttccttaagtgcatgaggaaggccttccgctcaggcaagctgctgcaggtggggtacacacctgatggcaaggacgactaccggtggtgcttcaggtaatgcccaagctccacctgaatcagggcttgggagctttggggctcccctgtggacacagagcctgcctcagggcctccatgaggggctggtcatgagcacagggggctctcccaatgccagctgtagggattggggccgtcctgagctcagctgtgggcgtgcacaggggaccatcttagatctcatctggtggggcccagacactaaattctggaaaattcgaggtgtccagaaggggccgtctagtgagcagcgtcagagcctggcatccaatatgtgaagtccccctgggcctcacagtgtgctcagagatcacatctttgaggatggtgtccaaaaatcaagtcctctctgccctccccgacccaccacatctccatcctgatgggtgggcttcttgggcttggcctgtgggcagagcccttggcccgggaagctgggcacagctctcaggctctcccgaccccttaccctgcagggtggacgaggtgaactggaccacctggaacaccaacgtgggcatcatcaacgaagacccgggcaactgtgagggcgtcaagcgcaccctgagcttctccctgcggtcaagcagaggtgaggcgtgagggccggtgcttggcgcctccttggctggtggcctgatgttgggcagggggagctttgcaggttccccacgccttgccgggttcctcatccccccaggacccgggcgctgtggcagctcctgacgtcggccatgagcacatagtcacgggctgacttgagcacctcactcatgctgtcacggctgacggctgatggctgacggctcactgggcccgtgcaggcggctgtgccagcacctccagcccaggcacctgtcctcagcgccccaggggacgcagcccagccccgccctgcctccttgtatgggctgccctgcctcctcagccctgttcctcactctgcacgtgtgcatgcgacgtcctagctctgagaggctgtgcggacacaaacaggcagacgggaacacttgtcactcatggacacatctgggcaggtggagaagaggggagggtgagaagaagaaaggggatgccttgagcagaaaaaccccaaggaggccgggcacagtggctcacgcctgtcatcccagcactttgggaggctgagacgggtggatcacctgaggccgggagtttgagaccagcttggccaacatcgtgaaaccccatctctactaaaaaaaatacaaaaattagccaggcatggtggcaggcacctgtaatcccagctactcgggaggctgaagcaggagaatcggttgaacctgggaggcggaggttgcagtgagccgagatcgcaccactacactccagccggggcaacagaacgagactctgtctcaaaaaaaagaacaaatagaaaaaccctgagaaaaattactaccagaaagaaagctgtttaacagttactggtaaacatttaatagaaaacattaaataaatgtctaattgaggacgtttacctagaaatgaaagaggcatagtttatagtggacaaattttgagttataattacaaccctgaacactttgtttttgaattactttgtatttaattgtaaaaaattgtggtaaaatatctatctcctaaaacttgccatttaaatccttttgaagtgtacagtttagtgtcattaagtacatttacattattgtacaacactcaccactatctatttccagaactttttttttttttttcctgagatggagtctcactctgttgcccaggctggagtgcagtggcgtgatctgggtttactgcaccctccgcctcccgggttcaagcgattctcctgcctcagtctcccgagtagctgggattacaggtgcctgccaccacgcccggctcatttttgtatttttatagtagaaacgggttttcaccatgttggccaggttggtctcctgacctcaggtcatcccaaagtgctgggatgacaggtgtgagccaccatgccgggcctttttccagaacattttaatcatcccacacggaaactctgtgcccttaaaacaactccatgacccctccttcctgaccgcttggcccctcctccctgaccgcttggcccctcctccctgaccgcttggcccctcctccctgaccccttggcccctcctccctgaccccttggcccctcctccctgaccacttggcccctggcccctaaccccttggcccctattctgttttctatctttatgaaagtgggacagagacgttaaaggttgagtagtactgggggcctcagaggcccagagaccttcttaacaccctttaaatactctgagccactctctgatcaccctcatgcagtcacaccatgagctagcacagctcagctcttagcaaggacctgtggggaactcatctgccccaaagacttctgggcttccacccccatgaatccttcctcctcttcccctgtgctctgatccacagattctagctgcttccgctgcccagcttttgatttcttcttctttaactcagaggcaattccatgctcttcttagactgcagctcaccgcgttgtagttggggaaatgtccctaggcagaaagttagggagatcacagggctccccttgtgaatttcacttctcttgggaattgcagtttttatttattttattttatttttgagatggagtcttgctgtgttgcccaggctggagtgcagtggcacgatcttggctcactgcaacctccgccttctgggttcaagtgatcctcccacctcagcctcctgagtacctgggactacaggcgcctgccactatacccggctaatttttttttttattatactttaagttctagggtacatgtgcacaacgtgcaggtttgttacatatgtatacatgtgccatgttggtgtgctgcacccattaactcgtcatttacattaggtatatcttctaatgctgtccctccccactcccccaaccccacaacaggccccggtgtgtgatgtcccccttcctgtgtctgagtgttctcattgttcaattcccacctatgagtgagaacatgtggtgtttcgttttttgtccttgcaatagtttgctgagaatgatggtttccagcttcacccatgtccctacaaaggacatgaactcatcattttgttatggctgcatagtattccacggtgtatatgtgtacacctggctaatttttatatttttagtagagacagggcttcaccgtgttggccaggctggtctcgaactcctgatctcaggtgatctgcgcaccttggtctcccaaagtgttgggatgacaggtgcgagccaccgtgccttgcctttttttaatgtttaattttaaaaaatctttagctgctaagttggtgttatttgagggactgccgtttttcactgcctgatgtcctatctctgaaaaacgtttgctgcctgtatgttgcctattttgtgatcgttgacagcacgatggctagcccagtactagatactccattatagctggaagcgaaaatctattttatcaaaggctcatttttagaaaactgctcgagggttccattggtttttccacaggcctcctgcgatcgtgtgattttcctgtgagtttagttggaagcaatccctgcatcctgtaataatgcttattgatgatctctttgtcagttgttaactggtctaactttgccagagagctattgaaagatagctttgcgtgtgatttgagtagtttttcttttcttttcttttttttttttttttgagacggagtctggctctgtcacccaggctggagtgcagtggcgcaatcttggctcactgcaagctccacctcccgggttcacgccattctcctgcttcagcctcccgagtagctgggactacaggcgcccgccactacgcccggctaattttttgtatttttagtagagacggggtttcaccatgttagccaggatggtctcgatctcctgacctcgtgatccgcccgcctcggcctcccacagtgctgggattacaggcgtgagccaccgcgcccggccttgagtagtttttcaatgtcactcttgttgatttagtgacatcctacatctttgacaagatttgctatttcacttggcagttgatttgtattatgtttgcatgacagtgttggcggtttacaacactgcacattcactgtgatatttataaagacattgacccagtggcaggggtatacacacccatgttaactggggcagggatgggggatggttggaggttgcctgatgtcacctttataatttttttcttttttttttttttgagacagaatcttgttctgtcgcccaggctgtcacccagtgggcctggaccccagatcctgcctctttggctggtgctcgtcacccagagctgccctggtgttgagccactcacaggacaggcctcggcgttgctctgtggagaccctctctccctcccgctggggcagggaggagatggaggccgagaggggcaggcgatgggctctcctgaggctgcaagcaagtcggggtgggatggaggaagagaatttaaggaacagcgagagtgcatgaggctctttgagtagttgagggaggaggacattgcaccgatccaggtgcctcaggaagcactcgcatgcctgggcctcgttttttctttctttctttcttcttcttcttctttttttttttttttttttttgagacggagttttgctcttttcgcccaggctggagtgcagtggcacgatctcggctcactgcagcctgtgcctcccaggttcaagtgattctcctgcctcagcctcccaagtactggggttacaggcatgtgccactatgcccggccaatttttttttttttttttgtatttttagtagagatggggtttcaccatgttgtccgggctggtcttgaactcctgacctcaggtgatccacctgcctcggcctcccaaagtgctgggattacaggcatgagccatcgtgcctgtcttggacctccttttatctggagacttgggaggccaagaagtgaatgtttgttttgttgcatccaaggtagtaatagtgttacccttcagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatatatatcgtgtcaagtgtaaagtttgtggcaggaaatgggctggcatagctaattggctctgtgtaggctgcttgtggatgcgtgtgtatacacatgggggtgtgtgtgtgggtgtgtgcatgcatgcatgtttgtgtgtgtgtgtgtacgtgtgtgtacattcctatggttgcattcctgctataatgcagaagggaatagttgcaacagagaccaaatagtttgcaaagcctaaaatataagcttacctaaaatataaaaagcttacctaaaatataaaaaacatactatctggccctttacagaagagtttgctgactcttcctttgtagaatagagcttaagaaacagatactctgctctccctctccctctccctctccctctccctctccccatggtctccctctcccgatggtctccctctcccgatggtctccctctccctctctttccacggtctccctctcatgccgagccgaagctggactgtactgctgccatctcggctcactgcaacctccctgcctgattctcctgcctcagcctgcccagtgcctgcgattgcaggcgcgcgccgccacgcctgactggttttcgtatttttttggtggagacgggtttcgctgtgttggccgggctggtctccagctcctaaccgcgagtgatccgccagcctcggcctcccgaggtgccgggattgcagacggtgtctggttcactcagtgctcaatggtgcccaggctggagtgcagtggcgtgatctcggctcactacaacctccacctcccagccgcctgccttggcctcccaaagtgcaaagcttgcagcctctgcctggccgcccatcgtctgggatgtgaggagcccctctgcctggctgccccgtctggaaagtgaggactgtctccgcccggccgcccatcgtctgagatgtggggagcgcctctgccccgccgccccatctgggatgtgaggagcgcctctgcccggccacgaccccgtctgggaggtgaggagcgtctctgcccagccgccccgtctgagaagtgaggagcccctccgcccggcagctgcccctactgggaagtgaggagcgtctccgcccggcagccaccccgtccaggaaggaggtgggggtcacccaccgccaggccagccgccccgtccgggaggtgaggggcgcctctgcctggccgcccctactgggaagtga

SEQ ID NO: 12809 - DNA, 27236 bp, Human
tacattgtttgtcttgactcttttctgagtttttctgacattcattttctgtttgtcttaaggttatcctttacctttgcttctcttaactttttccttttgttgatccactgttttcctatgagctaccaaaaaatgtaattcagagctctgtagtctaacagtcacatttccttaaaatatggccgttttaaaaattttaaacataattgtaataccattatataatttctcttagggaaaaaataattcaaaagactgacttttcagtaatgcaaagctttggctacaacatgaaggtcaaagctgcaattaataaccctgatacttcaacatttttattttgaaaaaccctctaaaggatttgatttgtaaaaatatgtgtgaaaatttagagggtccaccaccatttacatagcatctcagccgccattctgtctggcatttataagacatatcaaagaaactttcatctgaagaagtccacttattctcgtctttattaatcttaaagcttaagtagtttacatagtggatcttgtctagaactattaatagtttctttggtgtattttctcaaattcatctttcttggtgtgcaaaaacatcttcctgtaactccagccacctcttatagcatttctgtgtcttttaaaacttgattatatctattttttaaaatccagtctaaatctttcttgcctgcaactttttttatacttcctttgccactgtatttgtccattgtatccttgctttaatctatcattggtgaaattgatcctgtaatagacttgtaactactggatattgtctggttttactgttaaagtttcacatattaagctaccagtgctgagtgtattggtgatcaaaaaatagaaaatttaagcaatgcctcatagaattctgtaccaaacaacttcagatttacctctgtatgtagttgtgattataaaattgtttcactgaagatgttatgtatatctttcaactaatattttatgacaatcgtgatataaaagatttggaaattcttatgtgacagtttctgaggtacaacaataatgatttaagaaagaaaacaatttcatctagaaacacgtcttgggggatcataatcagaacataaatttaccaggtgatttgggctattcttgtgaaaagtttacaggaaactgtgtaaccaagatctcattttcatttttacctgttttgtgctctagatgtgctgtagccctgagcattaaatgagtactgatggatgctgatttggggagttcccttctttaaatcacctgtatttcctgtacctaggttttttcttgggagggctcctattcctgtactgaccagagttagttctccttactttaaaagactagatatgaagtaaacactgcctgatgtaggatggtcagtaagaaggcaattagttgtataacttaaatttgggcagcaatccttaaaactataggaaatgacttatttttcttattcacatctatcttcacctcaaattgattttgctgtataaaggtctcagctattatgtttggtcttatatcttacattaggtacttgaaacctaagcttcatttacttgtgattttacttggttctttctgatagtgataataggtctcattttccaaagcacagtacaactgattcatctttgacttgctgaccttgatttttttgtttttagtcttctggaacttaagcatcatactatagggtgtatttttattcttctaaaagaagaaacccatctatatttttactgaaattttgatgtactcagacatctaacctttcaatttacatgtttttaaactcagtatgaaagtccctttaatagttaagctttagcatgaaatactactttttaaatatctatatgcaggctctgcatacatcaggaatctgtttaagatatgtaataaattccttgtaagtttgagatcttaaatgttttttttttaaatcaacatgatgcataagtttttttttcttaaaaaaacggcatctgcttaaagggatttatgactaaaattgcttatttttctacagagttgtctgctggttctcagcttgaagaagattctgcagtccttattgatcctttttcttggcgttaccattttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggtgagttaactcaacagatgcttctaatttcttttacattgtagtgcctatttacctatatctttgactctaattctgtagtctgatgacattgagttgatcaagcatttttaaacttttgagaacacttactttatttggaaggtaattgtttttgagcattttaaaccagggctttacattaatatattctgcctagattacttctggccacaaagctatcatccactgagattatcttgttggtttttggcatcaatatgttcttcttaatcatatatttaagcaggttttttttgtctgctttgttgaattgttttaagtattttttttgcagtcaatgtgctctgccattcaggatgctagatttcagctctccatctgtcttgattgctgatttgtatgtagtaaagatgtattcttgaacaattctctttttttccttatctgtggctacagggaaagagttaatgtagagccctggtgtttgtttcagtatgtttcatattttagattagttcattcttccttttttaatttccctttaacacaaactctcatactatgactgaaatttttcatcattttttttctccttttccacaactttcttaaacatacttcaaaactcactttttattatcccatgttacatctgtccctttagagacttggacaaatcaactactacagtatcctgctctgtgttcctcataaacaaattctttttctgagttaggcttagacttctgaaatagtcatttgaaaagaaaatctaattctcctttgctttaattatcacatctggcaaaatgggaactttttcaaaatgcccttttaaatatgttgtcctttctctttcaactttttcagtgttactcattctgactttttttcccccaatatatggtgcagttgacttaaagtcattgttatagcaccccactagcttgatctataatctgtgaccgtccattttttcctgatgtgctctacttaactggaacaagttgctgccatgaaattgatttgatggttactgttacagggtttttctttacagtaacatctggaagggtcattttcttttcatagctaatcctttgataagcattttttagtaaatgagtatggatttttttttagtagactaaatcataccattgtttttaatattctgttaaagagtattaccagtcactccctttccttgtgtttggatctcagtatttttgtcttttaatctttaatctgtaccaaagtaaattaacataaatgctaaatttaggtttatttaaacatttaagaagatgtattttcattaagaaatacaaccccagactcacaaaagccagcaaattttaattggtatatgttttgggtgttaccttttcctaaatttgttggctctactaaatatatcatggaattcattttagtttctgatcagcactaaactttaaattttaggtcccgtgtgaattcatagaatgaaaaggtccattaaacactggtgactccaattttttctgcgttatttcttgcctgtttataaggaaataatagcagaaatgtcagtatgaccaatattctcagaaagggtctctaaattctgaggaaaatagatagttacaagtgtctcaaatgagagtgatgtgaagggacttaaaaaatcttcgctactggagtcattaagctgttgggacatcatgaacacaatggaaccatgagaggacttcgagaaaagtttctgtttttatgtatgattatgcttttttccttcaaattttgctactttctagttcctgaagaaggctaataacttaaatggatctaaattaacaaaagagcagtttttacatattttgatgaaactatggattcaagagtaagatacactaccctagtgcaagaggtacttttagcctgtaaaaatgcttaggtcctagctagttttggtattctgtcaaaatactgagtacatttgagaactattttagaggccttttgtttaattctgtggtttaaatgtgtaaattggaccaactttaagaagtttaaacacatggattatctgaatttctagttttctagttgctttactatgttttttacgtatatgcattatattgaaaaaatctttactcactttagcagtggaccctctataaccgctatagaaatgaccttagagaaaatttctgtgatggaagtagataatgaaaaatttttaaacatttaatcctgctctctggtattgctgcataacttggaaaatctgttctttttacttagtggtattgttaaatagtctacatgatcaaaaattcttactgtgaagtaagaaacttaagttgaaaataatttgtcatggagtgtcattatttttaggtgacttaaagtgatggtggtgtttttatttctttataggtcattttaggtcatcaaattgcttttcttttcttttctttttttctttttttttttgagacggagtttcacttttgttgcccaggctgtaatgagtgcaatggtgcgatctcggctcaccgcaacctccgcctcccaggttcaagcaattctcctgcttcagccttccgagtagctgggattacaggcatgcgccaccacgcccagctaattttatatttttagagccagggtttctccatgttggtcaggctggtcttgaactcctgacctcaggtgattcactgccttggcctcccaaagtcctgggattacaggtgtgagccatcgcacccagtcatcagattgcttttctatgcaatctcaagctttctcagcttcctttcacttaaagaaaattacccactacagcactttggctgtcttgtcacttgagtttatattaagttatacttttttctgccattctgtaagtgcttcccaaattcttttttttctctctataaggtatctcagatacatcaaggtgaatgtagttttcctacagaaatgtctgaatttaaaaagtgcacgaatcctttattaatctgattttacaggagttacctcagtgtagagtccagggatatatatttttataaaactctttcacttagtccccaccgtaaaccaaccagtaatagatcagtagtacagattagtcattggatgagtttgggaggtatgtgattgattttttgatcttggccttccttttttcactttgaaagaccagacacacttttcccctaagtttgaacctttaaacaacgtggaggattggatataatttctgttcagctatgtaccctttctagctcctatgaaatagaagcatgcgtagtaggataacatttatttctctcccacaacttaagaatattttaagtaaaatctgaatatttttagttcagagaattgtaagtcgttaattggtatttgtttaattaatcctttttttttttttttttttttttttttttttttttgagaaggtttctcgctctgtgtcccaggctggagtacagtggcgtgatcttggctcactgcatcctctgcctttcgggttcaagcaattctcctgcctcagcatcccaggtagctgggattacaggcatacatcaccatgcccagctaatttttttgtatttttagtagagacgggtttcaccatgttagccaggctggtctctaactcctggcctcaggtgatccgcctgccccggcctcccaaagtgctgggattacaagtatgagccaccacgcccagccaaggcttctaaattttgtgaacttacctgtggctcctctgacttagagccatttttattttattttattttattttatgtttttgagaaagggtcttttgctttgtagcccacgctgaagtgcgcttaggtgttcgcagctcattgcactctctaccacccaggctcaagtgacgcatgtaccaccaccacatctggcgtttttttcttgatagagatcgggtttcactgtgttgcccaggctggtctcaaactcctgggctcaagtaatctgcctgctttggcctcccagagtgctgggatcgtatgcgtgagccactgcacccggcccttacaagccattttaaaactggtccccaagaaggcagtggtccattactttccagttgaaactttagatatcccaaatagctgatgattagagagccagctggagagatcttgagttccttagctattagccattattttaaaaagataatctagctttgagagacctggaaatagtagtttatagcttccaacattttaaggaaggtaccattctatttggatgagttccattttagtttacaggattttatttttatttatttatttatttttgagacagtttcactcttgcccagactggagtgcaatggtgtgatcttggctcactgcaacctctgcctcccaggttcaagctattctcctgccttagcctcccaagtagctggaattacaggcacctgccaccatgcctggctaatttttgtatttttaataaagacagcgtttcaccatgttggccaggctggtcttgaactcctgacctcagttgatgctcccaccttggccttccaaagtgctgggactgcaggcctgagccaccgcacctggcctttcacaggattttagataattttactagagcataggaatgtacctaaactgttgtcaggtaaatataaaccagttttttttttttttttttaggagctcatttataaaataccaatccgcagctttttgaaagcacgtatcttgtaatttggtaccttggtaccttactctaatttagttcagctctcagtgagacatccccctttaaaaacacatcgcctgaccatgttttatattccaaatataattgtattgggtagtgtgggtgttacagaaattacctcaatttgtgggagtttgtgaaacatcaataatagttgtaaagcaggaattgtaaaacaagactgctttataatcagtgtaataatagttcttttttttttttttttagcacattccatgtgcctggcaagggtctgataagcagtttacctttattgactcatttgcttttcacaacaaccctatgagactcttgtcccagtgaatttaaataacacggaccaaagattcacatctttgtaatttgggagtgaacctaggcagtctaatagcagagcccactttttgtaacttctctttcttacattgcctaaaaagttaactcatttatatctgcatttttttcctaaagaaatttatttgaataaaataagagttacttcaatttaaagtaaaccataaaagagtaaatagtgaaagaatgtcatgtttcccaccctaaatttggaaagaggcactccttaaatttgcttattttggggaaatacaaagggagcataatattttgataaatgggattcgttttctagaaaagccattcctgttgaatcatgttagcattttatggtaatgctaatcatggtgtatttttcattcactgtgtatttagtaggtagtaaacctggaacatcctcaaaagctggatgtgattaaagttttagtttttgtttttgtttttgttttgttttgttttgttttgagacggagtctttgtcatccaggctggagtgcagtggcgcagtctcagctcactggaatctccgccttttgggttcaagagattctgctgcctcagccttccaagtagctgggactacaggcgtgtgccaccacgcccggctaaattttgtattttttgtagagatggggtttcgccatgttggctaggctggtttcaaactcctggtctcaaatgatccatccatctcagcctcccaaagtgttgggattataggcatgagccaccatgctcggcctaaaagattctattttaactaattgttcacatttatagtatatagtttctagaaaagtagatataaacatggatgttttattcagagtgctataaagtagcatacaatgaatacttcagtttggtccacagtaaaaattaataagccttgctgatctcaaggttagttactactcttgatctttattaactctatatcttttccctgtcaaatatcttaagtatgttgacaagttaatccagtttttccaagaatgtgcatagcgtatttgagggcaggatcaagcctcaaggattcagagaaatggttttaaattaaatcaatgtgatttagtgaatgggcaggtgtttgtacagcctatgatactgcatagacattaatatcctagagtttgaatggttcagatgaaaatatttcagctttatttttgttaattctactaatttactttgctgcaggagtggagtcaacatatcaatggagcaagtcacagtcgtcgatgccagcttcttcttgaaatgtaggagtttgaaatacctttaaaacatccttatcgtgaatcagaatcagccattattggtttttgggagttcatcatttacttgtaatatccacaatgttaatatcacatagtggtactgtatggacaatactatttacaagtaaaatgtttagatctggaaatttcatattgaatattagatgcagtaataatattttgttatttaacatttctaggatacatatatattggtcattatacaaattggtgatttttactagacatagtgaaagatagtatttgatatgtagagtggattaaacagtagcatttttaataatacatgctctaaaaatgtaaaagatacggaaaagagggtaggttattaaaagattctaattcattgtccagcaaaatccttggtgatgaattttttttttttttttgcttttgagatctttggttttgagttcaggctgctaccatgaaatggaattcctaaagaaactccctgcttaagcagcacacagtgcccattgttcactggagttggaattttcacatatgcctaactctgttggggctattctttctttctaatgtcacaactcaactgtgctcttggtattaatattggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaatcctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgataaaattcactttggttaacaatttttagaatatatattatgtagtaatttgtattcttttattgttaatgtagactttgacctagttacttcacagatactctgaaagattgaagtggttgtggtcatatattggggtgctttaacatttaatcttaattctttccaatggacctctttattatgatttatattttatgtcttcactttactaggggtgatccattcatgttgcagcagtctacaaatccagcaccaggaattctgggacctccacctccctcatttcatcttgggggaccagcagttggaccaagaggaaatctgggtaattatataaaattcatgttacttttccctacagagccgttactgaaaatttttctttttatttatttatttgagatggggttttgctcttatcgcccaggctggagtgcaatggcacgatctcgactcactgcaacctctgcctcctgggtgcaagcagttctcctgcttcagcctaccgagtagctgggattacaggtgcccaccaccacgcccagctaattttcgtatttttagtagagacggggtttcaccgcgttggccagactagtctcgaactcttggcctcaggtggactacccgcctcagcctccaaagtgctaggattgcaggtgcgagccactgtgccaggccgcaaattttacttatttattttagacagattctcactccgtcactcaggctagagtgtaacggtgcaatctctgctcactgcaacccctgcctcccgggttaaagctattctcatgcttcagcctctcctgagtaactgggattacaagtatgtgccaccacacccagctaatttttatatttttggtagaggcaggggtttcgcggtgttgcccaggctggtctcaaacacctggcctcaaatgatctgctcagcctcccaaagtgctgggattacaggtttgagtcaccacacccggccccattctgaaaattaaaggcaatgattataggtgaaagaaggctcattcaaatattacacagaaaaaacattgcatgaaaagtgatggtaatcatatatttgtaagagcttttcatttgtgtttggaagatgcacgtttttcagtaaaattgcttctttaagcaagtatagtgattacaagactgaaaactttctcttcccataaaggtgctggaaatggaaacctgcaaggacctagacacatgcagaaaggcagagtggtcagtaatgaagcttttggttttactgtatttatgatttttgggaatatgatttgacctaaatccttactagttgagtatgtatcgtggtccttatgggaacattgctgtaatttgaaaacaatcacgtttttctatggctttgataacagttaaaactttaaattttgtatgcccatagtccagtgaggtcaccttaattcagcatcttggaagctttgctgtccagttacgcgtacaatatttaatttaaaaatcactacagagagtatgttttgacactttgaagtagtttaaccgtttggttatggtcagaaagaacttacccagtgacgtttgatatgtagctttaaaattctctagaatgttatgagttgttttacttacactctcctggttaattatagattataaaaagtcctaatgcgtaattggtttcatattgctttaaagagacttaattgcttggtttttttcccctaatggataggaaactagcagagttgttcacatcatggattttcaacgagggaaaaacttgagataccagctattacagctggtagaaccatttggagtcatttcaaatcatctgattctaaataaaattaatgaggtatgaattgaaatattggtattattcatttattcatgccactaatatatgttctgcaagaattaaatgattttgtattagaaaaataaaactcaaggtaatcttaagtttatcaaatgcagaatgtagtagaggaaaaggccagtagttgatgaatataatagggtactaatggattattagtaactataaattatgatccttaggtagtaattgtcattatactactataaaagttgtaaaaggaaaattctgtggaaagccatttcagatctataccaaaatgatggtttcaagtcattatttttagtccaattggcatagtaaatgataaagtaatgcagtagaaaattaatctgaggtggcctttgtaataaaatagcaaattggcaacactgttttttggggtttttttgtttctttgttttgggagtcggagtctcgctctgtcacccaggctggagtgcagtggcgcgatctcagctcactgcaaccttcgcctcctgtgttcaagcgattctcctacctcagcctcccaagtagctgggattacagccgcccactatcatgctcagctgatttttgtatttttagtagagatggggtttcaccatgttggccaggctggtctcgaagtcctgacctcaggtgatccacccgccttggcctcccaaagtgctgggattacaggcgtcggccattacacccggccaacatttttgttcgtttgtttttgttttgttttgtgtttgagtgtcactcggtcacctgggctggagtgcagtgaggttcactgcagcctccacctcccaggttcaagccattctcctgcctcagcctcctcccaagtagctgggactacagacgtccaccattacgcccagctaatttttgtatttttagtagagacggggtttcaccatgttggtcggccaggatggtcttgatctttcaacctcgtgatccgcctgcctcggcctcccgaagtgttgggattacaggcatgagatactgggcccagcctcttttgttttgtattttgattcttgaaagtattttctacttaatgattaaatatatctgaaaagatttggggcattgttattttttaggaaaaaaaatctttagttcaatgtgagaaagctgattggaaaaaacagagaaataactttttgtataatttcaggcatttattgaaatggcaaccacagaggatgctcaggccgcagtggattattacacaaccacaccagcgttagtatttggcaagccagtgagagttcatttatcccagaagtataaaagaataaaggtaatgtttatttttttcaagctgtatatcagtttaacaaatgattttaatagttattaactgtggttatttcaaattattgctaaggccaggtgtggtggctcacgcctgtaatcccagcaccttgggaggccaaggtcagaaggattatgtgaggcccaggagttccaggcaagcctgggcaacatagcaagacctcgtctctataaaaataaaacaattggtaaagactaggatgtttttaactgttaactaataattattgcacatttgtccttttgttgttgttatttattaaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggtaatatacataaggaagttttagagaagataatttattaaaatccttaagatttttcaatatggagctgggcgtcattcctcaacctgtaatcccagcagtttgggaggccaaggcaggcaaatcacctgaggtcaggagttcgagaccagcctggccagcatggtgaaatcgtatctctattaaaaatacaaaaattatccaggcgtgatgtgcctgtaatcccagctacttgggaggctgaggcaggagaattgcttaactggcagggggcggaggttgcagtgagctgagattgcaccactgcactccagcctgggcagcagagcgagactcccaactcaaaaaaaaaaatttgcttttttttttttttttttttttttttttaaagtatatccctatttttagtgatgaaatctggaggactagttgtttgcttttcttttcttttttttttttttgagacagggtctcaaaaattaatatttcatacttttttttcttgtatttaaaaaatatagagttagccagtcgcagtggctcacgcctgtaatcccagcactttgggaggcggaggcaggcagatcacgaggtcaggagattgagatcatcctggctaacacagtgaaaccccctctctcctaaaaatacaaaaaaattagctgggcgtggtggcgtgcgcctgttgtcccagctgttggggaggctgaggcaggagaatggcatgaacccgggaggcggagcttgcaatgactcgagattgtgccactgcacccatcctgggtgacagagcaagactccatctcaaaaaaaaaaatttagagttaggctggatgcattggctcatgcctgtaaatccctagacattgggaggctgaggccagagttgcccaggagtttgagaccgccctgacaacatattgaggccacatctgtacaaaaaaaaattttttttaaccaggcaaagtggcatgctcgtacagttttagctacgggagtctgaagtcaggtggaacacttaacccaggagtccaaggtttgtagtgggctatgattgtgccactgtacttcagcataggcagtggagtgagaccctgtctcaaaaaggaaataaggatgaggagaacatcttttttgtttttctttttttgttttaaacacttctgtaattcagcattgcaagtttgtgttcttccagacttttatttttcttacactattttaatatcttaagcttattacttttttttttttttttttttttgagacagagtctcgctctgtcaccccggctgtagtgcagtggtgcaatctcagcttactgcaagttctgcctccccggttcatggcattctcctgcctcagcttccccagtagctgggaccacaggcacccgccaccacgcctggctaatttttttttttttttttttgtatttttactagagacgggtttcaccatccacaggatggtctcgatcccctgaccttgtgatccgcccgtctcggcctcccaaagtgctgggattacaggctgagccaccgcgcccagccagcttattacttttttgcagagtgtatatagatggcttagtatttggcactaaagtgattcttggggattttgtaaatctgacaggttggttttttggtttttggttttttctgagatggagtcttgctctgtcgcccagtctagagtgcagtggtgccatcttggcttgctataaactccgcctcctgggttcaagcagttctcctatgtcagccttccaagtagctggtactacagtaggcacactccaccaggcccagctgatttttgcatttgtagtagagatggggtttcaccatactggtcaggctgttctcggaattcctgacctcaggtgagccacccgccttggcctcccaaagtgttgggattacaggtgtgagccactgcgcccagccctgatattcagtgaatttttaactctgtgctaaagattaaaatttttagccgggtgtggttgctgtcacctgtaatcccagcactttgtgaggccaaagcaggaggattgcctgagtccaggagcccgagaccagtctaggcaacatggcgaaactgcacctctacaaaaaatacaaaaattagccaggcattggtggtgcatgcctgtagacctagctactggggggctaaggtgggaggatcagttgggcccagtacatcaacgcttcagcaagccaggattgcgccactgcattccagcctgggtgacacagtgagaccctgtctcaaaaaaagtaatgaaaattttctaaccagtaggtagaatacataataaggttttatacaattttgtaaaatataatgtgctttgtggtttcttttctttctttttaaggcttttattgagatggagacaagagaagatgcaatggcaatggttgaccattgtttgaaaaaagccctttggtttcaggggagatgtgtgaaggttgacctgtctgagaaatataaaaaactggttctgagggtatgtagtatttgatttgtcatcatttaacagcttgtttttacatatttaaagccacaacattcttttaaacatttttgtatgctaaaaatacaggattattgaaacctattgaaataagttattgaaagagaacaacctttttttctggtctttaatggcagaagtttttaaacgagtcttccctaaaggacaccttcattgctcttatctgtttaagtttttaatagcgttctgctaccagaatgttttattttccacttctctgttggtatggtcatgatgaatgtctgtaggcagcttaggttctcaaataaggttacgggaattgaataagctgagttgattatagggattgtctccaattattaattcactggataattgtgtattctgcaaatgtgttaacttctgcaaaacttttgtcttttagattccaaacagaggcattgatttactgaaaaaagataaatcccggtaatttcattttgtttttcatatgtgtgagtatattcaactttactttttcagacaacaaattaattgtggtgtgtccttttgatttcagaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtaaagaaagatacattgatttgttttaatagaacattagatcagatcagtatttcaagttatttacctaagcaggatcagatagaattatatgatttaaatcagaaaataaatcagatatgaaccagaatataaacatttaaatctaaactctgcaataaataattaaataagacattttattatagtgggcaaaaaacatcagctcaaagaggaaacttttcagtaaaaatgagggagaaagactcaaaatatatgtgcttctgtattgtagtggtgtagtggtagcatataggtaggcagccttatagtgtagctttgaaaaaaaaaatacaggacgtgagtttgcagtaagttaactgacccaacatagttaaaacttttgccactcattcaaaaattattgaataatttttcctatttgagaaatgttggcctggtcagataccttagtatcctttaaaacaattttatttgaacaagtaagtcatttagaagccatgtataaagtgaatataaatataaaaatacacacatgctataaagaagagtaaacaaaggacccacattgagctgactgcctagcttaaggagtagggcattaaaatgcctttgaggcaaactttttatgttaaatggctcataaaatgtcggagtcaggcgggcccagtggctcacgcctgtaatcccagcactttgggaggcccagcagatcagttgaggccaggagttcaagaccaacatggtgaaaccccgtctctactaaaaatatgaaaattagccgggcgtggtggcacatacctgtagcagctacttggaaggctgagacaggagaattgcttgaatctgggaggcagaagttgcagttagccaagatcacatcactgtactccagcctgggtgacaagagcaagactgtctcaagaaaaaaaaaaagtagagcgaaatgagatttttgccatcctattccatattccattggttccttttatgcaacattcaactcaaaaccaatatttacctcagtttttatttgatggcttggtcaaataacttcattaatttttctcactagagctgatcattatgtttacatttgtaaatgctaataattactgatgtttatggcatttaatgccatacgtttttctaagtttaaatttattaatttaatcctcacagtaaccatatgcatctcatactgtgatctccagtccataaatgaggaaaattgaagtatggagaagttaaataatcccatactgcttataagacacagagccaaaatttaaacttgggcagtcattcttcagagcatgattgttttttttttttttttttttggagacggagtcttgctctgttgcccaggctggagtgcggtggtgtgatctcagctaactgcaacctccacctcccaggttcaagttctgctgcctcagcctcccaagtagctgggattacaggtgtccaccaccacacgaggctaattcttgtatttttagtagaaacgaggtttcgccatgttggcctggctggtattgaactcctgagatctcagggtgatccgcccacctcagcctcccaaagtgctggaattacaggtgtgagccaccatgcctggcccagagcttggttttttagccattacactgtttgagtatttgctctaaagagtaggtatttgcagtatactgtcttagaaaggatattgctcaacttttaccaaatcaagttttttacacattgcctagcagcattgtagtctcagaaaagataaaatatgaatattcctatctcatttaacttctgctctttgtgtgaggcagaccttccattttttagttttaaaataagctaaattatttttcaaattatcagtaattttttggaagaaaggaagaagttactattttgagccaatgaataaagacaaagacgcggccgggcacggtggctcacgcctgtaatcctagcactttgggaggccgaggtgggtggatcacgaggtcaggagatcgagaccatcctggctaacacagtgaaaccccgtctctactaaaattacaaaaaaaattagccgggcgtggtggcgtgcgcctgtagtcccagctactcgggaggctgaggcaggagaatggcgtgaaccagggaggcggaggttgcagtgagccgagatcgcgccactgcaccccagcctggtcgacagagcaagactccgtctcaaaaaaaaaaaggcaaagacgctatccgtttcccttcaagtaaagcagacagaagggatgctgcaggataattgttgcagagtaaatttgtctttcttaacagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtgagatttaagtctttgttcttcaccttcctcactctcctcaaaacaaactcttaggttttaaaataagattttaaagttggtcttacataagctgtgatagcattttaaatttgctttgtttctatggggaacaatttataaatcttaattgatatattttcctctcatgcatgtctctgattttgtattattttctgttgttattccacaatgtgttcccttttttcgtaaaatttcttgcaagttacacgcttttgttttgcttttctgtgttgtttttctgtattatatttctttttttaagaatacagttaggtgagacctcaaacatcaattaggtaaaagcaaaatatggttcggtttttgttttttatcttaggctgtattggacttctcaaaaacatgttgtttcatttaaattatgttgacaggtgaaattgtgaatactaaataaaatcttcagtttaatttgtaagaatgtatgtttgtatttctaggtatagactatgtgatacctaaaacagggttttactgtaagctgtgttcactcttttatacaaatgaagaagttgcaaagaatactcattgcagcagccttcctcattatcagaaattaaaggtaaggttgaatgtaaaacagttcttttgtgaaaacttaacaagttatggaaataagtggggtatataagtaaaatgtgtatagtgttctctctagactcagtgcagtgctttctcctgaagataactttttatttacttttttttttttttttaaagacagtttctctcttgttgcccaggttggattgcaatggtgcaatcttggctcactgcaacctctacctcctgggttcaagcaattttcctgcctcagcctcccaagtagctgagattacaggcatgcaccaccacacccagctaatttttgtatttttagtagaaatggggtttcaccatgttggctagcctggctggtcttgaactcctgacctcaggtgatccacccacctcagcctcccaaagtgctgggattacaggcatgagccaccgcgcctggccttttctttctttattgatgggttatcaaaacatctgttgaacctcttgtcatagtttacccttgctacataacaatttagtgttttctaaccatattataaattctgtggtagaattaaacttattcaagtattctcagattgttgttgggctgtactttctctaatttgaaagatgctgggagtctgaatactaaaagtggcatgaccattcatattaaaataatttttaatattgacattattattgacacttcagttatttttatgaccaaaagtatataaagatcaaaagcataaatacataaaccacaacatcactaaagaataattcctattgagatatattgaaatttgtttttgtaattatcagcttctttggactacctattgaaatagtgactgaaacttaaaagtagttgctaaacaagtcaattatagataccttggtttttcacactgctttataataagttaactatagttactcagtcattagatatgttctctgttgactaaatggatgaatgtaatctttaattttggaaataattcaagttcttggctgtgtgtcacttctgtttttttttttttttttaaatgtaactgctctttgccacctatatgtcttttaccatcctgtatatgaagaaagaattgtggctatttgcaatggtagcagcaatgtagtacaaattattttattttatttttttgagacagttttgctcttgttgcccaaggctgaagtgcaatggcgcgattttggctcaccccaacccccgcctcccaggttcaagccattctcttgcctcagcctcctgagtatctgggattacaggcatgcgccaccatgcccagctaattttgtatttttagtggaaatggggtttctccatgttggtcagactggtcttgaactcccagcttcagatgatcctcccacctcagcctcccaaaatgctgggattacaggcctgagccatagtgcccgccctggtacaaatatttttatctgctttgattttaagctgtttggggtcaaaaactatatgtattgtcgagaagaatatggaaataatataaaagattgctaggtgcttcttgtggctccttttattatttccttatattttatttattttttttttatttgagacagaattttgctcttgttccccaagctggagtgcaatggcacaatctcagctcactgcaacctctgcgtcccgggttcaagcaattctcctgcctcaggctcccgagtagctggtattacaggcgtgtgccacttcgcctggctaattttttgtatttttagtagaaacggggtttcaccatgttagccaggctggtcttgaacttctgacctcaggtgatcgcctgcctcagcctcccaaagtgctgggattacaggcgtgagccatcatgcccggcctattatttccttttattaaaaaaaaaaaaaaaactttgtcaccttcatcaagaaactgttaagcattacagtaacttgctaatggtaaattgatactttcctaactggatgtttgtggggtgattttttgttgttgttgtttttctttaaaagatataatggcttttaattcttactattttgcattaactatataaagttgaaattccaatgagatggaaagaagctttggacattttaggttagattttttaatatgtcttttgtactttcattagtgtcttaatggagctcccgtgtctagaaactctagcagtcacaggtttaatggcaggggtcagcaagctacactcgtggctcagtcatctgtttttgtaaggttttattagaacccacagccataatcatttaagtgtcatctatagttgttttagtttataattgagtgcaggattgagtagttgtaacaaagactgaatggcccaatgagtctaaaatatttactgctggccttgcaagaaaatgtttgttcaggtgatttaatgagtagtgcattgaggccagatgtgatagctcttgcctgtaatcccagcactttgggaggcggggacaggcagatcacctgagatcaggagtttgagaccagcctggccaacacggtgaaaaccccgtctctaccaaaagtacaaaaaaattaactgggcttggtggcgggtgcctgtaatcccagctgcttgggaggctgaggcaggagaatcacttgaacctgggaggtggaggttgcagttagccgagatcacgacactgcactccagcctgggcaacagagcaaaactctccctcaaaaaaaaaagaataaaagtgcatgtcatttaaacccatagttcttgaatagtgtcagttcagtgtgactgtggtctttgttttctcatctctaaaaattagggttaattataacatttgaaatacccattttataccttttaccattttttccccgtgccttattgtaatgtcctgaaagtttttgtgtgctaatgaggattaactaattgttgaaaatattgacaaaattatagtttaagtccctaaacttggatataggatatttgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagagattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatggagttcttcagtgtttcctttcagtgatggctttttcatagcttcaactttgttggatttagcaagttgaaggaaagaatgctatgtttttaatacctacatttgagagcatttagaaatcagaaattataataagctgttagtgataaatctgtaacagcccttcgattacgagaaaacctctttttagtaggaatgtttccactcatgtttgctgtaaagtttaagaacatttttcctacggctatgtcagcccttagtttaatcttacattatcctacaaaagtgaatgaaacttctagaagtaccttgagtttgttttacagttcttttttattgaccgattgctagtaaatttgggatctgagagtgtcctttataagactttaattggatagctgtaatattgctttgagtattccaaaaataagttcatttgaaatgttattcaagaatatgaatttccaaccatagtgtgtgtgcatcagtacctctagagatttatttatttattattatttatttttttttttgagactgtgtcgcccaggctggagtgcagtggaatgatgttggctgaattctcctgcctcagcctcccaggtagctgggactacaggtgcataactgccatgcccagctaatttttcttagtagaggcggggtttcaccatgttgaccaggctgggctcaaactcctgacctcaagtaatctacctggcctcccaaagttttgggattacaggcatgagccaccacacccagtccctccagtgattttaagtggtaacatcctgaggagctttttaggaatagccattatttgaattcgctaaggacaggttcccctgccacctttttttaaggtgatggggactggaaaaggaaatagtaaactattgaatgttgtggcatgtagtaaggttatacagggagaagagtgtactgaaattgtttactttagctttgttcacagtggattttttttcagccttaagattgtgacaaaagcagctcatggtatgtaatagaaatctgctgggac

SEQ ID NO: 12810 - DNA, 24535 bp, Human
  misc_feature (1)...(24535): n = A,T,C or G
ggaatgaacaaggacagtttggaggttaaaagtaggatggagttggttaggtcagatctctcactgtctcagttataattttgcaatggtggtttcactggttttaagatggagtttattttattttatttttatttttttgagacagagtttcattcttgttgcccaggctagactgccatggcgtgatctcagctcactgcaacctctgcctcctgggttcaagcaattctgcttcagcctcctgagtagctgagattacaggtgcccaccaccacacccggctaatttttttctcccaaactgctgggattacaggcttgagccaccgcgcccgccaagatgggttgttgattttaaaacgatgtcaccctggctctcctaggttcctgttcccctaacaccatgaaggctgctggcagttctctggcctccagggaggcctccacacacatttacccatgttcttagacaatcctagggactcaaggcttcaacaaacctaaatgagccagcagaaaaataaacttgaacatgaatgtcaacgttttcccacatgtactaaagggttataataattttgaaatgtttatttcaaagagcgttggtaatttaaacgtcctatttaatccccaaaacagtcctgagggggagataaggcagttatcttcatagtacaggaaaggaaaaaagcgagggtccaaggccgactataccctcagctccattagcccccgaggcctccctgccaggcggggcggacaatcccagtgcagatgctctgtatcgatcgcatgctatcggttctttcaaggaacgtgtattgatcatcaattaagtggtgagtactcctctagatgtcgattctaaagagggaacaaaacacattagagagaagaaacataagtaactcgaataacaaccttagagagaagaaacataagtaactcgaataacaaccttagcaaactgcggaaactcctacagacaaaaactcaggtgtgggcgcagaagggccggggatgcgctcggtcaagacttgaaggcccggggcttgggccctgtgtcctcaccgagccccggggaggctccggctccgtccacacccggagcgcgactcagccgcggccggggctcttctggagaacggcgcggtcaggctctgccgcaactttcaggtcccctcggccccgtccgggtgcagcgcaaccaggctgcccgcggagccccaccgcccccatgccgccgcccgccatggttcagcccggccccgcccctcccgccggccgtggttcagcgcgtccgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctctcgtacgacgcccccaggggggcagaacgcgtgcgcacgcgcgtccgaacgcgcgtgcgcgggcggtgtttgaggccggccagtcgtgactgggcggcaatgaggtcagtgactgccgggagtcctgcaggggcggggcggcgccaagcgcagggagcccggctgagtggcagcccaggtgagcgctcagggagcccgggtgagggccgggaacccaggtgaggggcagcccaggtgagcgcgcggggtgcccgggttaggggccgggaacccaggtgaggggcacccaggtgagcgcgcgtggagcccaggcgagggggctgggaagcccgggtgaggggaccggggatcccaggtgaggggccgggaactcagctgagggggaacccagatgggcgcgcgggagcccacgtgagggggagcccgggtgaggggccggggtggctcctggcgtccgcggtcccagccctgccttccggtgggcgtgcggcaccccgggccgtgcggttcccggacagcagcttgtgggggactttcgagccccgcagcccggggtcctgcctgcgcgggttgggcgtggggggctcctcaccgcgacgctgactttggagtccttgagcggcgcggatgccggacggagggaggggacaggcggaggcggaggcggaggcggcgccgtcgcccctgacctcgcttccctcagaccggctgggcaagtacggtcagctcacctgtgtgcccacgaggcggggaggcggctcctgcagagccacagaggtgccgtcggagctgctgtcaaggacagcaggtgtcacgtgggtgtggcctccactggtcaccgagttagctggggcggaaggggacaaggtgcagctcaacatggtgtgggaggcggaggacccttggtctttcaaaacctgtaggagcggggagggacgctcggtaatggtctccaaaatgtgcgggggagagagcgggcgctgggtcaggtcagcaggaggtgggacccgcctgggctctgggccctatagccacctgctctaggttggggttgggtgtggacagtagggaggggagccaggggctccccagcctgtgtagattctgctgtaagtgactcttctctgaaagactggcgcgaggcggctgcttctgactcctgtttcagtttaccctctgtgtgaaatctgtaactatccagcttctgcttacctcactcccgtattttgatttttatttacatacaacttttcaggaaggttgtgagaggaaagagcaatggtgcaggaagtgtgagtgattgagggaatatgagatggccacagctccccactgagcttgaacacttctgtgcctcactttcagattggccgtcatggaggctgtggttgttaaggaagttcttcctgagcatccagtttccatacaaagagcacaggttctctaggtggcctcagagatgttcaatacacaatgtcttctgataacgaggaactgggcaaaagcctggtaggacaccgggtaggtaaatggtggagtccctgcaaccgtgttgcagaggaggattagctgttgctgagagaagagaagcaggccggggagcagcttgtatactgttatccccttttatgtaaaaagaagagtttatatctagaaaaacaattgacccagcaggcaccaaaaaatagtgatggtgcttggagctgtgtaagaggattgtaaatttttatttttgtatttttatgcttgtttatattttctgaattttgtgtattaaacatgtatttctgttgattttggaaaacatttttacaacccatcaatgtataattttcaaaatgttagaagtataattctcatgtaaatagctcttgtcaggttatatttcagtcattaatgcagtatacagcaggataggaatgtcagttcaaaagagaatacacaaaactaggattttcttagtgagtgggtaacaggaatgctgagagaagattgccagattagataataagattggtgaatatcctgtgtgcattgaaaccacagcctttgggattgtcttttcttcttgatggaaaggagaattagctttgcagattgtaaaatgcgtgacccacaatcagtggtaaatagtttagttatttctcctagaaagtcaagtgattgttggggttgtaaaacactgaacttgcgttagcagggaaaaaagcatgcaaccttttttttcccttttgacgtcacttccaagtttggataaattatctcaatgaaaaacaaaaatgctggtatccatagcagtttagcccccataaaccggaggagcgcatagatgcatgacagagtcgaagggttccagtggccactgagcctggttcctggtcacactgcagcaacagagctaacactcttactgatgtgtttgcattcagatttttaaaaaacttcatggcccagtgcaatagaagagctgaaaccacagaatcttataagacaagctttttgtatacattttctccaaagaaaatgaagatctgcagcgtcaagagatggtggccttccaggagttgtttattctccggctccacttcctctactgcagagaggaaaggggctggtgtggaagggcttggaagccttccagaatgaaagaaccagatgagtccattaggttcggcctccagttttttgttttttttttttttttgagacggagcctcactctgtcacccaggctggagtgcagtggcgctatctcagctcactgcacgttcctccttccaggttcccgccattctcctgcctcagcctcccgagtagctgggactacaggcgctcgccatcacgcctggctattttttttttgtattttagtagagacaaggtttcaccatgttagccaggatggtctcgatctcctgacctcgtgatcctcccaccttgggctcccaaagtgctgggattacaggtgtgagccaccctgcccggccggttcggcctccagttttacccatggaaggaacagtgacttccagctgtgcattacacttaaggactccttcatgtggcctgagccttatggtgcacagcaagggaacagtgggaacccctgtgtcccattttgcgtatcaagagtgagagggtgtggttgggtcaaggagcagaaatagaagcaaaaggagaagctgagctcttcccataccccttctgtgctgcctgacagaacaaggcctagccacacttctgtgggtgcccgccttgtgacttggggtgaaccacagctgttctcagtacaacgctgatgccacgaaaggacagcagagctctgcaggactccaggaagactgggcgcttgggctggatcctgcctctgggactggccttctaccctcatggctgagagagctgaggagttcacctcctttgtgaactcctggctggaggatgctggttggcattaactaaactcagagacccacagtaacgagttagactagaacagcaccagcttacccagaaagtcaggaggtttgagcaaagaatcagaatgggggattcactacaggactggaaggggaagtaagcattctggtctttataatctgctgtttctgcatccctaattggcacctgttctctgactgccaggagggtttgcccactcagctgtggcttacctgtttctgtttccatgtctttcacctatctgccacttttctgtagatatggtaatctctccaaaaagatatctagaaagcttgaagacctggtagctatttgctcttatggtgaagatcacacaaactagttgaacatctggcttgtagtaggtgcttcatttcccgctgctctgtatgtttctttcttttttttttttttttttttttttttgagacggggtctcatcttgtcacccaggctggagtgcagtggcgcaatctcagctcactgccacctccacctcccgggttcaagcgattctcctgcctcagcctcccaagtagctgggatcacaggcatgtaccaccacgcccagctaattttttgtatctctaatagagtcgaggtttgaccatgttggccaggctggtctcgaacttctgaccttgtgatgcacctgccttggcatcccaaagtgctgggattacaggcgtgcgccactgcactcggcctgctctgtgtgtttctttttcctgtagtcagattctggggtccagggtggttaggaaagaaacttgttttctttctttctttttttttttgagatggagttttgctctgttgcccaggttgaagtgcagttgtgtgatctcggctcactgcaacctccaccctcctgggttccagaaattctcctgcctcagcctcctgagtagctcaaattacaggtgcgcaccaccacgcctggctaatttttgtatttttagtagaggcagggttttgccgtgttggccaggttggtcttgaactcctgacctcaagtgattcacccaccttggcttcccaaagtgctgggattacaggtgtgagccaccacacccagcctgaaacttggtttcttagctccgaaatagtgaaatcaagatcagagcccactaagccagccgctcttcttggtttttggttctcatgtcctggagtccctctcaccttgaccaaaccaaagacctcctgaagcatcacttgggctcaccacttccactgaggtggatttgagtcattgatctgggcagagccttctggagtcggggattctctcgtctcaaggcagaggtcctacagaagttagtggtcttggccaagcggacattgatgcaactgtggcaaaatgggacctataagtcagagctgatgacctactcgtggaaaagtacagggagaagttttacgaggggtccatattttaacctttaacagtgttgttcacgttaacccttgtaatggatgctattccttgcctgatacctgtcctttccacccagcctgcttttctttaatgctggtaagcggtctcccctccaggcattaggctgcacttgaagttgatctgctcctgtgaagtgcataggggttcaacgatgccttgctgcacactgaataccagagccgagtgctcttgccagccccttaataccatgttcaacctgatttgtcaacaggttaacagaaatatgtttggagatgtgtaagtacactggagtcttgatatatagcatgaccagaagtgtgggtcacgagggcacacatgggcatggcagcccctcagttgtcatccatagcatctatcagagagcacgcctgtgtgccctgaactcacgcaccaggggcagcatgacacgggagccgtttctctagggagaaacatgagtaccagtgctgtctttccccacatcagatttgtgttcaaacagagctagtctgtgttaaagctggagtgttaatggagaaacagacaaactcttgtactattttgcctttgattatagaccattatcaaagcaagaggttaggagtgatcagtgctcccttgtcatttgcatcaggtcccaggactcacattctttgcatgcttgtgtgagctagtgttttccatgtccttggggtgtggtcacagcgacctttttgcctgaataatgattggcaagtttttgctgaatggccacagtgaatggctcctcctatgcttctggctctagtcctgctgtctcacaattgagtcaattctggggtctcttccggagagcagagggtccagctgcgtggggagtgtggtgttcccagccctgctgtctgttcgctgggtgtgagtgacaagagtccccactccctgcagaaattccattacctggacaagtccctgcacactgggtgaggggggaccaggcggggacctgagtctttgtcggtagccgttcctatgtcatcgttgtgtgcctgggtttcctgccgtgtaaaaggaaaggctggaatcaatcacacgtcccttccagtttttcaagaacttgagactctggtgtttgtagctttgcagacaggttcaggcttaggtaaagtggaccctttcagcatgattcagcatctgttcatgtgttccataaatgtttcttgagggcccactgtggacccagtgctgcatcaggcagaggagatgctgtgatggaaggcaggtgtggtctgtgccctcacagagcttgctgtccagtggaggtgaggattcagtaagcacttgtcctatgtgcaccccaccagcaagtctcccgccttcacagcagtcccaatcagtcacacaattcaggcatcgcaggatgaaacatatttaagtcattacactgggatacactttgttacagcactgaacttctgctgtttgatcctagttaacaccccaaacaccaccaatgagtgtttggggtatgcatcaggagcttgtagcaaaggtacttaacccagtccatgggtctcccctactctgggagggcatctggagcaaatggcctttaagtgaggacctgacaggtaagatggtgccaacttggggaaggtaaagacttttccaggagagggcccagcagctgcagagacccagaggtgcaggagagtgtgatgttttcaaaggactggaaggttatagcatggagtgagatgcaggggatggtgagagtggaaccagagaaggtataattgataatcacattctgcagagtgccgtaggtcacagtgaggagttcaggccttccctgctgctgttgagaaggcattccatggccttaaccaaggaataacatgaagaacaggagcacaggttttcgtgacatccttggggtgttaactaggatcaaacagcagaagttcagtgctgtaacaaagtgtatcccagtgtaatgacttaaatatgtttcatcctgcgatgcctgaattgtgtgactgattgggactgctgtgaaggcgggagacttgctggtggggtgcacataggacgagcataggaccgtgtgttcctgccagcaccgctccggcctcctgttcgtggctggaccgctctagctttagtttcattttctttcctcctatactgtcagtggatgttaccttggtatgtttatgcatccttgtaagttcattaagaataaggtacagaattaaatattttgtagtttaatgtttgcgttactggggtagtgatgtgtccttgtttctatcgagtcaacacaaaatgaatgatctttcttttagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggtaagtgcatgcatcagcagaagatgacatgtgcctcacgcatttaatcactggctacaatgtcctggacgctgccataaactcaacagcaggctggattgcagcacacacattcagttacaaactcattttagttgaatgcaatattctggttttgtttatttatttatttattttgagacggattctggctctcgtccaggctggaggcaattttcttaattttaagtcttttaggctttctcttccttaaggaaagaaagctcagtagattttatggctcagtagatagcgtctggaagcacttaattttttcctttcttttaatactatatttatttatttatttatttatttattttttgagacggagcctcactctgtcgcccaggctggagtacaatggcatggtttcggctcactgcaacctccgcctcctgggttcaagcgattctcctgcgtcagcctccctagtagctaggactacaggtgcgcaccaccacacctggctaccttttttgtctttttagtagagatggggtttcactatgttggtcaggctggtcttgaactcctgaccttgtggtccgcctgcctgggcctcccaaagtgctggaattacaaatgtgagccaccgtgcctggcctcttttaatactttagaaaaactgaagtaatatctgtgcgtacacacataccttgcttgctttttatttttgaataaggttgttgtactagtgctcagaagtgttgggacctagcatagttatttgcctagcactttctttctgtttttgaagaacatgttttaaaaatatttgtcacttgattgtcatattgatgtcaaaatgttcttcatgttaaactctttaaactttttttccttttgagacggaatcttgctctgttgcccaggctggagtgcagtggcatgatcttggctcactgcaacctccgccacccggattcaagcaattctcttgcctcagcctcccaagtagctgggattacagcgcccaccaccacgcctagctaatttgtgtgtgtgtgtgtgtgtgtgtgtgtatttttagtagagacggagtttcactgtgttggccaggctggtcttgaactcctgacctcaggtgatctccccgccttggcctcccaaaatgctgggattacaggcatgagccaccgtgcacagccttaaaattgtttttacatagattcttgctatcttttatgacccatcacattgtttatgggatatttgatatgaaatttgagatcctgcaaatgttcagccattcacacaaatgggtcatgttactgcacatttcttgtctacagaagactggtagcctcgagaggaaaaataagcataacaaatcactcctgccttcggggtcgaggtgggtagatgatatcagtccatcaaaagtgcactgcagtgtaaacagtacagactgttcatgcataaccaccatggacaccagccgggtgtcagatactgtgctggcacctgggaactcaaggaggaacttgtgttcctggtgtcccctgaggttggccccatctggcaccagatggggtgtgtgagcacagtgacaggaaagtgcagagaaaccatggccccagatgcggaccctctgcaggaggagcaggtgagcacctcggagttaaggcaagtgaatgagggtgagtgaggcacagtcgtcgccagtacagagcctcacagggtggccatggaagtagatggagcctatggcaggcgatactggagacatcctggtgagtgcgtggtttgggcggtggcaggaggaggttgggggccggtgtgatttgggtagaacttacccaggaagaagggttggaaccatgaatagtttgaaagagcccctccagtgacctggctactgagttcccttggcgagcaaatgactgaatatgaagctgctggtctaagtgtgggtcattttgggaacgatgctgtgacctgggaccccatcagcatcctgtacgcagcttgcagttttccagttttctctttgtgggcgttatttccataagagtgcagacttctgggatgcaggtcagggctgtgacttccctgggtttctctggagtgagatcagtgtggagtggagaggtgtgtgctggaggaagaggccttggcctgtgctccgcattgcctactcctctcacctggaaacaccggacttcaggagtcactcggctgtggcagaaaataaagttcttgaaaggaaagcagaggcgctcactcacatcgatgccctaaacatcaataccacatcaatgtcccaagtggtaaatagtgactaaattattaatacatcccacaagatggtgtgcttgaggtcattagtgtattttgagaaatagattaatagttatcttgtattttatttttattacaagttctttaaaaacaacaagaaagacgtgagtctttctgtctctccagtcctcaggggaaagcagtgttggatttctccagggttttatctgtgcttctcctggagccaggtgtggggacagcgtctccagcagttctccctcccctggtgtggtggtggagcccagcctccaggaggacagactcagcgagattttattttgaagtttgcacattctctaaagcttttagggtgctgtttgtgtagaatggagaaagggttatttaagtatttacttctaaccctgctcatgttaactgtataaagccaacagaccctaataagagaaaattataacctaaattaatatagctcagggccagtatgtctacatagttctattttgctctagttgaaatactaataaatgcagtaagaaaacactatgtctaaaatgttgaaattctttgaaattcttttaaagctgatagattcttgcatagtagtagggcatgaggattcaacatttctcccccatcaaggtctgatttgatcagaactaaaggatgtaaagacaaaatattaccatcaatttaggatgggtgtctaagtcaagcacagtggcttattcttcgtatttctgtcttagatttggttctactatttatccacagactcactagttcataatacaaatgaggtgatataaaagcactgtcaggccaagtgcggtggctcacacctgtaatcccagcactttgggaggccaaggcaggcagatcacttgagcccgggagctcaagaccagcaacatggcaaaacctcgtctccacaaaaaatacaaacattaactggtcatagtggcacacgtctgtagtaccagccaattgggaggctaaggtgggaggatcgcctgggagttcaaggttacagtgagctgtgattacgccactgcactccagcctgggcaagagtgagaccctatctcaaacaaaaacacaacccgctgtcagtttttatgtattttgtatatatacgtgtgtgtgtatatatatgtatgtatacagtcgaccttctgtatccatgggttctgtgtctggattcaaccaactgtggatcaaaaatatttgggaaaaatttaaaataatataacaataaaaaatataacaaataaataccaataaaatgtaacaattttatatagcatttacattgtattaggtattataagtaatctacagatgatttaaggagtaagggacagtgtgcttaggttatatgcacatacaaagccattttatataagggacttgagcatccgtggctttgggtatctgcagggagcccaggaaccagtcccccaaggatactgagggtgactgtatatttaagtatagatgtaactgccgggctccagagctttgcatgtgttatgtcacagattttgttcctgtagattttgctactcttctcaaagcctttggtgactttgactacaaaaattttagtgccttagtaaaaccaaagaactcttcggttctcaagctttgagttttctaaacttaaggtagtgattgcattctgatattactgttggtaatttaagatgactactttcagtaagtgaggaaaatggtggaggagaactttttgtgaattgtgagggaatggtgagtgaataaagactgagctcgcgagagtctggggctgagtgcacagtgtactgtacagttcatcactgtgtggggccttccagctactgtagaggattctgatgttcagaacatcgactcttcagtgttttgtcttcagacacacactcttttcactcctgttgatactgtacgctctcttgaggagcaatgagcactcttgcaggccctgtgccaggtgccaggtcataacaaagacgattctcagtcttccgtaagtgggaatctgtgggaggcacatatgcatgtggtgcggcacacacgacagaagattctggaagctgaatctgtgaggggcacacgtgtgtggtggtgctccagcacacacgatagaagattctgcaagctgagtctgtgaggggcacacgtgggtggtggtgctccacacacatgatgacagaagattctggaagctggaatctgtgaggggcacacatgtgtggcagtgccccggcacacaaatgatgacaaaagattttggaagctggaatctgtcagggggatacttgcatgtgactgtgcttctgttcacacagaaggttctggaagctggaatctgtgaggggcagctgtatgtgtggtaatgctccagtacacatgtgatgacagaaggttctggaaggtgaactctgtgagggttgggtatgcatgtggccccgctcctgtacacacacatgtgataacagaaggttctggaaggtgaaatctgtgagggttggatatgcatgtggccctgctccaatatacacacatgatgatagaaggttctggaaggtgaaatctgtgaggggcagatgtgtgtgtggccttgctccagtacacacacacacgtgatgacagaaggttctggaatctggactctgtgaggggcgcacgtttgtgtagcgatgctgcagtccattgcgtggcagaaggagcattgtctttcctttggtttttgtcagctctttgtttacttgataaatgcttgagtgtcttcagtttgataactagcaaaggaaaacagcgtgtgagacttctggtgtccttgcggctccatgcataggtctgtgcctgactgcagtgcacccacatgttcactcgaacaggggtacttggattgtcttagccacgctgttcatttggcctcagactgaatcctactgaagtcccatcatcagtggaaagggcttgtgagctgagtttgtccacgcagcagaagggtgggcagcagtctggatggtttacacagacacggtgagagacgttacccggacgcaaaagagtacacagcgtgtgataccgttccatgtacagtcatacgttgcttaacgacgggctgtgttctgagaaatgtgtccttaggctatttcgtcatcgagtggccgtcatagagtacctttctacatgtctaagccaactccacactcggctctatgcgacaaagcccattgttcccaggctgcatacctgtacagcatatggctgtactgaatactgtaggcaagtgtaacacaactgtaaatatttgtgtatctaaacatacctaaacatagaaaggtatagtaaaaataccatgttaaagatgaaaaatggcacacctgtgcagggcgttcactgggaatggagcttgcaggactggaagctgctctgcgagagtcacaatgagtggtgagtgtgagggcctagaacgtcactgtactctcctatagactttatgaactctgtgtacttaagcaatgctaaatttatataaaaaaatttctttaatcataaagtaaccttaacttactgtaacatttttactttataaatttttaattttttaaacttttccactcttttgtaataacacttagcttaaaacacaaatacattgtgtgtatatatatatattctttatacccttattctgtaagcttttcttaattttcgaaacttttttttaaattgttgaaatctaagatgcaaatacacattcatccagccctgcacagggtcaggatcatccatatcactgtcttccacctccacaccttgtcccactggagagacttcaggggcagtaacagacatggggctgctacctcctatggtgacagtgccttcttctggaccctcctgaaagacctgcctggggctgtttatagttaactttattttcatcagagaaggagtacactccaagataatgataaaaagtatagtatagtaaaatagtaaatgataggaattgttcagctccattataatcttgtgtggaaccactgtctatacactgtgcgttgttgactgaaataaaggcgctgagccctgggcactgctgtaggtgcagttgtccagcctcacctgggtgtgggcccacctggtactgccgctatgggtctgagggaggtgtgagatcgaaaacttgcctgtgccaaagtccagcattgtccttcaccacttatggacctggtggttgtggccagttgtcagagtgactatactgtttaccacccagacaaggatgtcagggactgccccaggcaaaccaggatctgcagtcaccccagggtctgagaaccagctatatttgtgacttttgctttggacatatcaaaaacctccaagaacttgtagcctaactctataatttcacaagtaagaaataagttatagtattaactcttcacatttcatttcaatcccatgtcacttaaccatccggaactgacagccataggttcttctggtctgtgggtttctcccctgtcccattcagtttggaggctccaggcttgttttggatcctgcttcctctgctcttcttcctgagtgttcactgtgcctcagcaatgctgagtgcggtgaagcatgtggtcctggcccaccttgaggtggccccaaccacaggtgggagtgtttcatttgcacctggggttggggtgaactaagtgcttggtatgtttgtggaaagccgaactggcggtctctgaaggcgtgtgtgtgcatgagggtgccgtgatgcacatgcgagagccctgaggtcccctctgagacctgggaaggactcccgtgacagttgtatgaggcaggctgggttactccattccgctggcctttctcttctaattgtcctcacattaattttttcagtccagacttagaatagatgctctttgactcaggatggggttacatcccaataagcccaccataagttaaaaatattgtgtcagaaatgtgcagcctcccgaacatcatggtatatagcctggcctgcctttaacatgcccagaagacttggatcagcctacgtttgagcaaaatcatatagcacaaagcctgttttacaacagaatgctgaacagctcatgtaattcagtgaatgctctactgaaagttgaaacaatggttgtgtgggtacttgaagtacagtttctactgagtgtgtatcatctttgcaccataaaatcaaacaattgtaagtcaaaccattgtgagtaggggactgtctataacagctaatatacctggggctttaaatattcaaaaacaccagaagaacgtgttagaattttttattttattttatttttttgagacagtcttgctctttctccagactagattgcagtggcacgatctcagctcagtgcagtctctgcctcccaggttcaaatgattctcatgactcagcttcccaaattagctgggattacatggtgcgccaccatgcctggctaatttttttgtatttttattagaaatggggcttcgccatgttggccaggctggtctcaaacttctgacttcaagtgatctacccacttcggcctcccaaagtgctgggattataggcgtgagccaccgtgcctggcccaagttagaatattttgccggggaggtatactgtattagtcagctcaggctgccacagcagactgccatagactaggcagctggaatagcagaaattcctttctcacagttttggaggctgcaagtctgagatcaaggcaccagcagattcatgtctggtgaagacccacttcctggtttacatggccaccttctggctgtgtcctagcatggaggaggggaaggctctggtctctttctcttcttatgacactaatctcatcatggggccttacccccatgacctcatcacttcccagggtctaggtatgggagcttgatatacctgtgtctggttttgccaaataagtattgtttatttacttaatatgagaaaattcaagataaaacaaagattgaagggatactgaaagaaaggttgaatttatcatagctttagggagcagaagccaaagagcaagaggagcaggaaaacagcatgagcgggcaagggtcagccctgctggcccaggtgcgcccacagagctggtggcctcctttcagaatgaagtcccaatgagagcagagccctggggaggaaattcttttgctttgaaatgaatttgttttgtttggtaagtaaggtagcaaatacctttttgtgatgtgaagaatgaattttggcagtttcgcattgacttgtgcatttgtcttctctccatgcaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacggagcaagactctctctcaaaaaaaaaaaaaaaaaaaaattctagaccgaagtgtacggcagtgccatctggtggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgtttcttaagttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggctgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagcctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgcgtggatcatttgaggtcaggagtttgaaaccagcctggccaacatggtgaaaccccatctctactaaaaaaacaaaactagctgggggtggtggtgcatgcctgtggtcccagctacttgggaggctaaggtagaagaattgcttgaacctgggaggcagagattgcagtgagccgagatcacgccattgcactccagcctgggtgacacagtgagactccatctcaaaaaaaaaaaaagaacggacatcatttctcacagttctggaggctggaagtccaagataaaggtgtgggctgattagtttctgctgggaacactgcatcctcacgtggtggaggggatggaaggtcaagaggcctcagctagttctccgctgcctttttatgaggcattaagccatttgcaagagtagggggccccacctcttaataccaccgcaatgacaattacaatgtcatgtgaattctggaggggacacggtcacactgcagcatcagcacccggtgaatgtggttctcttcccatgtcagaattttgtgagctccacacgggcagggttgcatctgttttattctctgattgattctaagccccatgtccctggcacaggatggctgcttggcagtagggagtggatgaaccagtagtacccagggctgccaggcagggccctgcaggggacagacccaagggctgatatggggacacctgctgaggggggaatttaccacggtaagggcagggctgggaggctgggcagccagtttcaccctcgcacaggctgcctggcaagaccagcggctggaggtgatgtcctcagtagagaacggtggccactggaaacgtgtggccagaaggggaaacgctcgggcctctggtgggggccagcctggggtggggtcggccagggtcagctgcctttccttcatgctggggaggagatgttgtgtgcatgtgagaaagcatttgatagcatgccaaaagtttcctccattatgtgcgtgtcaagtgtttgaccaggtcagaactcttgttctatgcgaatgtgctcacgcagacagaagcggaggggctccgtcgctctgccctcacgccgctgaaccgcgagggtctcccgctcctcaggcttgcggctcggccgcgaagtgtgtcaggtgtgcatcctgggtgctcctttgtgctctgtcctacggtgacacaggcggcgtggggttagacaggtaccggtcagactacggtgacacaggcggcgtgcggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtgacacaggcggcgtggggttagacaggtaccggtcagattacggtggcacaggctgcgtggggttagacaggtaccggtcagattacggtggcacaggcggcgtggggttagacaggtactggtcagatgcacgggctccctaaacccctgctgtggcttcggcagtaaagacaggacgcacccatgtcacaagaggagcacaggcaggggtgttggtgttggggcagccctcagggtctccagaccccagccccactcacacagcagcctaggaaggaagggcagagtcccaggtgtcagctggtgggtctcccaggagctgcccctccctggaagtcacaggacaggaatgacagatcagggaactgcaggaagctgccacctctggggtcagaatatgcccagcctgcgggggctctctatcggggtcttcgagagccagacagcctgccttgtgctgcatacctggctttgctctgtgcagaacccagcacacgtgattttgtgtgacatgccagcagcctggctcccaggacaggaggcctgccctgggggaggggctgcaggaggagggggggcaggcacccatgagtctgtccagccttgtcacagatgcatcgcccagcct

SEQ ID NO: 12811 - DNA, 6403 bp, Human
ccatacctagatatggaatatttatccttcttcattatcagggggtttaaatttgttttcttaaatgcttatcaaacactcccacagagtcaggttaggaagtaattggaggccatctagggatggctattttgccattaaggtacagccaagaagttgccctgagtttagagagccttggagaccacgttgcaaccaaataagttcccacccttggtgatccaagctcagtcccctgccaccttccctagtgtcttgtaccatcttcagtgggcagaacttggccagaaaaaggagcccaaaggaaggacaaggcagaggagggtcagcctggcctgacatctgactttgttccatgccctggccccttcttgtccccaggtgtgaaggttgtcacccttcactacttggcctgtgtatgtatattagaatgttgggaatgcactgtggccctgtctcccagcctgggctcaatgcttattttccttggatgaaagagccagagacatacattctctgacacacctaaatttgtaaggcggcaaagctgatgatacaaacacggggtgtgggagggaattgtagcgatgctgagatacagacagaagggagaggggatgctggctgatggctggaagcagcctgctgagtccccaagagaacgcaaacgaccttctctccctatcaaactaaagcaaaaaccaagtcttgggaaagaattaattttaaaaagaactggcagctcctacagagacttagaagaggagtgaggatgcatttcttcccagtggtctctgactgcctcaactatcaggagggttcaaagcccacaactggaagaagaatgatttcttccttgtgcccagatttactgggacatccctgattcctgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgccttccaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacagaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtgggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcaaactgctcctcccctcccccatctagagtctagacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctggtgctgaggctcacagccgcttctccccgtgcagacttgggggatggagaggtgctgtgtccctctcattctctagcctttcctcgtgtatacacagcactaagggagccactgaggcccctaaagctctctggcggagacggagccatagtctgggggcctctgcagcgcttttctgtcctcaccttcgcagcgacccctggtctttggcccgtccacatggccaggttttttcgccagccttggccctccgctcctggcctgtggctctggagactgaaaaatggggccactgggtatctctcaccctgcagctgaaggctccaggtgccccttcccacctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgaggggcctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctatctttgatcttctcatccaaagttaaaataataacgacaatgatgatgtagggagaaagaaccaaatagagaggctaaccccacccacaagaaagtgggtaaaaagcccaacccctgctctaaaaggctcaaccctgtggctgagccttggccgggtttctttctctcccggcgactgcagggagcctgcagggagccagcagggaggcagccgcccgccgccatggcggtctcacgcccgcgctcccgtcggtcgccgggaggtggcgcgctctgctcagaggccaaagccaaccttctctctgtttctcccccttctccttttttccccctctctcggaggctcgcattgaatcggccctaacgattctcggatcgtcattatttgtaaccatagagcatgaattacctcttgaggtcatcagcgagaatttacgactggtcaacaaaagcacgtgattccctaacgcccccccaccccccttccaacccccccccccatatttggccgcatacatagcaaaacgaagtacagtgcatcgctataattcattaata

SEQ ID NO: 12812 - DNA, 47751 bp, Human
ccatacacagaatgaattcaaatggatcatagagctaaatatgaagagcaaaagtagcaaaacttctagaacaaaacatagatgatcttcatcgatgttggattaacaacaatctcttgaacaggatgcagaaaactctaaccagagttcccacaaattgataagaaaagcaaacaccctagtgaaaaaaaaaaaagagcagaatatctgaacaggaacttccccagagaggatattcaaatgggcaataagcctgtgaaatggtgcccaatatcattatccctcagggaaatacaaatgggaaccacagggagatacaactacacaccacccccaccacagagtggctaaaattagggactgataatattaagtgtgcatgaggatatagagctttgtacaactgcttggcagttcctaatggagtttcacgtgctctgtgatccaacaaccccactcctagatgcacacctaacagaaatgcatgcacaaggcactcaaagacacatacaagaacgtcctcagcaacattagttacaatagcaaaacaaccgaaaacttcctgaatgcatatcaacagagaaatggataaatgaattatgttatatttattttatttatttatttttgagctggagtctcactctgtcccaggctggagtgcagtgatgcaatctttgctcactgtaacctccacctcctgggttcaaatgattctcctgcttcaccctcctgagtagctgggattacaggcatgcaccaccatgcccaactaatttttgtattttttagtagagacagggtttcaacatgttggccaggctggtctcgaactcctgacctcaggtgatccaccccccccttggcctcccaaagtcccaaagtgctgggattacaggcgtgagccaccacgcctggctggtatatttattaatcaaatactacacagcaataacagtgaactaactgtggctacaagcaataatgtggataaattttacaggcataatttgaggaaaaagaaatgagatatgatagagaatatgctatatggttctatttacataaggctcaaccacaggcacaattcatatacaagtgatacagcagtttactttctgggggagggaggagataactggaggaggctgagctgggggcagaggtgcatctgaggttctgagaatgttccagagcaggctatctccaccttggcactagtgaaattttgttggggagactgtcctgggcactgtgacattcccggcctctacccactagtgccggtaccacgatgtccaccccacccaccaccacccccgcctcattttggaaacaaaaatgtctccagacatttccaaatgtccccttgggtggaggaggtacaaaattcccctggttgccctgtttgattttgggtcgtgggggaattaggggtgtgggctcatttatggaaattccttgagctatacacatatgattcatcaacttttctgtacacatataaagcttttaaagtttttaaaataaaaaaacaagtcaatgaatgactgaaagaaccagtaagttttccagcaatccgagacaatagatagagtggggtttaatgtcttgttcacagacaaggagactgggatccagggtgggtcagggcagggggccagcaggatccaggagggaactcattccctgacttctcctccgcttccttcccccatgctctcacgcattcttgctcccgaatactagccaagtccctacagaggctgatcccgtgcaggggctcggttggacctttagcctcaaactcccgtggtggaaacagttaggattggtggacgctgcacccagcatcctgcaaacagaattctgaaaactgatatctcatgcaaacaggatatcaacttttgtcagaaagatcaaaaagagcttgaggtttttcttcacagcctcagccttgcctctccccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgtgagtactgcccagagaccccggggcccagccagtaaggctggtgccagaccctgctgcggcccccggcatggagctgcaggggtgtagggtacggcttcctgccaaagcagtgcaccttgcagggtaagacactgcctcttcacagggccctcttctgcttctcgtaaatgaggtgatcttgaccaagcttgtccaacccacatgaggcccaggacagctttgggcttaagccatcatcccacctcagcctcctaaggctgccctgttcaatttgtgttggctgcccaacacaaattggtaaactttcttaaaatattatgagattttttttttagctcattagctattattagtgttagcgtattttatgtgtggcccagggaggcacaagaatacccctgatattcttgaccttttaaagaccagctcggctggctgactgggggaccctgaaatttgtgaaaatcagaagccatgtattactctgggtgccccattttgggggtttggaggagattggggcctggttgtaatctctttgtgtgcagctcagtgactctgaaagtggcgtttcaagatattcaaactctaacgtgaaaggccccaaagcccgctgagtctctaacactgggaccaactgtcagcagggctgtgcttccacgctgcccggggaaagtcacttgtcctcagagacaatcccttgagtgtctgataacgaaacaaatgggtaggaaacttcagacacagtgtgagcgcgaccctgcttacccaagggaaaggcctgcatgtggaagagcttagccttcagagttaccactctcggagagggaggccacgacaccaacattgggttacagctttcatggcaaaccagtgccttaaatctgacccattcattttttcacatggaaaaatgtatcagaaacacactttaaatctgacccattcattttttcacatggaaaaatgtatcagaaacacactttaggtaactttgggttggggaaggagctaaactttccttccacactataacaaaagcttggccaaattgggtgaagtaactctgaagctagacaaacccatttcttctccccaaatcagggctttgtcgtcactgttatgttcaagctaagccaggggcctttgaatggggagtggggtcaggcatgtgcagggcggccaccgggcaccgtccaggcattacagacaaggcagcttttgtccactgctcaccacccagtgcaggcaggacactgggcccagagagtgcattagtggcggaggtggaacccgaaccagctttccatgcctttgaaggagtccacgctggattttactactaaacgtatagcatggacttctactcaaaattccttccagtttaaacattaagcacatgttggaggaagagaaatgtgtgttaatttccccacaccagagcacctcatagtaagtgccctgcaccaaggctgccttgttcaaacctctccaggtggccacagccccatcggtgcccacccaaatagcagcattcggcatcatgtggtgggttcctcatggacgcccgctgtttccagtctgcattcctgataaattacctttgctatattccattctgtttcatttggtccagttctgcccaattcaatgcaatgtacttacgtcccgggttaccgtgatgaataagactcagtcctgtgttcagggagttcttggtctagcaggggagagccgtgggtgcaaggggactgtgtaagccgtaacaagtgcctgcctgggtgctttggaaagggctgtttcccagcagagaggtgtgggaggcgagcctggggatcagggtcgctgatgctggggtgaggaaagcgtgtgtccgagccaggggcacgttccgcagggtgggtccatttgatctaggcagtggggggggggggggcaggccagggagagggattgcaggagcgggcggaggtcaggtcctcagccctgagaccccgtgccaagggctgaagcgggtagccagggaaggacagtgagggggaggtgtgagctggtcagcattgtccaaaaccacgatggcagcactcaggggacaggcgctagaacttccagctggaagttcagcatcaggccctcttcagagcaccccccaaagatcctgggtgtgcaaggccacaccctgcctctctgacccttttcccaagaatgggcgacgtgactttgtgtctgtgtctgctcttctgcaggctgaaagcgttggcagccacggggaggaagacggcggaggaggccttggcctggtgagtgcagctgcttctgtagacccaggggcgtttgggctgaattccctgtgcctaaggactccctcccaccagggctgataccaggaagagccgggcgcctctgggtgggatggggccactgcggaagtgaaacaaaataacctccctgcctacccatagtgcactgagggaggggcacagggctttggttaaccatggaaagagaaagagagaactctgaacaaggctttcttcacttacaaacctgattcaatccaatttgactgccaagaagaacaggttcatgtgctttgttgagtaaatggggaagacatgattgttgtgttgtgataagcacgtaaatgagggtaattgttagaataaagtaattaggttaaaaatggtaacatttgggtttatattagtactgctaatattcagcctatttcagtaattgaagagcaggctgggattttgcatacttgtgtttgattatgtcctcctcaactgcctactacgatggataagattgagatagataggaggatgtttgtgtttattgatggaaagatttgagacataattgacatctttgctgatagagactagcggccaccatgctctcgggctgcctctgaggggaagggagtttactggtggtcatgaagccaggtgtgtgggtctaagggtgccaggtgtgtgggtcgggtgagggctctgatttgaggtgacctcaccaggtaccagctgcgtgagtgattcttcaagccacccactgccatgggcctgttctctgctctggggatggagaggagggccaccgtttctctaaaaccctctcctacccggatgtgctgtggggagtccttcatcctctgccctgagatagccacggggaaaatcaaacaataaaaaccaggtcctgggaggctggagtgtcctctccaaagcaggagggcagatactgatcctgggtctctgaacgtgcagtgttcccaatgggatgccccctcctcctccagaaagtgtaggccacgggcaaaatgggcaaccccttcacagagtccactaaagccagttgccaattttggatcagaaacaagcccactgctgtgaagggcatggccagcacctgcccactgcaacccagtcaataagactaggaaccccaccaaaaaatagggaggcaatggggtcccctagactgtcaagagcaccccaacctctcactagtaaccagggaggtggtgcaaattaagatatcattagagcaaacaaggtaactccaagtgttgatgagggtgagggaagcagggcctcacacgtcactggtgtcactgaggaaggcagtgctgggtatctgccaaccttggcaatatgcacagcccaccagcctccgtcgtgcgtctaagcagattccctggagaaatgcaaggagcctaaagagacatgtacaaagatcttgattgcagggttatgaaatggttttaaaataaaataatttagatgttcatcaatgcgggaatgaacaagtgcaacattgtatatgtatacatgaactattacacagcctttaacaaattcgcgctgacaaacttcactagacacgtgtgtatcaacagggattaattgaaaagacatggtagaggaaaaatgccagttgtagaataatttgaataacagcttatgatttatgtaaaacaagtgctatctataagtccgttacttaaatttctgggagaaggcaaagcagcttcaccctctgggtgaaccctggaaagggggagggtgggaaccacgatggagaggagtggcaacttcttctgtgatttttattgaagagaatatggtcttgcgtaagttctgtttcctctagtgattgaatactactttctaaattgaaaattatatcacaggcactttgctgagtaattagaaattcttccaaaccatgatttctaatgaatgcacggtaaatagatttgctatcagttatggagtttttcttctttcttctaaataaccctaaataaccttctaactttcttctaaatagccctaaatagatggttcatgtgcaaagttttgcctatacagtactttgtgctctttcctcgggagaaatttctggaagtagaattattaatgcaaagagtgtgggcattttaagactctcaatacctattggcaaattgcttcacataaaagttgaaaggtctgtccttaagtcctgctgcatcttttacacattgagcagaacttttatcctttttattgaaaaaatctttgtgaacttgacagatgagaaaaatgccgtctcggagctattttatttccatttttattgttagtgacaatgaactcctatgttgggtcatccgtcgtttttcctttaatttaaaataactgtctgcctgaaatcccagccagtcaggaggctgaggcaggaaaattgcttgaaccggagaggtggaggttgcagtgagctgagattgtgccactgcactccagcctgggtgacagagaaagactccatctcaaaaataaaataaaataaaataaaataaaataaaataaaataaaataaaataaaataaaataaaataaaaactgtctgaatctaaagaaacgcagcagctacctaaattttgtctaggtttttggttttggtttttatatgtaatttgaagtttgaggtaaaatacaaatgtgaggtttttccacaaaattttcccacaccatcaaggagatgctgggcccacggatcattggaagaccaggttttaggtcttgctgtcaactttctttcattttttctacctttgactttggaatcagactaaggtgggtctgagagcaggacttacactgaccaggtctgtgccacacacagctgtgccgcagtgcctcccaccagtaggatggctgtgagattaatttatgtcatgagcatatatgatgtcttcagtgtgccctataattctgcattgctgtcattgtcattctgttgtgtatcctcaaaggggaaaactctttttgttgtgacagtgggtgatgccggcttgctctctgttgcaggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacggtgagtcaacccagtgtgccttcaatgctcacggcagctggaggcatttttctgtgctaactaggccatgatgggacaaagttgacttatttaaatgggatagtccagaactgcatcattagctggcaccttcatatgagctgtcctttattttcctctttgccttcatctggtcaactcctattaatccttcagaacccaactcatttatcctctcccctttttgagtcttctccagctccccaggcaaaaggagttgctgcccattttctcgttcatgtgtctagtggcacttttgtatcatacgggccatgtgtctggtgcagcaccgcatccctcaccagaccgagtccctcaagggaaggcagatacctcactcatctttgcacccccagaaactagcacagcccctaaaacagagtttgtgcttccaaaatgtgtggtaagtcaactcaaggatgggtgattgttggctacccacaaatgcagaacttttccctgtctcagggaccagccgtctgattcagaaaaaaaatggcccagtgggtagctccacagcaaaacacaatggcccagcaggcagctctacaggggcaccgggaagacaagaagaatgtgggagctgctcaggagaaaagaaggagaagggagagacagacagccactgctctactcagctccgccagaggggcttaaggaagggcacacccacttctgctaccgcggcctggccccaactctgctgttggcaaactgatttgttccacccatttcaaggaattccatcagggcccaaggaaccctccattccaacaccaggcccctcggtgctggatggaaaggaggaatgcaaacctctgaagggaaaagatttctggaagatgtcccaggagaagcagtaccttccaaagcctccaaccaccaccccggattgcccgagacttgcagggatccccagagcacaagactaaacctggaaaagccccagaaaaatcgagagagttttccccctacatcgacatcaatggtacttgtgacaagctgactcccttctggttcaccctctggagccaacggggaaaggcaaggcagcccaagccatgtgacacagctcagaaatcagagcaggccttggccccccactccttccccagcccactgaggtgcaagcacacacacacacacacagatagacacagagacacacacatagctcacacacatagacacacacagattgacacagagacttacacatgcacacagatacacacacatacatgcatacagacatacatagatatagacacacagacacacacagatagacacagagacgtacacacggcacacacagatacacacacatacatgcatacagacatacatagatatagacacacagacacacacagacatggagacgtacacacggcacacacagatacacacacatacatgcatacagacacacacagagacacagatacacacagacacacacagatagacacagagacgtacacagcacacacagatacacacacatacctgcatacagacatacatagatatagacacacagacacacacatatatacatgcatacatggatacagacatacacagacacacacagatagacacacatacacactacatgtacataggtacacatgcaaacagatacacacagatatacacacacaggaatacacagatacatgcacatagacacacacagacacacacagagacacacattagatagacacacatgcacaaacacagacatgcacatacatgcacatacatagacaaatgcacacatacagacacacacataagcaccacatgcacacatatgcacacagatacacacatgcatacacacagacacacatatagacatacgcagacacacagacacacatagacatacgcatatgcagacacacacacagacacacacacatatagacatatgcagacacaaacacactcacacacctccctctgtcgttagctcctcccagtcccccaccccagttctggcctggccgtggttagtggagctcccctcacaggcagaagagtgtaacggagactcactgtgtaccttgatgctgtaaaatgaaaacactaatcttccgaagtgtgatattgatcacagctacacttataacatgactattcttgaaaattacatatctgaggccaagaaacacaatgtgagacggattcaggaatggacatgtgttcactgggtggttttgtgttgagtgccgttgagggttgcagagaaaacagacagggaggaatgtcaggccggcctgtccatggggagacggaagctgcattaaacactgtgatctggcctcatacttgggcttgtaagaagcactgtgggaaattccgagggcagcccggtgctgggaagagaagggatcaggccaactcccgccaggagggtgtggtgtctgggtttcccctgtggtccgatgtggccaatggcactgggaaggttttcaagcccaggaagcagcctccccagggcggtaggcaacaccgagcccagatgtcaggagaggctgcgtctggctggaggatgggggtgggagccccgtgggcaaggctgtcgggccagcacctgtcgggctccgtgggcctgagggattctccaggtgacagagagcctgcggcctcaggggtgggagctgcatcagaaagagggtcctgcagccactcagggggcatcagggaggccgggccaggggctgtgcaggctcaggtcctccagggagcagaccccaaggcagaattcccagtgcaggagacgcacaggggagagactgctggtgaaggcaaaagaggaggagagggttggaggcaggcagagcctcagtgccttagaggagtccctgtggaacccgactcagtgctcagccgtggaagagagggtggccccgcagctggaagtgcagctgagtcccgctcactacaggctctgagcagtgcctgggcagccttggagtctgctagaaacctccagaagccaaatcatgcaaacctgagcaaagcagtgtgccatgggactgaggaaagggcctggcaggtgatgagcacgtgccatggagggaggggatgcagttcaacgaccaggggatttccaacctgggcacctaaaggagactccaacctgcaaagaaacttacctgaaatatttgaaaaaaccgaggtccaggtatagaacaaatccataaccccagacacaaagggacgcaataaattatgttacagcgctttgaacagaaaagaatctcactttaattgctgcctgattgttattaattaaattaatagatgacttctgatgagaggtgtggaaacacaggctctgtctctgtccccttagtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggtgggcagccctggccagttgcaaacacagggctggattcacagtgagtgagccctctgtggcagggactagcccccggcacatggatgcagtgggtgggttccaggggagcagagcccagcagcaatggtgggatggctgggtgggctttcttccgggctcagtggctgcacctgtcctcacccaggcacttccgtttcccgcttctggattttcagccaggtgcctggacatggccctaacctgaggctgagcaatttaactagagcctccttcgtgagccactacatccttcaaaaatgtaagccattagaaagcttccggaccagctttggtcttctctttaggcgggaatagccttgttctcattatgtggtttttaaaatgcttagctatatgccaacagcctgggaaagtgccccagaagggtgtgccaagcatcaagcctgagtgggtgactgtgacggggttggaggctggtgcacacagggagtcagggcctccccaccccagccttgagtgggagacacacaagtcctacgtgacttatttctgtattttcagtatgagcttagtgctctctccttggcctctccagggaaagattatttagactcatattcagaatcatcaaaattcccttctctccaaacaccagccctggcctggagaccaaggctaccattggggtttagtggaaaggattgtggacttgacgtcagaagatgtgatttttttctgtgtccctgatgagtggcatgaccttaatcaagtcatgtccactctctctgtctctttttctttctctacaaaacaatgagggctctcactcttcaagaacaatgttgcctgagtctgtggcccatcctgccatagttcccgggacacagaaggcactcagtattgctgagatttgccgactctaaaatctgacgaggccgcagtgccttggtgggagggctccccactttctctctctgggagcgtgtctgtctgtgctcagacatgtatgaagcacagatcctggcctgtaaatccatccctgaatcctgggcttccacttggatggcagcttgtgagtctggagatcgaatctgctgaataattagaaagtcgcccccggtctttgtggattagtatcctttatcaaatgatggctctttcacacccaggccctcccccagtgaacctcattggcagcatcttaaaaacaggaagactgaggctgcaaagggtgaagggcctgcccaaggtcctgtggtgtgtagagcggtgtcccctaaaaatgtttgtccaccaggaacttgggaatgtgacctcacttgggaatagggcctgtgcagatgcgattggttgggaggaggtcacactgcattagggtgggttcccgtaagggtagaggccgcacagagacacagagaagccatgtgccgactgaggcagagactggagtgatgtagccacaagccaagggacgcctggggccaccggaaactggaagaagccaggaaggacccttcccaggagctttcggggagagcacagccctgccaacaccttgattttgaacctctagtctccagaaatgggaggcaatacatttctgttgtttgaaaccaatctagtcccctaaccaggctggcggagcagggacctgaacccacctctgtcctgctccatgctgcctgggttcatgctgggcagccccacttcctgtgggagccagcgttgacctcacatctacgccccgaccctaagcaggctgtgtcctgcccttccatggcccatgctctcagcctgacaccgagggggtggaggggactctctcagtgatgagtgaccagtcactgctctgaagtggccgaggtccctcttggggcaaatgcatgaggcccccttgcccgcgttggtcctccccagtgaaacgtgcccataggcacaggtccgcagagagaaggaaacgcaaggacccgttcagaagtcggtgtgactcactctgacgtcagcaacctgcagtgggtctttcccaggccacactcactcgcatggcaaggcggtcctccccgactgctaaaaacaaaagtcaggaaaggaatttccccaccacctacacactcatgctgctccccaccacctacacactcatgctgctctgggctgtgcagcctcagtgccccagctttcctagagaccgtgggagcttcccatttgcctctaaaggctcacctctcacgtgggagacagcagtgagccccaacttcggggctccagggaaaggcttgcatcaaccttgaccttttttagggggtgagcagatcctgtttgtaagtgccctgccgtggagtgggggcagggtacgtctgtgcaccgacacggcgtctctagcaggaaactttaggttaggaggctgatttcccactgcagccttggcgagcaggcgctgccgtcctccagcagatgctgctgaagcagaaattgggcaggcccagaggctcagtcaaggtcaccctgcaaaagggggcaaagtgcagcctaaaactaggtctatctgacaccaaagtttgtgttgttcccgtcaagacacagaccgcctccctaggacataaaatactttgtggctcaactgaaatcagatcctggctgctttggtgatgccagctgctctgctcagactgacctgagagcccctggcaggaccagggagggctagggccacaggggcagaggacacccaaaaagacctgaggctcaaccactcccaggacttcctgcttcaccaaaacaaggtgaaccttaaagacactgtgtgttttatagttttgttgcctaaagagttttcttcttgaaactctacgattaaacaaaaagccgttgaactggagctcgggcctgcaagtccaggccactgggtaacgtgcacaccccggggaatggaggagccgtttactctgtgcatctgaatcgtgcattcgggcagctagcctgcaaaccgataggcccccgagaccctgaacccacatctccatatcgtcctctttcctacttcctggaaaaatctacagggatccagccatctcctttatgatgtgagttctgagcgggccaaatgagctctgagttctgagagcccttgccttgtggaggaagcatggaggtcggaggaaggagacatttaggtaacggtgtcctggcaccctctgtgtttccctgatttcacagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccaggtgagagagctgagcaggggctcataagaagcagatgaatgggctgggctcggtggctcacgcctgtaatcccagcactttgggaggccgaggcggcggatcatgaggtcaggagatggagaccatcctggctaacatggtgaaacctcgtctctactaaaaatacaaaaaattagccaggcacggcggcgggcacctgtagtcccagctactcaggaggctgaggcaggagaatggagtgaacccgggaggcggagcttgcagcgagtggaggtagcatcactgcactccagcctgggctacagagcgagacgtctcaaaaaaagaagcagatgagtgaacggccactcacctgacagcatgtaccccctggagccctccaagggagatatgttagtagcaaggaaaatttctattgcttctctaaagccattctctttcttgtgcaatttacaaccagcattcttttatatgtgagttagagatgcacagacaacaaaatagaagcatttccaatattagaaaaggaagctgggtgtggtggctcacacctataatcccagcactttgggaggctgaggcaggtggatcacttcaggtcaggtgttcgagaccagcctgggcaacagggcaaaacgctgtctctactaaaaatacagaaaattagccgggcgtgatggcacgaacctgtaatcccagctactcgggaggctgaggcagaagaatcacttgaacctgggaggtggaggttgcagtgagcagagatcgtaccgttgcactccagcctgggcaacagagcgagactggcaaaaaaaaaaaaaaaaaaaaaaaagacagaaaggaaaggactattgtaaagatctatgaatacatgttttgcttattaattcttttttatttatttattttttaaatgtaggggccatgctaatcttctctgcagcattccaattttagttatatgtgctgccaaagtgagcacaattcactttaaagaatgatttgagtgaaacctcattctgggacttcctgcccatgaatcgatgggtttagaaacgaagtgtgtgatgctcctttcagacccagagagcacgtgtgaatgaatccaccatgttctgtatcgtatgaggtgtcaataacctcacaccgaggaaggcggatgtgaaagtctgcttatgccttcagatcttttgtagacaaaaaagtacctagatggatggatgatggatagatcccaaaatgtatctcttttttttttctttttttcttttttttttttttttttttttgagagggagtctcaccctgtcacccagggtagaatgcagtggagtgatctgcgcccacttcaaccttcgcctcccaggttcaagtgattctcctgcctcaagcttcccaagtagctgggactacaggcacccgccaccatgtccagctaatttttgtattttcagtagagacggggtttcaccatattggccaggctggtctcaaactcctgaccttgtgatccacccacctcggccttccaaagtgctgggattacaggcgtgagccaccgcgcctggccccaaaatgtatttctaaatctatccaaagaattctatgctgcgtttcattacattctgtgctatatattgccagacaaagctttggatggagtcttggagacacagaacacattggaggggcagaaagcaggaggtggcaggtgataggcctcctattgctgccattttccaatgtaaatctttgctcgagacgtgaaacccctttgcctcttttctagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggtgagtgctgcctctggctgcagccccgtcatctctctctgagttactgtgtgagagtgcccacctgccaacagtgtgcttctagaccattccattattggtaaaattgcattctgtatgctgacaaaattattcctgcaggtatatagtaaacatcttggttcgtccctggttttctgatgataacattcaaaaaagaatgaattactctgcattagagtaatttgagatggtaatccccaaattactgcaaaatactacttctttatcacacacataataaattatactcagaggtcctgagcttgggtttatttattcttctgctccgtgtatgaaatgtaaagtcctaggtcgtattattagttttctatgactgtataataaattaccactaaaacaaagtgcaattattatcttatggtatttatgggttgagagtcagagtccagcttcactgggtcctcagctcggggtctcaaggctgtaatcaaggtgcctgccagggctgggctccccactgaggcttcacaccctcgcctgagcatacacagttgttggtgggagtgatttccttgaagctgtagggctcctggtgagttgcttcttcatcagctgaagaatctcttaattttagcaccttttagcatcatctggtgaggctaaggattttcagaatcatcagatactggttcttttttgttcgatgttcttccctcaatttatctctttcctctcccgcttcactataaataacatgaagaaaccaggtgatacacttaacactttgtttggaaatagccttagctatgtgaccaacatcatcgcttacaagtcctgctctccatggacaatttcattaaactctctggcacacatgggaaggatcctccttgctccgatttcctggaacacctgtcacattcctttctgagttctccccggaggattcacctttagcatccctatttcctctagcagtctgttcatggtgatttgggctttctctgctgtgctactcaaaagtctcttagcctctactcgctgccaagtcccaaagttgtttccacattttaagttcagaaggtttccaacttacaatggtttggcttaggatttcataatgttacgaaagtgatatgggttcaatagaaactgtacttcaagtgcccatacaatcattctgtgctacattttcagtacaacattcaacgaattacatgagatactcaacacttgattataaaatcggctttgtgttagattattccgccctatcataggctactgtaagtgttctgagcgtgtttaaggtaagctaggccaagctgtgatgttcagtaggttaggtgcattaaatgcattttcaatttatgatgggtttgttggaacataaccccatctgaagttgaagaacatccactgtttgttagagtagcaccccattcctgataccaaatttagtaaaagtttaaccagagatgcagaaccagtcactttcatacaatatataatacatataagtatatgtacagttgtcccttgctatctgcaagggattggttcccggacccccacagatacccaaatcctcatgttctcgagtccccgatataaaatgctgtagtatttacatgcaacttatgcacatcaccctgtatcctttaaatcatctctagattacttgtgatatgtaatacagtataaatactatgcaaatagttgttatacggtattgttttttatttgtattttttaaattgtattgctattttttaattgattaatcttttgaatatttttggcctgcagttggttgaatccacaaatgcagaacctccagatacaaagggctgactatacatacatagtattttatattatatacacatgtatcacacacatatatatatggaaaggtatatatgtatacacacatctatattgatttactacaatgaattgccttatggaattactggggctagctaagcaagggcagacaggcaggaagggaggagcctacttaggctgaaaacccatgggcaagctgaagcttgttgtccacatgtggcagttggaaggaccacccgggtgatgggagagcagtcacagacacagctgctattgaagtctctgagtgtgaggaaagcctaagtttttaaaaaaaaatgccttccaactgcataagtcagacctgctcagaataaccttgcttttgattaatttaagctcaactgattaggggttctagtcacatttgtaaaatctccttccagcagcacctagactagcatttgatgggatagctaggaaggctgtgtgtgatgcttaggatggctactgcctcccttccatcctccagctctcatgagaatgcctcttgtagcccaccctgatcagacatgtgctaaaaaggaagtctaggaactgtcgttcagtctggccaagttgccacaccataaagccattgcaaagtgttaaggtggctcttgtgagctttttcactctcttctcccaggttccagttaggagagtggagagagcaggcagaggtcagagtacacatggtgaaaaaagagaaaagctgctcagcctcatgggtgtgcctgttggggtggagctcttgcaggtgtcaagactgatggttggaacaactgaatgatgagagtgggaggagaagggcagaaatacacagaaaaaccctatgttgtggttctgggcttcctggcaccttcagagctgtgtggctggggaagagagcctggaaaaacaccatcgtggccatccctctgtctccaggcaggaggtcttaaaaccattttatatttcactcatttgtttaattctctcctaaaatgctccacagcttctctagggttcccctcaccaccctgacaaataaataaatcattaagttgaacacagatgtatcagcatctactcaatctatagattttcagatctgtgctggacatttgctgtggacttctatttccagcatctatacatccagggaattattttctgtacccttcctaatgagattcatgcacatggcaaaactatgaaaattgtgacgttttatttgagtagtcattaaaagctgcttaaaaattgtcagaggctatatggataagcctctgtgtggataagactagcattttaagtaaattaagaaagaacgtattttgaagagctgaaataaatgattgcatattggtcatttttatccaaacccccaaaaaagaaaagaaaagatggtttaatagtacctgatagaagctcttggtgaaatgattagaatttgcaagaaatagtagtaaaaataatggaagtattgtctgaaatatttataaaaggagatttggtgactatggctgatttctttaagtattatatttctttttgctaattattcatacactgagatttgtataacaagccagggacagtacctatgtccctgggctcccccactaaacataatagccacttgacattcaaggagagcagattccagccaaagccccacagctgtgcatacatgacattccatatcatcttctcttgaggccatttaacttcttaccctaatgaataagaacttaggaccacaaaatgcaaatgtgggatgaaaaatgcagccgtagtcacacgtctttatttattgatgtgttgactcctaatccacttaaatctattttaaggcagcttaagagatgtccaatagctttgcacactaacatcaccccctgtgcctggctctgtgccatgcatttcccttactaactgatttacttctccaataccccctggataggcacttttattgatccattttatagttgatgaaactgagacacaaagagatcaactcacttgcctgtgttcacacagcaagtgagcagaggaagccggattccagtcttatacctaatcccacgcttgggctttcaactatgacctcaactgcctatagaagagatcattaaaatttaaaaataagtccataaattaaattatgacacatccatacaataaaatatttgcagctttaaaataattaaaagggagaattttatatattgatttgaaaaaatatgcaagatttattgataaatgaaaaaaataagttgcagaacgatgtgtatggcatgatatacttgtgggggaaggggagagaaacacataactgtctgtaaatacatgtgcacaatatgtatttctatacatgtgtatgcctaaaggttccctggaagggagagtgtctagaaacttctaaccatggttaccggtgggtgttgggagtgggagccaggagaatggaacagaaatgggagggagtcttttcaaacacgaccatttcataatgtttaaatgtatgaagcatataaatgcattacttactcaaaacataaattaatccattttaaatttcaagaagagaatgtaagaaagctgggtcaaagggagagtaaaggtggaaaagctagacaaagccagggctgaggtttgtccataccatggcgtgcgctgtgagctcccagctccgagctttcccacatccagtgagaaaacagacacacattcaaccaacagtcatggccatcccagatgcgtgcagaccagcggttcaggagaaacacaatttgctgacatagacatgtccgtgggtccaggggccacatcaaaatcacaggatgtgggtgccacaagggattgtagagataaccgaaggcagctcccctgcttgagaggtgagaagactcgggcccaggaggccaggtgacgttgtacaatcaaggaagctcttgctttcttgcaagctcagttcaccacctgatccaatcaacagtttaaggaatagagaggagatgctggctatgccctaactaaccatctcaatttcaggagggttggggctcccctgtggccccgcatcatttagcatgtccttcgctctctgcccgggatgggagagtttcacagtcacagaggaaccacaaagactctgcagaagatgagtcagcggctatgatacttttcacttcacaattaatacatcagacacctgccatcaacataaccattccagcttttatgcctgacatttctgggactattctttccagaggaactttctcttgagaattaatcagtattaacaaaaattgcaatgaaaggaaagagaaataagcactgggctaggtgctgtgggttgtctgattggtcctgctttggaagcaccctcattgtggctgggggagcatcaagacaccctgacaagctgtgatctgtgcttatgggccagtgaggcagatgacgggagctgttggactccactgtgctggctaaatcttttcaaactgctgaaaatccttattaaacatctaaagctttcaaaatcggaaaatgatccttgaatgtctccacacatcactgacatattcattagtggaaaatggggtcagacagcaatgtccagaggccagctgacccacggactgacagatagctgtgcagatgttgaataattacttcctacgagccctggtcaggactcacacttgcacgatccaagcagcagaaccactggcattagagtgcctggaaacagacctgcaggcgcaccaggaggaatccccctgcccgccacagagggcacctttccaggtaagagtctgcagctctgatgaatagtacttgtcaattaacacaccagtcacccatcaccactataatgaccccagcctcagcctccgtgccagacggtgcagggattctttggacttatctaccgcaaaatcacactgtaatgtttgtccattgctttgaagatcagagatggcctggagagactggtgatggaggaccgtattcacaaaccacagcagcttccaatcctctgtccaggagagcagaggggagcacccctgtgggacaaacaacaggggggcttgagtgtgagggctcgggagaataagtgccatcccccagtcaagatgaggactttcccaacactgaagacagacacagcagattacttcaaaaacctcagagcaagtttacagcaaatatctcagacataagaaaggtacaattaagggctaaattgcattctgccaacattcatatgtggaggtcctgacccctaacacctcagaatgtgaacttatttggagacagggtctttaaagaggtgactaagttcaaatgagggcattagagtgggccctgatccaatatgtctggtgtccttataagaagaaatgaggacacagacacacacagagggacagcctgtgaggaaacgaggagaagtacctgtctacaagccaaggagagaggcctcaagagagaccagcctcaatggtggcttgacctcagactcgcagcctccaggactatgagggcatctgtggctgtcgttgaagccgctcagctgtgggactttgttatggccgccccaggaaatgaacacagggacgtagtgatgcaacccccagatggcagctatgtccttttaagaaccagggagaattcaaacacatctgtttcatggtgtaagttactgtcaagaggctctcttaagtcaaagagaaaaatggaaatgtgaaaatgctaagctcttttctttctccttccgtcacccatgttcacagcataatcttgattgtatttcatttgaaagactagcaaaatgcactccgtttctctctgtaaacctcacagatgtcatcagttgatagcaaagccctactgtctgcagagcgagccgcagggaggctgtgggtgccctcgccttgccctcaggaaggggaaaccaaccaatatttcctgtgctaatgtggggctatgaattgtgcctcactgctctgagcatgttaatttgaagaggaaactgtcgattgttccaatgagactatctatattcttggtctacttaggatcaactcaagtgtgcatttcctatctaatggcatctgacagcttgagaagatgcaaagtaaattggcctggacctgccatagtttatagatggagacagggcaggtaatagtgtgagaagatcatgtgtaacgcagatgctgagatgcagaagaaaagatgcccttcctggctctggacgggtctcggtggaggagtgggagctactgctggttttatgagaatgtggggacttgagacctctatgggagaaatgcaaacatttgcaaatgggctggataaatagaaacatgccctgtgcatggctgagaacagtaaactgtggtggtgtgtcagttcctcccagagtggatcaaaggggatggtgtattagtcagggttccccacagacagagacagagacaaagacagagagacagagagtgaccgagagagaaagagagagagagatctagttgaaggaattggttcaagactgtgagcctggcaagtgcacaatttgcagggcaggctggcagatgggagaccctgggaagagttgaggttacagctcaagtccaaaggtggtctggaggcaggatttccccttcctcatgggaccccagttcgtttcctcttaaggccttcaactggttggatgagacccactcacagtgatgtgtcgagacattcaaggaccattttctgatttaaaaagctttaaatgtttttaataaggactttcagctatttaaaaagattgagccagcaccatggagtccaacagccccatcatctgaagggtggtctctgctttactcagcctagtgacttaaatgttaatctcattctaaaaaaataccttcacagtgacatctaaaataacatttgacccaatacctgggtactgtggcctagccacgttgacatgtaaaattacccatcatagacggtgatcattgtaataaaacaaacacatcatccacacttcctgagtcctgagcactttgcacacgctacttcattttgtgctcatgggaacctttctgctgaggttgtcccggacattctcaagtacatacatgaccagatgctgggtctccatggcaacaacatggtctcacttctgttcaagccgtgctttccttcccctgcaggatgtacaccttcagtctagccacagacctgaactccagaaaggatggtgaagccagcagcagatgcagcggggaatttcttccacaaacggcaaggagtcttagcagcttacaggccttgcaggtaatagaacattcccttttttcttttaagtaaactaagcaaaactacactttgtattaacttcacggtggacacagcttcgtaggtgtagcttttgttccatagacacatcctccctgccctagagcgtggtcagcaagggggcctcccaggtctgagggtgccgggggtcctgccctggtctgtctgctctgggcagacagggagccaccccttcatggcagagtgccccaccttgagctcctcaaggcagctgaatcccgagttctcatcccattccctcattcatgagccaagaggtccccaagacgtcacctgccccggtgccttggcccctcatcttttgaggcaaaactctccataacctgggggtcagcagactcaggccagggtccagggcacagcagggcaccccgagctggccaccctcatggggcacatccaggagtgcaggctgccaggcagggacaccaaggagcaggcagcccctccctgaacgcaaacaagtgacatcacatccctgatccctgtcctgtgatctgaagcttcacactccttacagaggagccctcaggaaggggctgtacctgctgctggcctttgtctggttgccacagtagtgaaaatgcctctctgtccttgttcttcccaaattcgtccgcctgtgccctgccatgtgccgcacacgttactttaggatctctcatccttgctatccccaatcgacacaggaggcgctattcctgccccctacccattttacagatctgaaaactggggctcatggaggctaggaagcttgtcggagagcacacagactcctaaccaccctcccatcagattgttggaaggattatgtgagatgggccatccagtgcccaccacggccaggcccctggtgcggagaaactattgtgcccagagggtggggtcacagtagccaggcttattccctagtccccagggcccatcctggtgcctggtccataaatctccagaacaaccaaaggaaggctctgccgggacttgtcagtggctcaccctaaggtcaacgctcaccctctgttacggattgaattgtgtgcctccaaaattcctatctcgaagtcctaacccccagtctcactgaatgtgattgtatttgtagacaaggcctttaaagaggtatttaaggttaaatgaggcaacacaggtgatgcaatctgatccaatctgactgctgcccttataagaagaggggatgaggaaacagacacacaagagggatggccctgtgaggacacagggaggggacaccaccggcaagccccagagagaggcctcaaaaggaaccagccctggcaacaccatcatctctgacctccagcctccaggactgtgggagagtaaacttctgctgtggaagctaaacagtcaacccacacgcagcgtccctgtcgccatttgcacctcctggcagctggtgcaaatcagcccaaagctaagtggccttggcaggtctttgcagccttggtggctaggtgaggaggccttttcttgagaaatcaagaatgtgtctctgaagctgggtccatgagaaatggcgatcagcgttcaccatgtgagaaaggcccagacttgggagagccgagactccccagggctgtggcctggggattatttaaaaagctttaaatgtttttaataaggactttcagctatttaaaaagattgagctagtaccatggattccaacaaccctatcatctggagtaaaacagagaccattctgttttactcagcctagtgacttaaatgttaatctcatttttaaaaaataccttcacagtgacatctaaaataacatttgacccaatacctgggtactgtggagaagtacccaggtattgggtagggggagagcctggaatggaagtctctgctcgtagctcagcctgtgtctaaaccgtgctttcaatggctgaaaacagaacatgcatctgcctgtgaactggcccccctcacacggtcttctctatagggatttcaccccttccctacagtaagaaaagacaactggccacaggtctggtagaatcatggccccagagatgatgccctaatcccgggaacttgtgcatgtgaccttattaggaaagagagtttctgcagatgggattgagtggagggtcttgaaatgaggaaatgatcctgggtcatccaggagggccctaaaccccatcacaagtgtgctgatgagagaaaagcagaggggatctgatacagcagcagaggaggccatgcagccagagaggcagagactggagcaatgtggccacaagccaaggaacacctggggccaccaggagctggaagaagcaaagaataaattctcccctagaatgtcagagggagcatggccctgccaacaccttgactttggacttccagcctccagagctgtgagagaataaatgtctcttgcttggcaccgcccagcctgttatggcagccccaggacaccaatgcagcaccttctgtctagagaattggtgcagccctgcctcattccatagatcccaggggtcagtccattccactccccacagggctttcttttgctttatcatcatattcctgtggcaaagctccacagaagaacatttaaaatgctctgagctcttccaggaagaaaataccccaaatccaaaacttcagcccgcaagttgaaaacttcagggactttgttactaggcagaatgagtttccaagagcatgcatgctttgcaatctacttgcagatcagctctctacagctctctaggatgttttaatattcattctgggataggggcggtgggtgctgcctcttggtgtcagtgtaggcaacctctgcataaccacacttcacatgcaagagagcaagacagcaagacaaaccttcccctgaagctgttccccaggagatgcatgtttctatcctgaaacaaacaactgaagttttccaataagggaaagcaatactattcacttggccttaccgtatatccgttttgaagactcagcccagtgaccctaagaaagtgtttgcatggtgactgcaaacgttctcactggctcaccaatcccatagtttatgcacctaccaaatgtagccagggccaccgagaactgtctggtcctgataaatttcagcagctggaaattctgcatcgtccgggccagcgtggacttcacaagggatccacaggatctggcaggagctgcccgtggtgctgaccccgagaatgctttcaaggcaggtgaaattggcccccaccctactttctggtgtcccttccttcccagtagtttccaatcacttccctaggtacagggacaccacgggggaccactcttgccagagcgagtggccagttagtgcagacccttgagactggatcactgttcacagaagaaagtccagacaggaatgatcagctgcactggccaggtggaaaatgagtcccttcctccctgagggtgtttggatgttaaagccatttgcattttcctctctaggatttggagggaatcagggcgatgctggggctggtgtatgagggtttatgcagacaaggcttacctctcctcacctctcttccttaccctgctcagtaggaaaacacacacaagagctgccctctcattttagcccagagagagctgtgtggccaagagggagcagggcagggatagtgcctgtctgagctgcctcctgcccaggggtcctccctaccccgtccatccctggtcgcctgggctccaggcaggatttggtccccagaaggccccacagcccacctcccgtggcaggccgtgttcgctctgcccccaccatctctgttaatgactcatctttccatgttcatcccttggcccagggagacctgcagctccctaaagcagggatgctgtggactgcagcttcatggaccagcatgtgacatgctcccccctgcggtgccatgtcacagggaggttgaggcatgagtcctgggtgccagagggcagcaccactgggcctgtgttgctgcagggttccccacctcttgctctgaaatggacccccctggatagcctgggcctggctctggggctgggaatgtaggtgaagggccgatgtcagctggcacattagtgccctccagggaagcagccgagcctggtgtctccctccagggtcctggtgcagggcttatgctccacgcagctgtcctggtggcctctagctggctcggcccctagcactctgctctctggtcccagggggggcatcctcagctctcattcactctcttcatctcatttgctgtgggttcctctcaaggccagtccctcaacttgatcagccctgcacagcatggggagaagggtggcctagcccctgaggacagagccccccacaacaccatcccacacagtggaggcccctcccaaagggtagccagcctcgctgccccaagcatgacctttgggctacttccccaaagcacaggctccccagaaagagggcgggcgtgagccctgtaactgcaaggctccaaggccatcctgcggctgcctgaggctggggaggaaggtgccagagagctgctgtccctggctcgaagctgctggccaccgccaaggccagtctcatgccgagaagaagtaaataaactataaagtactgttttcctttagcattcagccaaacagagaatgaccagctatgggaaaacagcaaggggatggatgagggcttctccccttggtgctcagaagcagaattcatacctgggagccataaaaggacggcccctcaacaggtcaacaccagggcagtcctggagggtttctcagaagaagtgtgccagcaagagaggagactagatatatagataggtaatctatactataacaatacatattataatatagatagggataatgtcctaagacgtctctatgggaatgataaggacttagaaaagacagaaaagtagaaaaacggatgtgtcatgataggggccaatcctgtctcttttcattttcttgatgttagaatgcccagaaaataaaacattggaagaaattgaagagattgtcaatttcatgtcctctttcattctaatgatttgggcaaaatgggctgagctattgactaacgaaggaaaagattccctcgcagttgctgggtgactgggagagctgccattggtgcaagtccagtgagttggatgttaaactgcatgtgccttgcttcctgccccaccccccaggctaccgttgcaaggaagagcgtgctggtggttcgccacggggagagagtggatcagatcttcgggaaggcatggctgcagcaatgctccactcctgatggtaggtcacactcaggcgggtctacggacagaaacactgtagatctaaccaatgagatctccttcttaatgaccttacatggcaccagatcccctgaggcaccattctgtagaatgaccatgtgtagactgtatgtgtggaaaacgtgcctgctacatcttcctccaggggtgttccatgtatgcatttgagtgtctgtgttggaacctctccaacctaatcttaactgatgtaatttttggctatgctgcttaacagatggacgtattcttgaacatgcctcttgcacaccccagcttttctcctctgaatgccaggaagtaagaatagtgcttataaatacacatacccacaagccaacctctgtattgatgatcaatgtccacatcaatgctaatctcctaataggaagcctgtagtgtcacaatttctaagccatgacccattacataaattaaggcattgaatgtagtgacaaaatcaattcacagttgctaggttagccgaacccttttgggatccccctccagaagcccagcagacccaagaaagtggtaaatgagtagggaaaaccattggcagatgacaatcacacaccagaaaagattctgagcagataacatcatgatcaagcatatttccaagaactcacagagctaataatatggtcacctctataaaacaagatcaagtaaagatacaagagcttaaagcaacaataagacaataggtggctatcaggatgcattaacaaacatataagaaactttttttcaataaaacagtttttttagctattgaattactgaagctatagattgaactgacacaccttgtccatggtggggagaaccaatacaaaacaatcaacaccaaaaatagttattgaacttcatagaaaaagaaaaaatatttggtcatctggacaaaagatcaagtcacttataagggaaaatattttaaaggcactggaaatccccatctgaaaggaaactcctggtggatcttttcccaaggtagagaggcccttgataaagtgaagaattacatctagtttgtctgaattttgtatattgcagggtttaataaatcacaaggaggtatagccacgtcctcccccaaggtgaccaacctcagggaacacaagggagatttggggggctctactggcctctccccagctcagctcacttttggcccaggcacccacatcctcacagggcccctcacctcaccccatattccacacagactctgctcccatcaggacctgaccttgccccacatccttgtcctctcctgagctctgccctctgcccccagagtgatcacagctgaagtgtcaatgacagcaaaatacctaaatggagtgtcttgacattttagagggggatcacagatgcctttgagaacacaatgaaattgatggactttctctctgattttaaaactgcctttcccaagagctaatgttggcattgaataaacacctctaaaatgcagtgttcaaacaagagtctctgcccatggaaatcccagggagggagtcttcagaaaactcctatatggaaactaaaatgcaggcatgaaaaattgccccccgctgacccctgctgccccccactgccccctgactctgggtttgtgcaaggctgtgggccaggatgaaggggcctggcatattctggggtgcaaagggcagggcctgctatgtatggcagagcaggtctcaggaaggtcagtgtggctgctggaacctcctaataaccaggaggcttggggtccctttggagaatgtgaaggcaaaccagagtgcactggagggagcagtgtgtcgtggtgtcctgtgtgaggataatcagtcatcctgacgtggtgacatgagaccagtgccccgactcgttgaccactccctcttgagtcagactctgggctatgggtgttacctcactgacacctcgcaatcgctactctttccctgttttttactgataagagagatgaagtcatttatttctggctgcacagtgaggagatggtgatgccaggatttgctaccagactgtcagatcttagaactcaaggtcaaactccacgtgaaccctggcaccgggcagcctctggtgggagacagtcccagtgagcccacttccagcctggcttcaagcaattgactaaagaatgcacaacacaggcatctccagctcaagcactctgtcccctgagcaagaaggatacgtttaaagctagggggatggatcattgatgccaacttcagattcttaccgagttacactaaactagtcatagagacactttatcaggttcttcatcaggaaaatgtaagagtgaatcttcatggggcattttgggaggacaaagagggttgcatagttcctggggctgaaacctaagttgtctgcatttgagaaaatgttgtgtgcacagctgagcagcactttcttctcaaattgaagccacgttgcagagaatgttcagaaacaacacagttgacaataatttcaataataacattgctgttagagtgggtcttggtcttgggagttttgtggaacaaatctgtactaacttgatgaaactgaacgtctgatgcttatttatacttcagggaaatactacaggccagacctgaatttcccctgcagtctgccaagacggagtcgtgggatcaaagactttgaaaacgatcccccattatcatcgtgtggcattttccagtccagaattgcaggtatgtttgaggactgtctagtaggaaaggtaacaataacagcaacactgattatggctagcaggcatccagcctgagccctagctacacaccctttgatacagtgttagctttgtctccagtctgctgaggaggctggggcacagagaggttaagcaacttgcccaaggtcacacagcaagaaagtggcaatgtagaggtttgatctaggaatggatgattcaggaagttggcaggaatgaaagaaaggcatggaaagaacaagagaggggaggaaaaatcaacaaccaaggagctccaaggagctcacttttcaaatggaaaaccacatcctctcattcgttggttttatttcaaaatctgtcactttgggcttttgtttcatgtctggcggttctgcttctacgtgactgagtttatgtaaacagaagagaccattgagttcatcgagtcttcatttcctaaattcagaaaatggaatccagagaagcaagttacaccaatggttaactgcagagacccccacggcccactcgcccagggccccactcagaggtgtgctcagaaatgtttacccacctgctccaggcagggtgggaagtccgagttatagagttatagagttagttatagagttatagagtcatggagttatagagttagttatagagttagaatcatagagttatagagtcatagagttatagagttagagttatggagttatagagttatagagttgttatagagttatagaattatagagttagttatagagttatagagtcatagatttatagagttatagagttagttatagagttatagagtcatagatttatagagttatagagttagttatagagttatagagtcatagatttatagagttatagagttagttatagagttatagagtcatagagttgtagagttatagagttatagagttatggagccatagagttatagagtcatagagttatagagttagttatagagttatagagtcatagaattatagagttagttatagagttatagagtcatagagttatagagttatagagtcataaaattatagagttagagttacagagtcatagatttatagagttaattatagagttagagtcatagagttatagagttatagagtcatagtgttacagagttatagagttaattatagagttatagagctatagagtcatagagttatagagttagttatagagttatagagctatagagtcatagagttatagaattagagttatagagttataaagtcatagagtcatagagttatagagttagttatagagctatagagttagagtcatagagttatagcacttgctgagtgcagtggtgagaatactgcactccccgacaactgattccagactcccagtgtgagctcccaggacactgagtcgggaggagatggtggtcccaggcctctgtccctggcttgcaggtgacattttctgtcttcctcttctcttctctgcatgtctctgtgcacagatttccccttttagaagggcactgtcacactggattagagcccaccctaatttaattgattgaggtgcatacccttattttaacttatcactctgtaaaaatcctgtttccaaatgagtcacattctaaggcaccaagggtgaggactctaacatgtttttcaagggaggggatacagttcaacccagaagagcctccactgaaacctcgctcatcagctttcaggctgtgcaatttttgtgctgtagggactcccatatttccctgagagcagggcttccagtatcacagggggaaaggcagagtacaggcttttccttccacgagcttcagtgggtcttgagttttctcaaacgaccacaaatgtgaagccccgcccatttctgagctcacagtggtgcagatccaaagcccaggcccacgaggctgcttctctgctgaaggtcttaaagcctgaagtcaaggtctctgctgggctgagttttcattgggagctcaagtctccttccagactcattctgctgttggccaaattcagatccttgcagtgggaggactgaggtctgttccttgctggctgttagctgggggctgctcccagccctagtagaggctgcccacattccttgccatgtggtcccctccatctttgcagccagcaatggagaatgttttgctgaatccttctcacttcacacttctctgacttttttccatgactggctggagataatcactgcttttaatgggctcaccaacttgtcagccccaccttggatcccttcccttctgccataggatgtaattgtcccaggagcaacagatcattctggtcatgggttccacccatacttggaggctgtgcagggtgtgtcacaccagggggtggaaacccggggccctttgaggaccctgcctaccacagggagcacatggctcatctgccatcagaggctagaattatgaaggggcattttctgcctttttcactattttccaggggacgcgctactggacagtggtatcagaatcagctctgtgtttgcctccccagccctccgctgtgtgcagacggccaaactcatcctggaaggtcagtgagaacctcggtgagcctctcctactgccttgaccttggggctattctccaaggggagtgggaagggagtggaggtggaattggatgactggcaatgaatgcccacaccaaagtcatcaggcaagtacgagccagccctccaaggatgctggcaggcatgctgggtccgtgagcgtgtctggaataccaggaccgtcagaccagtaggggctggtgtagctaaatgccagggcctgtcctcataccgtttctctttggcctccgtcagctaggcatttttaaaatacacctggaaagcggcattcgaaaaccttgagagctgggaactgctacggttccttgtaagtctgaattgcatgacccttcccagggcaatgcactgggccagtggagctgtccagcgtcctcaagggctgatgtgtgtcaggaagtcctgggcagacccttctgcagctcccatctacgggaagaagaaagttcctgcccataggagagcagcttgttccagaggcctgggctctgccttcagcctgaaccctgtcctgctcctctttgtctgggaagagggataagatctcggtccccaggcagggactggccgtggccaggagcatgggtgacatgcgagagagcatgtcgcctccatggtgacaagggagagggcagagcacacagacacagatgcagcaggagggcaaatgtgggggacagggcttgcctcgactttctcagagacctaggaagtaaggccaccagcggaaagtgggggcagggactgtgggaagtttggggtgcgccgaaggaatgaatggctgtcaggcagaggggcccaggacatgggctgggagatgcagagtgaccgctgggcagcactcagagcccacccacagttcatgagcatgagtttaaatggagatgcatcagccgggctagggggtctcttccagcttagaccgggagtaggtggagagtgggatgcaggtaagggcagggttgagctgtgagtacggtggagccagaggggacaggaagacttgagggcatagtgagggggtgaccgtgcccatggactttcagctgggtcagcgaggaggccgagcacgggggaggtgagtgcaggagaaaggaggtgatctgagtgaggctcaaggtccacgagggggctgcttggagacagcagagtttggcactgcaccatggcggggctgcagtggctagaatgacaagtcccaggtggaaggaatggatgctcaaggcagggaggaagccacgtcctgcaggaggtgggcaggaatggaggggccatggaggagccatcccgcagatggtggtcttgctgggacttgcacatggggccacatcagagccggggccacgaggggccgggaccttcacaggaggagccgttgggacagcagtggattcaatgcacacatgtgcattgccggttcccatgtcctcagatccccttcgccccgtcagagacgctccctcagagcaccttcaaatccaggtgcccaggaagccccagccaggagcggacctggttccaccccggagcctctcaggctcatcattcctgtcctgtgctctcatgaactttccatcccatagtccagtcctagtttcacgaggcacagaaatccattgtatcagcatggagcatccacgatccaccttccacacacttaaaaatgtcaagacactttctgcccacctcagtcttgcagcttcatcctttcatttcccacccaactgtggcacaggaccccacccctctgcacggcatctcgggtcacaagacagaaatgcagacttacttcactttgccttggaggttcccatgttgattgcatcacggcacctctgggctctcaatgagccagatgaagatcaaagaacaatatcagcttctttgaccaaaccacgaaaggactcgcgaatccccaaaggcctgacggcagtgtagccggaggccagaggcagctccacccgagggcaagcaaggcttccacaatccttgtctctcctcacaacgctggcatgcacatacacagcacacacatccacacacaccacacacacaccacacgccacacacacactacacacacccacacacacaccatgcacacccacacaccacacacacccacacacaccacacacacccacacacactacacatacacaccacacaccacacacacaccacacaccacacacaccacctacacccacacacacccacacacaacacacaacacacacaccacacacataacatacaacacgctgaacacacataccacacacacaccacacacctcacacacaccacacacatacacacaccacacacacgacacacaccacacatccacacacacaccacaccccacacacacccacacaccacacacacaacacacacccacacacacaccacacacaccacatacaccccttggggtttcacttgggggctgagtcacagaccgcagaggaggaggctgtgatctttgagagccatgaccccagcccaggtgacagggtcccgcgatgtccgcctctccctgttcccatgctcacagcagcaggtccagccttcgtgttttcaggaaggcctgagaaacaggacgtggcctttccagctctgcgctttgggagggacgagggtggcaagatcagaaatgtgaaggggcagggtctccgagtatctggggacccttcagtgtgagggtggctcttaataactatgatggaataaagcaaaattgatatatagcaatttcatccctggttgtttaggatcaatgtatttataattaaccaaacacctataatcataagatgtgaaccaagcaagaaatgcacacaaatatatgacaagaggggaacaggcctgtgcctcagtttcccctcttctcccctgtcgctggtctttgcaccccaccactcaatgagcgcattttgttggaaaccacctaagatgctgctgttcttccactaagtttcagaatcactttggtttctgccactggctggccgcccactagcaggccgtgcgagagtccccaggtcgcctgtgcctgccaggccagcaacaacagtctcctctcactggggcttttactgcctcagcctgcaagtttcccttctagtgaaaaccttcgtctttctttccctacccaacctctctcaccacgataacaacaacgaataaaaaaggaatctcttggccagcctttgtaataaaagaatacgactgactgaaaacacttcataattttatcttttttttgtcattgttcgtggttcctcattaacacacttattcccatttttggtggatttttttacttctattatttgggtcacttgcatataaaaagctttcaaaaatgtcttttgccagcaataatgtcaaaatctttaatgtgatctctcagtgacctttaagtgcagatgatgatgatggtgatgatgatggtgatgatgcctgtttaaagggcatgggtttataaatcctctgttaattcagaaaaacaaggacacccagtcttctttacaaggcctcagacatgatcaacctgcttatcagatggtgtctgagatgctaaggtgctcaactttgtttaaattcaatgtcagagaatgtccacatgaaccatttcacagccaagtccacaaaacactggcctgcaagaggtcttcaaaggaaagagacccatggccacacctgtctgggaagctctcacactgttccttcatcttatttgttcacaatggaaatgagctcttcacaggcttgggggagatttcgggggcctggtttatcagggaggacttgggggcccagttgatgggggaggactcggggacctggttgatggaggaggacttgggggcctggttgatgaaggaggactcgggggcctggttgatgggggaggactcaggggcctggttgatggaggaggactcgggggcctggttggatgggggaggactcgggagcctggttgatgggggaggactcgggggcctggttgatgggggaggacttggaggtctggttgatgaaggaggacttgggggcctggttgattggggagaacttgggggcctgattaacttgctttaactctcttttctaagcatgcttgatgaaagagctccttccatggacctaaaacacatttgaggaactgattttatgtccagcatttgagttcaatgacatcttctccattcccagtgaaaacattcaggtctttttttccactcaaaaagagatggccttactttatggctcttcctttaatcaaaatataaaatgcttgggaaatgtgagttgcagggagtcagaatattccagaagatggctccttccattcttcacctcttgccccgtctgtgtaagtgtttatcaggaaagtgcctcatgaggccaacattcttcatgatgggtcacatcttgtccattgatcattggatctgccatgttggaggatgcagccggtgggctggtttcacggtggagctgtgctgggtgatcaggtgagccccagcctaagcctgctgcctgggacactcaccagctcctggaagactctggcccttcctggcacacagggggccatcactcctctgataccttcccactgctcgtcagttttgacttcagaaatagcacagctatgcctaatcacagaacggtatttgccaagaagaaaatcacactgtttaaaaggcatgatttagacgtgtgtgtgacggtctgagatctaaaaggagacttatttatgcaaagtcagggtggatgttgaggatgataaacacttgtattctgttgaatccagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggtatgctgttctaaagttctctgccactggggcttttccagttattgttaaagaaaaatttcatgacactgttaaaatggtaagaaagactttattcaagagggaccactgcagtggggttttgcagcaggggagagaggtggggctcaactcctaatacaaggaaaagaggggagttatagccacagagcagggtgggggtcagtggatggaaaattcctgagaaggtgggtcattcttgctaaactgacctaaatggagactcttgctgaaggcaggccaaggtgatcagacatcacctggggggtggtagaggataaggaacttgatcagatgtcgaaggtaggaggttcttgctaaactcactctgcaagaacagacacagaagcccaagggtcaagacctcattgagaagaaggttcagaggagctggactggagtttagtcaaggagagagtctttgtcattctccacccatgtctgactctgccatcacagagccctcctggtgttgagtaagaatgtgtgctggagattgactgtcagtgctttgccagttttcagcacaaaactggagcctgcctgttgaccatgagcctgccttgaggcagagccatcctggaagaacgttctccttccccagctaactgcagctgagccttcctaatccctacgaaagtgccagggcagcagcctctccttctcatccttccaggcccgcgtttcccctgtccgccctcatgccggccgagagctaccaggagtacatggacaggtgcacggcgagcatggtgcaaatcgtcaacacctgtccacaggacagtaagtgcctcaccatcctcagtatgaacagcccctggggcttggggaattatctctgagatggaaattggccaattttctgaacctatgaatgcccctacttctcctgcctgcccccgcccccattctccagcaacaaagttttcatcactgctgctgctgctgcagtaaccgggtgcacagacacacactcccctgccgcccaggccctgggaccccccatcctgggactgagtgctgatgggaggggaatgatctctgagatggaaattggccgattttctgaacctatgaatgcccccacttcccctgcccgccccccaccattctccagcaacaaagttttcatcactgctgctgctggtgcagtaaccgggtgcacagacacacactcccctgccgcccaggccttggaaccccccatcctgggactgaatgctgatgggacccaggccagcagggtcagcacaatccacccatgtccaagggatttgagtcagcttcctgggaaacaaaagagacagagagagaaagaacaaccaacttccaggtggcgcccccttccctgacccatcacacgggtctcctaaccctcccgtgttgctttgtcctggatgaagcatgcacagaagcgctgacttcccacgccttcccctgagctggcagggacaagcgtgtctcctgagggagacccactcggcctgtggtctccaggtgttcttatctaaagcaggagtcgtagcaggctcgtgtgacaaaataaccggctgacctttctaaagtgaatcaggtctggcttgggcgtcagccaccgctacatcccagtctgtggctgacggggcccaggcagccagcgaccacagggggtggctcagctcacttcctaggcctccctgaggctggtgggcagctgctgcgtgcagaggaatccatgagcgagggtgggacgcaggcatcactgagcggttaccagccacactacttctagcccaggggtctcgccaggcttcggggcactctgagatagctctgccccccaccactttggggaccccagtctaataaaaggtgctctctggggctgctttgacctggaggtgttcttgttttccacagcgggtgtcatcctaattgtgagtcacggctccactctggactcctgcacgcggccactgctcgggctgccgccccgggaatgtggggattttgcccaactcgtgagaaaggtacgcgcccactcttggctctttgggccacaaaatcaagcatcccgaagacacaggtttatctcatccacttctcggaatgaaaacaagtgtccggctgacccagggccaccaggatccacgtgcccccggagactgtgcccaccggctcttatgcgaagggtgacttcgggctggggctggtggataggtcagtcaacctcatcatcattggccacttgccaactttttaccagtcagctcatgccatgaccccttgcagctctcgtagaaaaacagacggtccaggaaggagtaagcagtttagatgaggagggaagaaacgactgtgggactcgattctggcctcttctggggacctggggcagggcggctgatggatgaaaaggagccccttgatcctcttgcccttggagtcacccagcatggaagaagcttgagctggttgtagctgccagagtgctcaggctctggcaagggccttgtgaatgacaaacagaggataacgcacacgtgacatcttggacaaccttgattatcactcagcaaagccagagggtgatgtccagtccatgggtgaattgaggcaggcaaactcaggagtgcagatcccaccccagtcccagcccttccctgcagatctactcaaggctggactcaccacagtcctgacctttttatgaaattcatcagtccactggtcagtgcccaggcagcacgtgcagcatagacaatgcctgtcatcggaggtgcttgaggccctgacctggtttcttcacatagcactgccacaggaccacactggccacagcttgtttgccataagttgtgggcagcagtgggggttgctgagtccccccaagaggtcaggggcttcagaggagcccaactcccgggcccagcccagtgacaccagccaggtgcctgcaggagggcttagctctctagctacgcctgcctcagcagccagatgagaggttacgcacatgaagagcatgcctgccgtgggtcattgtcactcagcaattaggcatcagacacccgaatctccctttcttgctccattttcctctgcacctgagtagaaacatgcttcccctgcaaaatgtctccagggtggtgtgtcccaattatgatccagacatttccgagcgccctggattcttgagccaccaggtgagcattgtccaaatagggcagctcaacccccctgggccacactggtagaggtctgcatggattttcctggggactgtccggggcagccccggcaccacctgctcccaaaatgttgctcttgcttctgcaaatgggtctcccacacatgcgctctgatgcattcctcctgtccctgccccgcttcccacagtcccatatacacataccaagcctccagccccaggcgctcctggggatccacgtaaccaagggtggcagcactgcacacaccagctgctgacagttcctcaaacccatgagcctttgtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctccccgaccagcccatcaccgcccctcgcccacagcctctacaagcgtgaggaaagaatcaccctagggtcaacaccagcctcactcagacccccctgccagttggcatttttgtaaatttcatctgcctgaggaatttctagacattagaaagaggaaggaaagaaagaaaagaaaagacaaaaacaaaaaaggcttcaccacaaagctctgttctcacacatccatttcacagatgaagggatggaggtctaaaggttcactttgtgcttttcttttgggtctgaaaactcaatgtctgtgtctttttgtgatgctgaatatgagaatatgagtcactccttaagtggtggatggcaatctccacctcagcctgcagacctttgtggtgggggctgttctactcattgtaggatgtaccaccttgtaggacctctacctgctaggtgtcggcagcacctccatcctcagttgtgacaatcagaaatgtctccggaattacccagtgtcccctggctaggggacatcccccacggggcaccgccagggcagatgttggtgccattcaatggtggcagtgccagcctgggcagtcgcagaccctccaaagtagaggtgtgcctgacagttggctttggagctagtctgaaattgatggacttgctataagatattaacaagtgatttaaaactctgttccagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtcaaaactgggttgctgctccgtgctgtcaacattcatgttactatgtctctgtggttgctgtaaccaatgaccacaaacctgggggtcatggaaagaacacaaactttacacacacacacacacacacacacacacaggcacatacacacatgcacatatgcatacaaagacaggcacacacgagcatgcacacacacaaacacgtgcacatacacatgcgcacacacatgcacacgcacatgcacacacacgcaggtacacaagcatgcaaacacacatacacatacaaacgcgtgcatgcatacatgcacacatgagcacacaaacacatgcacacacttgcacacatgcacacaaaggcatacacatgcaatgcacacacacaaacacacatgcacacacaggcacacacacgctcacatgcacacacacacacgctgactctcctacggttctggaggttggcattttctcagcaggctatgtttcttctggagcctccaggggaggatccttgccttttctcacttttagaggccacctgcatcctccctcctcaagtacagcggcgtagcagcctccaagctctctcagtctctgccttcacagccacatcgccttctgcttctgactctcctgcctccctcctacaagggcccttgtgttgacactgggcccacccaataacccaggatcaattctcatctcaagagccttaaccacacatgcaaagtcccttttgccacataaagttgcatattcccaggtcccggggattaggacatgaacatctttgggggttatcctgtagcctgccataacataccccaatccttccaagcacagcggagctgcccgtacagggcctcggacatagggatttgagacactccccttgcaggccttttttggcttctcctattcttgtttctgatcacgtagaggagagaagaggactttgccagtgggagaagtaggctcccccgatttaatggggccccaaaagaagggccacgagcaaagtggagtctgtccatgatggtgatgctgaggaagctggtccagcaggggatggggtctccccagtggggagtctcatgccccagcccacaggtcacacctgctcccacagcccacacatgtggtgcctcatgctgcaggcagagatcccagcacggtgtagtgacagtccatcggtctttcatctcttctagccccctgatccagtgcaggtgttatttcatgattgcagtttggggctgtggtggtggctctgtgagtgccttttatagtgtgaatgcagagacagggcaggaaggacccatgctgcaccctcagcctcccctgtgagcacccaggcaagtggagggcagaacacaaagggagctcttgtagaaataaagatggtgaacaccccgggctgtgacaaaaacggcccacattgtgtagaatgcacaggaggccagacccaataaaagtttccttgctgttttagtcaatcaaacacgacctcctgagaaaaagacgcatctgtctgtcccttgttttatttcactaatgatgtagtttttctgtgtccaaacataaagaagtttgaagttgacacagccacagagagcagagcatgcaccccactcacaggcctgcttcgagtccaggccataccgaaatgacgtcttcagggagattgttctagacgcatcccagcagataccgactagagaagagatggattcactgggatgtaggtggctgggcagtacgtcctgcaacaaatacaccccaccgctgggcacctgggtggttgttctttctcctcggcaagtgtgtggttgggtccaagtccctcctggataccacagtgccacgctcgctaatcatgatgatgaattaaagtgctgcaagtcaaggtatggcattgaaatcacagtcacgtgttcaggtggtctgtaatgaatctctggattcaccttctcaggggtga

SEQ ID NO: 12813 - DNA, 4900 bp, Human
  misc_feature (1)...(4900): n = A,T,C or G
ttgtaaagacatcacaggaagatggaggaccacacagctgtcaggaggaggctcaaaccaaggtgctcatcgctctgaacttccccctttacatggtttctgccttggccagccacttttccatgaccttctaatctccctctgatctcaccattcttgccatctctgcaacactcatggctgtttatacttcatttccgtctattgtaatggttatgaggaatcagacttgtcagagaattctgtaggagatgatatgtacatggaaatcctagaggccatgacttggaagaaggatctaatcaggcccttaactgtatcactgacaacagtaaaaataactgtagattttagaaaaatgaaatttttattctcaattctcctcatttcttctttgattttgaaacaaaatgaaagggtaacatgaaaaacaggctagaaactggagcttattgctctctaagcaatgcaaatcacatcattttaataaactacagaagtcaaaaccgagttttcatattttgcatgggaagtatcacatttttaaaaattactgcagataatcaagttttctttgccaatatgctatgtttttgataaaaggaagtagaaaatagctatagtttgaaaataatatattttaaaaagaggtgagcctgtatattttttaggcaagcacttttcttaggggaattagctaaattattatctcaattttctatgtagtttagcctctcaacaccggtagtaaagtagtcaaaaacctacctttatatttctggatactttggtttttttgatgccagactagctttctggaaacgtgtcagttggctaccaggatcggtggcaaattccactgccaggctagattggggcaggtggggagagagaggcactatgtctctatcagaaagtcactgaagaaacactgtttttggacgagttcaagcctcatctagatttttagtccagtagaagatcgcgaccacctctgcccctccatagcctacagccagagttttagagtaccaggccttgcagcttggtggagatgatgtacaatggatgctacctggaggcagggactgtgtattataatggcgccgtcccctgtgcctagtacaccgtagtttgacacaaaataagcactttgtaaatttagtccgaaggaatggaaatctcatcctacaatccattcagttattaatagagcaactgaggcccagagacgggcagtggcctgcctgcctacagcttcgtagagagttctcagcatgcttactttttttttttgagatggagtcttgctctgtcgcccaggctggagtgcagtggcgcgatcttggcccactgcagcttccatctcctgggttcaagtggttctcctgcctcagcctcccgagtagctgggactacaggcagccaccaccacgcccagataatttttgtatttttagtagagatggggcttcaccatgttggccagggtggtctcgaactcctggcttcaggtgatccacccgccttggcctctcaaagtgttgggattacaggtgtgagccaccatgcctggcccagtgttcttttcatgaaaataaaatttctttttttatatagcatatgagctcataactggcactgtatagcacctgagcatgttttgatttggtctttcttgttgaggggccttgttacgttataccctggtgtctagactttggcccaaaacctttgagatggagagccggtgtctgtggtactgtttgcaatctctggttctacactcagggttcattcatgtagatgcaaatacagatggtatcataacttccaacctctctgttcctcatcacagctgttcagtctcgcttgaagacagattacggaaggacgaggccaaatccagattttgtggtgtgaaaatttaccctggtgtgttatcactaccaggggatctgacctcagccaggagcagtgagagcctcctctccccagccatgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatgatctgggaagaaaagtgtggtcaggacactcttgggacgctcttttgatagctctctataagggagctgctttccatgtcttttaagattttccttcttttacaccaatgtaatgaatgagcaacagaaaatacggatcaaaacccaatactatgtctcttttggcaatgcaaagtatatttttttaatgtaccacagaaatcaaggctagggcttcatgtttggtaaaagaggtattatattctctctacatatagcaaataattcatatataaatcgtgtttttcctattataaaaagcagagattaggaacaattctgtctacatatagcaaaaattcatatataaattgtgtttttcctagtatagaaaacagagattaggaacaattatagtgatcattaatttttatgaaattttacctatacattaatgttagtcattttagatatgctttttaaaaagtatcaaataatttccccatttctctgctgtaatgtatctaattatctaactgaaaaacaaaacaaaacatctttatatttctggaagtttctttgagccctagccttggctttcagaataaaaatcaggctcacgcctgtaatcccagcgctttgggaggctgaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12814 - DNA, 19762 bp, Human
ctactatagtctaataaccataacactcctacagctgactttaccaagaggcagtggcaaaactcaaatgtgaatctaggctttctgaggctaactgcctcaagtcacggagaaagacatgcccagattattaaaaacattattcaacatagaactgccctaacccaggaacagagtgcctcagcaaagctggaaactgaatcaagtctaaacttggcctctagtggcctcagaacatccccactgtgatatctttctgatgatatcccaggtcctgtatgagctaaacgggaccaaaaagggtcagtctggcagagagcttctgactgtgcacacttctggtgggaagatgaaggtctggaccacgactatccatccaatctgatgggagtatgggaggcaggcagcaaggtcttgtggagaccttactcattccagcctggcgcttcaaccacccaggggcaaagctgccctgcttaatgctcaccttggctgctgtggtcttccaggctgaccctccagtcatcaccccggggctcggcatgcagttcggcgtggatcccagagatgaggccaggctcctgctggggccgcagggccacatcacacaggtcggccctgtggcccaagcgataggtgcagccagccccggcgggggggtggaaggtgtagagatcaccgcccctgccgccccctatgcgcagcagttggaagcagggcagcatgggcggtgccccctctgcaccacctcttccacttcaggcatccatttcctttcccactcctgggccacgcaccgctggcttaagttcgcttcccagtctgatgcaaacttgagttgtgctgtatgcggtttcaactttgagcacactacctgaatagcccaaattcagagtgcaagcagcctaggactcaatgcaaaattggttaagccgacttgcaaatgaaaaattccaggaaggtctccgtgcaatgcaaactcaggaacacgtcctatggcacctcacttgagctggatcctcagatcacaaaatatttggggagcctccaatctgcaaggcaaggatactttaggcagctcctgtgtgtgtcggggtggcggggcgcggggaaggaggtcctgttatacacacgtctacgtgcaatacgaacacatcacctctgtgtaattcggagaagagcagcttcttcctgtcaaacttgcttatcctaatagagcactcctgcttgcctgcgccccgatcttctggccaatccctcactcataactggttgaacctccgagggcaatgaatccactgtcatcccccaaaagaaagtgcaaacgagtccttaagtactccaacaaattggacctaaacccctacttcccggcttctctaggtgggataaaaacaggaaggagctccccgcgatcatgcaaggcatacccggccttttcccactccgccccagccccgtttcggatctacccgcgcggcgcagtctccgagtagcctcctcttcaagcagtgccagcctgtgcggcggatcccgggaccccttgggctcctcggcaggagccgacgttgctgcatctgtttgacagccaagaagccggggccaggaggggcgcggcctctgcgcgcgggcagcgcctacccctccttcggaattcccgggcccgaacttcgcgccgagcgagcccgcccccgtgccgttcccgattggccagctcatttgttctcttccgcgccattggacagcgccccaagatctcccgccttccactttttctgattagttcacaagttttcccgggttgccgcagtgaggaggagccgcctgggcgcggagatgctccgacgcatttagtgggcccaaatttagacgccactgcgcctgcgtacacctttccccctcctcccaacagagtgaaataggactttagggcgcccgccttgcgcaggcgcggtcaggggcagaggcggggccgggagcgaggcgtagggggtgtggccaaagcgcagtagggggctctcgcggttggtaagggacgttcgggaagagtcggttgggggcgggaaggggctgagcgggggtcctgggagggttcaaggggtccaaaggggaagggggtacaggggccaggtgaagggacagatgaagagatcagaacagccttagagctcacgggctaactgggtgaagcctcgggtatctaggggagcagtggtgggagagtagagccggctagcgtacagggggcgagggcaggctattgagagatgggggtgagggtcaggaccagaataattccttcagaaaaaggtagattaggttgtaaaaagggacgggagtagggatcccagattcgggtaaaaaatagattaatgagggtgggagggtgggaggaagatcttcaagtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtaaaggcactgcccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcgggtggacctggctataattcaaggattatgactttgttattgtaggggctttctctttggaaggtggcctgaaaattgaattggagtgtctttgtttctcctcttgtccaggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtagggatccatccacgccgttttctcaggcttgcttgctagtgacccttcctcactggaataaactccttaccctatttcggccctagtttccagaacgtactcatttttatgtaagcaattagttcctacagtgcataaataataaagcagtgtgctaagtgctagggatgaggataacaatagtgaataagacaaatcctgacttaaatttgtaattaataaggaatctaaaatcctaagaggggagatagattgaccaccagctgatggtaaagcatggtatgaggcaagatgaagaagtgcaaactagaggtagagacccagcactgtggcagtgtgggttcattctgatggaagaaagcctttacagaggacatgctgtgggagctggccatgctgtcgtattatctgtaaacattcttattcttgtttcatgtgtcttttcccagatgtactgggatatcattctgccattttgctccagaataggattacattagaagaagcagcatgatgaagaaggaatactagactgggtgtcaggagacagagactctatttctagtttggctaccagctagaggacatttggcaagtcacttaatttccctagcctacagatcgctgctactaaagaaagaaagaaagagcgagccagatatggcggctcacacctataatcctagcactttgggagctgaggcaggaggatcacttgagcccaggagttcatgaccagcgtgggcaacaaagcgagactccgtctccacagaaaataattagctggctgtggtggcatgcatttgtagtcctagctactcaggaggctaaggtggtaggaccccttgagctcagaagttgaagactgcagtgacctatgatccagccactgcattgaggcctgggtgacacagtgataccctgtctctaaaaacgacaacaacaacaatctcttatagtcctgggtctcagagagctgcctcaggagccatgttccaagctggattaaacttcacgtgacattggtagacgatttctctaaaggctggcactgtgttatttatgtactgttctctcagactcctcataaagtatacctaacactcaataaatgcctttttttttttttttttttttgagatggagtctcactctgtcgcccaggctggagtgcactggggagatcttggctcactgcaagctccgcctcccaggttgacgccattctcctgcctcagcctcccaagcagctgggactacaggcacctgccaccacgcccagctagttttttatatttttagtagagatggggtttcaccgtgttaaccaggatgatctcgatctcctgacctcgtgatccgcccgcctcggcctcccaaagtgctgggattacaggcatgagccaccgcgcccagccaataaatgccttttaactagcacctggcctcaccatattgatactggaagcttacgacctctctatgcccattcctccctcaaacttcttgcccttaaattagaattgagaagtccctgtgtgttcttccaacctttccacttaaaatgtgtggcctaaaaataaaaaaataaataagacaaaaaaaccaccaaaaaacaaaaagaatgtgtggcctaatgatatacacatttgatgttgaatcctcctgtatgtagctctctctagggagatcatgttccacgatctcagccagactttaggtcctgtgagtccaggcactggactcaacatgctcaatagggctttgatgaatgatgatgatgtcaatgcagacatccccataccccagcttcagcacccccttcacctccccacacggaagcagaggggtcctcttttccttctcctggctatgtttatgccctcaactatccttccagcactggagacaagtctcacctgcactaacctgtctttgaaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcaggtgaatgcaggggtagaaaggattcaaattcataacggagagctgggcagtagcttccaagcaaagaacaggtattgcagaaaagaccctccatgagtagtgagtagtagagtgatgagacctttggtgaaaataaacacacatgggctagaaagatggagaatttgggtacttttatcttaattcaggttgcacttttcccccaagactcaggtggcctcccaccacttgaagccctgcttccctttctagtaggaaatagtttgcctccctactttactccaggtaccaattcatcaggggtattgtggagggcagtgaggaaggtgggtataagggggctatggtggactgggagagagagattattcagtcctcaaactcagtacttactctgccatctctaagactcagtgaccaaattagcctgagtcctgccttcgtggatggaactgacagcctcgtgggggatatacacatccacatttaatttaatcataattaattgcaatcaggaggaatgccttgaaggagaaggactagaaagcactaacttagtctggggttcagggaaggccactgtaaccagttgacatgtcaaggaaagaaaccatagccctgggcgcagtggctcacgcctgtaatcccagcattttgggaggccgaagcaggcagatcacaaggtcaggagttcaagaccagcctggccaacatggcgaaaccctgtctctactaaaaatacaaaaattcaccaggcatggtggtgcgcacctgtaatcccagctacttgggaggccgaggcaggagaatcacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccataaaggaaaaaattgatccattgactttataacatgaacattaggaatagccaaaaagaaaaaaaaaagctatatttatagctcagatcacaagaaaagggtaatatccctaatataaaatgtgtgcctagaaattggtaagggaaagaccagcaatccaatcagaaaatggacaaaggagatttatgaaagaaacttagaaacaagaagctaggccaggcacagtggctcatgcctgtaatcccagcactttgggaggccgaggtgggcggatcacttgaggccaggagttaaagaccaacctggccaacatgaagaactctacaaaaaaatacaaaaattagccgggtatagtcgtgggcgcctgtaatcccccagcttcttgggaggctgaggcaggagaattgcttgaacctgggagacagaggttacagtgagctgacatcacactccagcctgggcagcagagcgagactaaaaaaacaacaagctaccgtttgtgctgaataggagttggccagtgaagaggcgtgtgaagtccagtggtagctggaagacacttggtgggacaacaggtgaaggcggggacaggaggccagaaggctggggcacagagatgaggggcactgagtgtgctgcagagcccaggacccagggcacaaggctttggccacttcagaacttgctactttcccataagagcaatgagcaggctgggcacagtggctcatacctgtaatcctagcactttgggaggccaaggtggaaggatcatttgagcccaggagtttgagaccagcctgggcaacaaagcgagacccccatctctattttatggaagaaattagggctgggcatggttgctcacatgtgtaatcctagcactttgggaagctgaggcgggtggatcacttgaggtcaggagttcgagaccagcctggccaacatggtaaaacctcatctctactaaaaatacaaaaattagctgggcgtggtggctcatgcctgtaatctcagctactcgggagggtgaggcaggagaatcgcttgaacctgggaggcagcgtttgcagtgagctgagatcgtgccattgcactccagtctaggcaacaaagtgaaactccatctccaaaaaaacaaacaaaaaaaaattgttttttcaagtaataagcaaccgttgaaaggttgtttttttttttttttgagatggagtctcgctctgtcgcccaggctggagtgcagtggcgcgatcttggctcactgcaagctccgcctcccgggttcatgtcattcttccgagtagctgggactacaggcgcccgccaccacgcccagctaattttttgtattttaatagagacggggtttcaccgtgttagccaggatgatctcaatctcctgaccttgtgatccacccacctcggcctcccaaagtgctggaattacaggaatgagccactgcgcccggcctgttgaaaggttttaagcagggaaataacatgattagatttgtattttatgtctaaaaaattttgtcatttatgtcccccaaattaattttattgttgtatggagacagggctagaggaggcagaccaggaagcagggtgggcactttgccctcctttccagtccatcccatgactcttggtggctctgacacccctgcaaccctttgaggtgccatgagcaaaagacacaaaattcctcctttcctggagctttccttccagtgtggtccgacagatagtaacacatacacataagcaagatatggtcagtgctaagtgctcaggaggacgtgaacagctgatggggcagagtagggtggggagggacggtattagagggcccagtgaagccaccctgaggaggggctattgcctggggtctgtggagcaaggaggggccgctgtctggttctcagcagactccccgtggccggagcggggagcagtgggagagcctccagggtgagctcaggaggtaggcagaggccgggtcccctggcctgcaggtgtggagagacacctgggttttgttgtgaatgctgtgagaagccactgagggtttgtaaagactagttaggagatggtcgctgttgcccaggcaaaagatgagggttggtggcagtggagacggagacagagaggtgaagatatgttttgggggagatcggacaagaactcctgatgggttgtggggcagctgcggagagtgagttgccagctctccatttgctgtgcacagttggctgattggttgggtcattctctaaggtcacagaaagtgggagtgaagggaacaaggaaggcctccgtgtggggtcgagcctctgctgagccccctcttctttccgcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgaggtaggtgggcggacgccgacgggagcccagcaattagtgatgtggtggatctgcagggcgccccactgatggctgtcccattcccaccccaaccctagcaagacccaggaagacttggaggctcaggtgaccctggttgagaatctaagaaaatatgttggggaacaagtcccttctgaggtccacagccagacatgggaactggagcgacagaagcttctggaaaccatgcaggtgagggtgcaggaatgtatctgtgtgcagacttagggatcaggttgggaggcaagcgtggcccttggaggagcgtgtagagcacagcctccgggagagaaggtggtacctaaggcggcatggaggccctacagaggggctgctttcctctgcccgcagcacttgcaggaggaccgggacagcctgcatgccaccgcggagctgctgcaggtgcgggtgcagagcctcacacacatcctcgccctgcaggaggaggagctgaccaggaaggtacagcccaacccccagacccctcaccctcagccgcatcctgcatctactgtcccctgcctccctccctgtgggcaggaggggtcaatgtgccccagaacctgcttagatctccttcctgtgaactcctcttgctgtagctcatgttgcccaggcaggacagaggagaaacaaagatgccacctccttcctctcctcccccaggagcccacgcttttctcccactccttctccctcaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtcactgcactctcttttctcccggtattccctcccagcaccttgctccttccatgaaggtggcatccattcaaccagtgtttattgagtggttgccacatgctgggcacacagccctgaacaaaactaaaatgtggagcttgcattctagaacagagacacagaacacgcaagtaaacagataatgttgggtaattatatgtgcgatagaaagattgaagccgggtgcagtggctcacacctataatgcgatcactttggtctcgaactcctgacctcaggtgattcacctgcctcagcctcccaaagtgatgggattacaggtgtgagccaccgtgcccagtcaagtaatgccaacagtttgggagaccgaggcaggtggatcactggaggtcaggagttcgagaccagcctgggcaacatgtgaaatcccgtctctactaaaaatacaaaaaattagccgggcatagtggctcattcctgtagtcccagctactctggaggatgaggtgggaggatcacctgaggctgggaggtcgaggcgaggccacagtgaactgtgatcccatcactgcactctagcctgggtgacaaagcgagatcttttctcaaaaaaaaagaaagtagtaagaaaaattcaaaagataatgtgacggagagactgtggggtgagtcagcctcaggtaggatgctcagagacagcctctctgaggaggtgacagcatctgaggagagtggcatggtcagttggtgggtcttgtggggtgtgtcaagggctattcccatcttcgagtgggcacatggaatgtggaacatggaacactgggctcagattccatcctcagaacctaagcttctgtctccctgcgtggcattcattctttttcttttcttttctttttttttttttttttgagaaggagtcttgttcttgtcacccaggctggagtgcagtggcctgatctcagctcactgcaacctccgcctcccaggttcaagtgattctcctgcctcagcctcccgagtagctgggattacaggcacatgccatcacgctcagctaatttttgtatttttagtagagacaggctttcaccatgttggccaggctgatcttgaacccctgacctcaagtgatccatctgcctcggcctcccaaagtgctgggattacaggtgtgagccaccgtgctgcgacccacccccgtcgcccgccctccctccccccagcccctgcatggcattcttacagagatctctgcacctgccactttgcttccagtgcccccctcatcttttagctctagagggccctgcccagctctctctcctcccccaggtggcctcactccaggaaaaagtgacatcccagagccaggagcaggccatcctgcagcgatccctgcaggacaaagccgcagaggtggaggtggagcgtatgggtgccaaggttggtgtcagcctactagagactcggggagggcaagggagcccctgttccggggctgcagccaggacttagggagggaccctgtcctttgctgcatcctccccagggcctgcagttggagctgagccgtgctcaggaggccaggcgttggtggcagcagcagacagcctcagccgaggagcagctgaggcttgtggtcaatgctgtcagcaggtatcagggatggaggggtgggtggagtagtgtttctgctacctcaggttcctgggcaccttgttgctgaggatcctcaggcaagaggggctggaaagtggccactggaggctacagggctgggcagatttagctctatcaatgttcctgtgttcgtttcttttcctggggaagccccttctgcattcatacctgattgcttgttatgaatttcccgttgcatgtttggctggaggtgaggccttgcttcctcctgcagttcagtctagtaatggcttgagctaaatagagcacccgggaggatcttcacttgcagtattgttcaaggatggagagtgtagacacttcatcttcctttttttttctaaaattttacgggcaatccgtttcactggagaaaaatttagtctatttatttatttattttgagacaaagtctcgctctgtcacccaggctggagtgcaatggcgcaatcttggctcactgcaacctcacctccctggttcaagtgattctcctgcctcagcctcccgagtagctggattacaggcatcctccaccagtgtcctccactacgcccggctaatttttgcatttttagtagggacggggtttcaccatgttggccaggctggtcttgaactcctgacctcaggtgatccacccacctcagcctcccaaagtgctggaattataggtgtgagccactgcacctggcctagtctatttatttaaagctgtatacttacttgcttattatatacttaacttgcttactattccatctaaaatgtaagccagttagtttccttctaaatcaattgccagcctttgtctctcctaccaacttcctagttgtttcattacctacaattgttgtatgaccttcagaaaaacctctaagaaaacagcaaagcttctttgtgctggtgatgacttcccctcagccttagacactgaggtacccaaggcaggtagttctttttttttttttttgagacagagtctcgcactgtcacccaggctggagtgcaatggcacgatctcagctcactgcaacctctgcctcccgggttcacacgattttcctgcctcagcctcctgagtagctgggattacaggtgcacaccaccacacccggctacttttttgtatttttagtagagacagggtttcactgtgttggccaggctggtctcaaacttctgacctcgtgatccgcccgcctcggcctcccaaagtgctgggattacaggcttgagccaccgtgcccggccggcaggtagttcttagcacagtctctggcttgtaaatgttgattgttatcgtgaggctcttcttgatgggttaatttagataaagataatttttggtttagcgaaattaagatgcaggatgagtccttgcccaccacttccttctcttgggtttgtaccttagggactaatttagctttaaaaattatgaaaaatttcaaacttgcacggaattaaactagttataatgacctaccacccaggttcaatccatcgcgggtgccccctacctccaggagaacagaaagatgcactgtggacagggtttgactttggtaccaggtgatcacagaaatggtctgtgtaatgatgcatttgccgaaagtcctccaggcttaaagcagtccaaactctgattgttgctgggtttattagattgtctctaggtaattggagactttaataagagctgtggtaggtgttggaagcatctactggaacaatttccagatcaaagtgaactttgctgtgctgctggggatgcagctgcaagccttcatcatcatgtgtttttctgtgggtgcagacctggactctcctgaggaaaccccagcccggccccagacactccttggcctcctcctggggcctgtttaagctgctcagttttcatgagccaggttggtcctacttctggcacagccagctggtaaagcatgtggacctgcccgtcactggtgctagatcgacactcctgggcttggagaggataactttgttttcttttgtttttttgagatggagtctcgctctgtcacccagtcttgagggcaggggtgcgatcttggctcactggaacctccacctcctaggttcaagtgattctcgtgcctcagcctctggagtagctgggattacaggcatgagccaccatgcccggctaatttttgtgtttttaagtagagagagtttcaccgtgttggccaggctagtctccaattcctgacttcaggtgatccgcccgcctcggcctcccaaagtgctgggattacaggcaggagccactgcccctgaccagagaggataactttactctttgatacacgatagtgagcaaaacacagttgtgagaaataagcttaacaggttgcttaaaaagatagtcatttaatgcattcttggggcaagggtcctttagataattgacggaagctgtgcgttctgtacttgtataatgggacaggattagagggagttgtctatacaaggcacagcaagtcctttgggaatgaggggaggcatggaggatcagtgacttgtgccctctccagctctcagatctggctcgagaccaccatggctaaggtggaaggggctgccgcccagcttcccagcctcaacaaccgactcagctatgctgtccgcaaggtccacaccattcggggtgcgtaggacaactgcgagccacgtcctgcccccaccccaccagctcggactttcttcttcctgacccagctctctctgatcccacatccattcaccttcctcctttcaccagtccttgcatctctttttcccttactccctgtccccactttctcccatgcaaacttcatctctttttctccctgctttttccctcccaggcctgattgctcgaaagcttgcccttgctcagctgcgccaggagaggtgaagtttgggcactttgaggtggatggggctttagggcattggctgctgggacccccaaaaccatgaggactgaggtgggatgggggctttgggatcaggcagctgggtgatttctcctgactctttctcttccccgtctcagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggtacacctggttgccagagggtggagaggatgaggaaaaacccagtgtctagggtgctgggagaggcctgacccagcaccccctccttttaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaaggtgtcgagagggaaatgggtgcttcccttggagggtggggtgggaactgcgaatcaaagctcctgctgatatgccccgtctgcactttcaccccagccctgcaagaaaaggtggctgaagtggaaactcggctgcgggagcaactctcagacacagagaggaggctgaacgaggctcggagggagcatgccaaggccggtgagccttgccagggtggatagggccttccaggaagaaggaagtgttaagacataaggttattattttcccctcaaagtgtgttcaaagcttcattacaggaagtaatgaaggtatccaggagtagcacagatgaattatcacatcgtgaacacacccatgtagccagcaccagattaagaaacagcatatggccggtcgcggtggcttatgcctgtaatccaagcactttgggaggccgaggtgggtgtatcacctgaggtcaggagtttgaggccagcctggacaacatggcgaaaccctgtctcgactaaaaatacaaaaattagctaggcctggtggtgggcacctgtaccccaagcttacttgtgaggctgatgtgggaagactacatgaacccgggaggtcgaggctgcagtgagccaagattgtgccactgcactcaagcctgggtgatagagaaagaccatgtgtcaaaaaaagaattgtgtaatgaatgtatcttctctaactaaatatagcagttaacatttgccacatttggtctcttatctatatacacacatatttgtacatcttttgaatcactttaagttgtaatcatttaatgttttgttgttgttgttgtttgagacagagtcttcctctgtcaccagctggagtgcagtggcatgatcttggctcactgtgacctctgcctcccgggttcaagccattctcctggctcagcctcccaagtagctgggattacaggcgcccaccaccatgcccagctagtttttgtattttcagtagagacgggattacaccatgttggccaggatggtctcgagctcctgacctcgtgatccgcccgccttggcatcccaaagtgctgggattataggcgtgagccaccacgcctaagtaagttgtaaacataagttgttcagccgcatctcccaaagccagtaaattctcctatatagctgcaatcatcacactttaagacagtgaacactaattgcacaaaatctaacccagttcatgttcagatttcccctgaggaactccaggatggttcagggatgaggaagatacttaggttcagattcccaggctcctagagcatcagcccacccctccaactgtacagaagagacagatccacagagcagaacagcctccccaagccacagagttggtgacccagcgtttgttcctgtcttcatggtgcctggctgcctctggcctgactcacacctgcctcctctgtgccttggcctctctgtagtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggtaggagacaggagggcagacaggcagacactagggcccatcctgggctggttcctgggctagaggtgtggaaagaggatggtgagggaggctctatccgggctaggtttaaccctctccttcccaggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaaggtcttgggccaagcacaaagggacaagggacaaatgcgcgcacttcaggaatctcctcttcagactctcgcatgatgagtgttgttctctgcggtccttcgaggcccttagcctcttttagcgatgcccagcttggaccaaagagcctcctctctcccattcctcatttcctgtgccagccctgtttcctctgtaaccacgagcaccttcccttgtctggtgctcatctgctgtcttccttcccagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaaggagccattgtttggaaatgttatttctgggaatctgtgggaattctccctgcagccatctctcttggagattgtgagaagtggtcccacccatagctctctctatgggtggcaccttttcaaatcctttttctaggcagctttggaaatgtttgggaagctcctgcttttctttattctcaacttttgttttaaaactcttttcttctggaagatgataaatgctaggagtggggaagatgaaacattcactcgttcaacaggaatgtcaatgccaggcactgtattagcctgggggccacttggaccctgagagcctacatcctagtgggagagagagcgagcagatgggacctaaacagatgaacgagatcgtttcaaataagtgcttgaagagaaagtacagtatgatgatatgatagaaactgactctggggagaggcctctgagcaggggaccttgtgcagaggcctgcctgaagtgggctcctgtggaggccaggaggtctctgtagagaatgctcaaggatgctgctgcgaggccgagatgtggccaagtttggattttactgtaagtcaatagaaagccattggagtacttctttaaaaacggggaagaaagccaggtgtggtggctcacgcctgtaatcctgacactttgggaggctgaggcacgcggatcacctgagctcaggagtttgagaccagcctgggcaacatggtgaaacttcgtctctactaaaatacaaaaaattagccaggtgtggtggtgtgagcctgtagtcccagctactcaggaggctgacacaggagaattgcttggacacgggaggtggaggttgcagtgagccgtgatcatgccactgcactccagcctgggtgacagagcgagactcagcctcaaaaaaagaagaagaattaaaaaaaaaaaaaaaaaacagggaagggggcccggtgttgtggctcccgcctgtaatcccagcacttttttttttttgagacagttttgctcttgttgccaggctggagtgcagtggcacaatctcagctcactgcaacctccacctcccaggttcaagcaattctcctgcctcagcctccggagtagctgaatcccagcacttttttgggaggccgaggtgagcggatcgcttgagcccaggagtttgagaccagccaacatagggagactccatctatataaaaaataaaaataaaaaacattggagggcatggtggcgtgcacccatggtcctagttactccagaggctgagttgggaggattgtttgagcccaagaggttgaggctgcaatgagctgtgatcgcaccactgcaccccagcctaagagagcgagaacctgtcctcactccccaaacaaagggaagacgcaacatgatttggtgtacattttttttcctgagggacttactggatggtcccttccagagtgaggtacacatatccacgcactgtggtcagcgattgctcccggcacccagcgcagcagatgggtgggtctaaccaggtcacttccccaggagggcataattgagcagtttccgcatcaggtccacgtgggccagcagcatgcggcaggcagcggctgtggcgcttcaggcccagggcgtccccatcagcgtacttggactgcagcagccccaggtaggcctcccacgtgttgcccacagtcttgctgcaggtgaagcagcgcacacaactcctgagctcaagtggtcctcctgtgtcagcttcccaaagtgctggcatgagccactacgcctggcctgatatatatatatatgttttttttttttttgagacggaatttcactcgttgcccaggctggagtgcaatggtgtgatctcagctcaccacaacctctgcctcctgggttcaagcgattctcctgcctcagcctcttgagtagctgggattaccaagaggcatgtgccaccatgtccggctaatatttttgtatttttagtagagacggggtttc

SEQ ID NO: 12815 - DNA, 6285 bp, Human
gaacagccacgtaggcattctcttctctctggaggaaaaggcccagcagctgtccgaggaaaagacccaccagctgtcagcaaagggacatgtcgcagctaagtaagaatctgggtgactcgagtcctccggcggaggccccgaagccgcctgtctatagccgccctacggttctgatgcgggccccgcccgcttcctcccgggctccgccagtcccttgggatccacctccaattgacttgcaggcttcattggccgcttggcaggcacctcagcctgcctgggaggccccacagggccagctgcccgccccggtggttccgatgacccagcctcctgccctagggggcccgatagtcccggctcccccgctggggggcccgatgggtaagcctccgactcccggggtcctgatggtgcatcctccacctccgggagccccgatggcccagcctccgaccccgggagtcctgatggtgcatccttcagctcccggagctcccatggcccatcctcctcctccggggaccccaatgtcccaccctccccctccggggaccccaatggcccatcctcctcctccggggaccccgatggcccatcctcctcctccggggaccccgatggtgcatcctcctcctccggggaccccgatggctcatcctccccctccggggacaccgatggctcatcctccccctccggggacaccgatggctcatcctccacctccggggacaccgatggctcatcctccccctccgggtacaccgatggcccagcctccagctccgggagtcctgatggcccagcctctgactccgggagtcctgatggtccagcctgctgctccgggagcaccgatggtccagccgcctccagcagccatgatgacccagcctcagccttcaggagcaccgatggccaagcctccaggtccaggagtcctgatgattcatcctccaggtgcgagagctccgatgacccagcctccagcttcaggagcaccgatggcacagccggcggccccacctgcacagccgatggccccacctgcacagccgatggcttcttgggccccgcaggctcagcctctgatcctgcaaatccagtctcaagttataagggctcctccgcaggttccccagggcccgcaggcacccccagcgcagctagccacacccccgggctggcaggcgacctcgccaggatggcaggccacgcagcaaggctggcaggccactcccctgacttggcagaccacgcaggtcacctggcaggcaccagccgttacctggcaggtgccgccgcccatgcgccaggggcccccgcccatccgccctggcccaccacccatccgccctggcccaccaccggtgcgacaggccccaccgctgatccgccaggccccaccggtgatccgccaggccccacccgtgatccgccaggccccacccgtgatccgccaggcccccgctgtgatccgccaggccccacctgtgatccgccaggccccacctgtgatccgccaggctccacctgtgatccgccaggccccgccgctgatccgccaggcgccgccgcccatccgacctgccccacaggtcctggccacccagccaccgctctggcaggccctgccacccccacctccactgcggcaggccccgcaggctaggctgccggccccgcaggtgcaggcggcgccgcaggtgccatacggccccacctgctacgcaggtacccgcggcgccgcccgctggcccgcaggtgccccagcctgtgctgccggccccgctgtctgccccactgtctgccccgcaggctgtgcactgcccttccatcatctggcaggcccccaaaggtcagcccccggtgccacacgagattccaacgtcaatggaattccaggaggtgcagcagacacaggcgctggcctggcaggcccagaaggcccccactcacatctggcagcccctgcctgcccaggaggcccagaggcaggctccccccttggtccagctggagcagccctttcagggagccccgccctcccaaaaagccgtgcaaatccagctacccccccagcaggcccaggcatcgggtccgcaagcggaggtgcccacactgccgctccagccttcctggcaggcaccgcctgcagtcttgcaggcccagcccggacccccggtagcagcggcaaattttcccctgggctccgctaaatcattgatgactccatcaggagaatgcagggcctcttctatagaccgcaggggctcctctaaagagcgcaggacctcctcgaaggagcgcagggccccttcaaaagaccgcatgatctttgctgccaccttctgtgctcccaaggcagtgtcagctgcgcgagcacacctgccagctgcctggaaaaacctgcctgccacaccggagacctttgctccctcctcaagtgtcttcccagctacctcccagtttcagcctgcctctctgaatgcctttaaaggcccctctgctgcctcagagaccccaaagtcactgccatatgctctgcaggatccctttgcctgtgtagaggccctgcctgcagttccatgggtcccacagcccaatatgaatgcctcaaaggcatcgcaggcagtgcccaccttcctgatggctacagcagctgccccccaggcaactgccaccactcaagaggcctccaagacctccgtcgagccgccacgccgctccggcaaggccacccggaagaagaagcatctggaagcccaagaggacagccgtggccacacgctagcctttcatgactggcagggcccaaggccctgggagaatctaaatctgagtgactgggaggtccaaagccctatccaggtctcgggtgactgggagcacccaaacaccccccgtggcctgagtggttgggagggccctagcacctccaggatcctgagtggctgggaagggcccagcgcatcctgggccctgagtgcctgggagggcccgagcacctccagggccctgggtctctctgaaagcccagggagctctctgcccgtagttgtgtctgaggtcgcaagtgtctctccgggatccagtgccacccaggataattccaaggtggaggcacagcccttgtctcccttggatgagagggcaaatgcgttggtgcagttcctcttagtcaaggaccaagccaaggtgcctgtccagcgctcggagatggtgaaagtcatcctccgagagtataaagatgagtgcttagatatcatcaaccgtgccaacaataagctggagtgtgcctttggttatcaattgaaagaaattgataccaaaaaccacgcctatattatcatcaacaagctgggctaccatacagggaatttggtggcatcctatttagacaggcccaagtttggccttctgatggtggtcttgagcctcatctttatgaaaggcaactgtgtcagggaggatctgatctttaattttctgttcaagttagggttggatgtccgggagacaaacggtctctttggaaatactaagaagctcatcaccgaagtgtttgtcaggcagaagtacctagagtacaggcgaatcccttacactgagcccgcagagtatgagttcctctggggccctcgagcattcctggaaaccagcaagatgcttgtcctgaggtttttggccaagctccataagaaagatccacagagctggccattccattaccttgaagcgctcgcagagtgtgagtgggaagacacagatgaggatgaacctgacaccggtgacagtgcccacggccccaccagcaggccccctccccgctaataggtgtagcagagatctcgctcctgtgtttccctggccagaggccactgacagggtggggggacatttttgttcctggtgtttgtgttccagttccacgagtgtacgtttggattttcaacttggtttcgtatctgccaaagctttgtacattttttatgtggtgttgatttcaatcggctactgttctgttctgtattttggcatctgtgtttttaagtgagatctgtggttctctgttttgtgttttaattgttatgttttggtatcagctttgtgctggctttgtgaaatgaattgagaagctatccatctcatttctggtatagttcatgtagcattgtaatcggttgttctttgaacgttcaaatgactcatcagtaaaaactgtctacagagaagtaaatatctatatctatatatataaatatactttcagcataacagaagtgtttgtctttattctaatttttacactagatggtggaagccaagttttgccgtattctctgaatagacatgaatagcaagactactctcagttatagtaaaaaccacggtgatggaattgttttccaaggagagtactccattcatctttataaggatgcagtgatttcagtgggtggttatacataagatttctccaggagattaattaaagcacacacgttagtgcccagctggtaacgttgttattagaagcagaaatgtccttaagggtatgtggagaagaagggccatctgcctgcaggactacaaataaccaggtggtcccgcttcatggagaatttggccaaaagggtatttgtcaatcatgtggcccgtggcggggtgtccagcagttcaaatttgggtttcatcaacacactgctaccgggatggaaacgtgctccctgcaggatatccaggcttataacagggaaaaggaaaaaacagtcttcatttaattagaaaccctgcagattgccagcagtagtggctgggttaggggagggcgtggcagggtgcattcctatcaacatagagttctaggggaaggtcctggggggaagggtcattctaacttgtaggggaaggcagccggcaacgcctgaagttgctgaacaaccgcggtcagcccttggctatgaacctggtctaggcaggaaagggacaagggaatgaactggcctgagtgttttgaggaaggatattcaagcacacaccaggctggtgtacacaaaaggacgttcttgtggtcatactctcttcctgtggacaggggaccatcagccctacttgccaccgcatactgtcttatcagaaggaagaaatccaatcccatatcccgcttctagggtgaagccaaagtcccagatgcggttagtggcgatggtggaattctcctgccacctagcggcagattagaggtgccaccgcagctgccgcagcaacagcccctcccacagtgcttaacttcacaaccatgtatatacttggattgcagctactccttgcttcaccacttttgctcataattttatctatatctgtgcccagagattccttcttttctcttataggccaaggtagcatctgttttcaagtccaatccgctcttcactcaacaatttctatccttggtcctgcagcgctgccacttaggaagctgactaggagaggagcccacaagatgcagactctactcctagcacccgcagaactgagctttccaggacgatgatccccgccccaggacctgccaggccgcaggagctctttctcaagttgtctaagtggtcaggtagtccaaaaactgggaggcagtttcctataaactccttgggtcagagagtcctgcgcatttgtccgcaagcaatgtttacttatttttacaacaacagcaaatgtccattgaaggagacagcaatgccccagctgagaactgtccccaaaggaggttttgctgggccagtaaagtggcatattggtctagtatttcttgtttgtgtttagtttatttatgattgcttataaagttttctccagaccattaactcatggcgtgcctgagcaagatgctctttgtggaacaaaatttgggactttgttccaaatttgggactttgtcccatcatgggactttggtgccatacttaaggtgggggctggctctgctccatggtagagaggcttacttcccagctgcaaacctcactctcacacgtgacatatatctaatggccttctttaagtaatgccaaggacttaaagcctaaatttgtttatattgtaatgagatataaattgcaacaatgaaaaatgtgttcattaccaatgagtaaactagttagatattcaactgaaaagtttaagaaagtgcagctaacatgacagtgaaaagcagaaaacaaagaccaggaatatagaaaaatacaggttaaaaaacagcgggaactggcc
